United States Patent 10,233,495 (METHODS AND COMPOSITIONS FOR SCREENING AND TREATING DEVELOPMENTAL DISORDERS) - sequence listing, part 26

SEQ ID NO: 258 - DNA, 2867641 bp, Homo sapiens (residues 1-1,433,821 of 2,867,641)
  misc_feature (283802)..(283802): n is a, c, g, or t
  misc_feature (283822)..(283822): n is a, c, g, or t
  misc_feature (283824)..(283826): n is a, c, g, or t
  misc_feature (283828)..(283829): n is a, c, g, or t
  misc_feature (283831)..(283831): n is a, c, g, or t
  misc_feature (283926)..(283926): n is a, c, g, or t
  misc_feature (283930)..(283930): n is a, c, g, or t
  misc_feature (283936)..(283936): n is a, c, g, or t
  misc_feature (283946)..(283946): n is a, c, g, or t
  misc_feature (283973)..(283973): n is a, c, g, or t
  misc_feature (283977)..(283977): n is a, c, g, or t
  misc_feature (285181)..(285181): n is a, c, g, or t
  misc_feature (299588)..(299588): n is a, c, g, or t
  misc_feature (306297)..(306297): n is a, c, g, or t
  misc_feature (306303)..(306303): n is a, c, g, or t
  misc_feature (311059)..(311059): n is a, c, g, or t
  misc_feature (311063)..(311063): n is a, c, g, or t
  misc_feature (311111)..(311111): n is a, c, g, or t
  misc_feature (1615094)..(1665093): n is a, c, g, or t
ggaagaggtccctaagattaacaaaatcaagggcgcagagactgagacagcgcctttttggtgaccaatgtgtccaacgagttttgttttcagttgcgcagcacccaccttcttagcagaaactccctgttcgggcttccctgtgccccacccccttccaggcctgatggccctaggcctccgtgcttggttggccggcaggctgactctggtggtagatctgactgcgttgccctccggtaattggagttctgttgacaggtgagcagcgcccttgggtagttggaggtctgttgacagctgtgcgcgcccttcagggtcagttccctctcaggcctgcagggcctcattctagttgcacatcaaattcctaagcactgtctcctgtggcgccctcccaaaccagaagagcttcccacttgagccgcatgcttcctgggcttcggagccctttcctgcaaattatatagggcaggtccccctgcaccatcagatttccacctttgctgttttatttttcccaaacttcttattttaaaagttcaaacatttggaaaaactgaaaagacagtgtagtgcatacgcttgtgctctccaccgaaagttcagtagttaacattttgctctagttcttgacatcccaaaatacatacatgtgacagcatagaattcaccaagagtcttcagcattcctggagaccaggattttcaacccagccatgctgacatttgtggctgggtaagtctttatggtgagatgctgtcttgcgcattgcaggatggcaggggtaccctccctagtcgtgaaaaccaagaatgcctccagacaacctgggtggtggggtcaaccttggccttggattgggagcaagtgctctagaacaagagcggtctcctacacagctgcagagggtagccccctgagaaattaactgttccaggtgtctcctgactttcagtgcatggccacatcatggtacctaacttgtggcaaattgttgctttataagtaaggatccagtccaagttcatgtactacaattggttactttggtctctttgcttctggaacagtccccaacatttattgtggcattgactttttatagagtctaattctataattagaatgccctgctctggatctatcagaggaaatgcttcctcgtgcatttaacctgcttctccactctctgggtttactgtacactggactcctggtaggagcctgattagaggcaggtttaatgtggcaaaaattcctcctagcggggcaaggcccccttccccagaaggcaggcagtgtccatctgctccaggattggtgtgtttctatcaagaatggatgttggattttggcagtttcctttttggcagctcttgagatgatcacgtggtgaatcattttctattactacagtgaattacagtcacttgaattccatcctactgggtcgtgctgtagtatcctttttatgtatgctggatttgatttgctaaaatcttgttaagaatttttttgtctatgttcatgataaactgtggtctatagttttcatgtaatacctggtttgggtatcagggtttttgccagccttataggatgagtttcgaagtgttctctcctcttcagttttccagaagagtttgtgtagaattggcattacttcttcccctaaatgtctgggtgactgtctttttaaaaattttattgagctgtaagatgcatgcagtttactaatcccaagtgcatggctcattattccttaatgctcagactgtgccatgtgtggccagttgggggcgctccaggcacctttagatgccgccccatcattctgtgagcactttcttgctttctggttcaggtatgtgttcaggctcatcttttcttgttttctccgtgtctcagtcctggaatcggccatttttccacagagttgtagttctttctagcaggatggggagtttcagtaactgcctgggcccaatgctgtttgtgcttcagaaggtttgggccaggtcctggttccaccagcagcaggcatgcctgcgttgactttctgcttctcctgctgatttggcaggggtgactggctgctcctgcctcctttgtgttcccggtcgtgtctaaggccaggccccttctgcccaggcagccggcgtggctctcttcttgccttttggttgcatatctagtggaatctcgtagtggacctggcacttgtagcaatgtttgatcagtagagtgaagatgatgacatttccctgcttccctgtgttatggagctgtcttgaggggggcttttggtaaataccatcgtcgaggtgtgtacagaatgccaagaaacaggagattggggaaggctgtaggcacagctggagccaggctacctgcaggggagcctcaggggccgtggagttccctggagacttgccaccagagaagagctgcaacatcagggctcttcccaggaacagagtgttggatttcacgttttgttgtggccagggacccctccttcctggggaactgtagccatttggcacttaatgcactggcgccagctgcggggtgctccatgttccattttgccatgatggtttatgtcccatgatcgcttcctctgtacactcccttcagactagagtttgcacatctgtgtttgtgcacagtttagcagggaccgtggagctttgcttggtggccgagggtgagcccctcaaagccacacagactccctggcccagagcctcacaggcttatgacaccccaggttcatcccaaacttgggcctcccaggtcagctcacccttctccctctggtgctgtgtaggggctgggagctgcaaatgggggagggggctgcccaccctgaagggcagcaccaagggtggaggggccaaccacacacctggtaggcagaggccccacgctcagggtcagcgacccggctcctcctgctcctttcccatgcctttgcctgaggtggtctccaacacttgagtagatgtcctatggcctgtggccacgggggccctgaagccctcagactgcagcctccctcccgcctgccccctccagctgccctgggtctggggctgcagctttggccccacctggccagtcttccccacccccactctctttcagtgccccgcaccttctggaatcccctggagacttgccgtgacagtggggtgggaggatggaggaggctggcgtcctccccagtgcagacacccctttggcctggctgctctgctgggttggtaaggcaggtgcccatgggtgagggctgctgccgagtcccaccgcctgctgacgggctctcatccctcccagtgctcaggcaggcgctgcggcagaagcaccaggaagcccagcaggcctgccggccccataacctgcctgtgcttcaggcggctcagcagcgagaactagaggtactggggacgcaggcagggtggccggcccagctctcctgtgggcaccacctggctctgctgactgggctgagctgaaggggtgtggggggctcaggtgtgggtggctaccctgggcctgagtgggacactggaggcctagtgagtcccaccaggtggctcctcgctgagggtgccaggtgtgctgggactgggtggagggtgagaacccaccagtgctcccctggagtccattagtgcccctcgtgggttggggtctccgcagagcaggtggcctcggggggtacaaaggcaatggtggggtgatggggccagccaggaaggggcccatccttctccccgggagcacagggacaaccagagaccggcatgtaaccaacaagtcatggggcagggtgtgcctgcggagatgtgtgtgtggtcccaaggcagtcccaagtcaaagcattcgtggaagccccttggggcccccttcaggggttcacttggccgaggagaggcctgggtgtggtgaggatgcattggtggtgtcagagctggtgctgttggggacagcagcaggagcatgtgtttgagctgccctcacctcccccgccgcccccggccccacggcaggcggtggagcaccggatccgtgaggagcagcgggcgatggaccagaagatcgtcctggagctggaccggaaggtggctgaccagcagagcacactggagaaggcgggggtggctggcttctacgtgaccaccaacccacaggtcagtgcctgggcctgctctgtcctagcccgagtgcccctgggccccattccatctgggatttcactgctggtccctggggagccaggctcagggtatagggggtgaagtggaaggattgaggctctggaaaggatttctgtgccattcccagcatggaggccaggcccattccctacaggggggtgagccagccagccatgggcactgcccaccctccccaggcctgctgtgccccacagggccctcttctgctcccctcccgcatgccattccaagtggccctgctgggtgcagaggctcagattccgagtggccctgctgggggcagaggctcagattccgagtggccctgctgggggcagaagctcagattccaccctgtcgtagcaggccatgaccaggcttcacaggatggtcgccccgtgggctcactgcctggcacctttgggccgggatgaaaggggcctgggggtcactctggccttcatggggcccctctgtatcccaggagctgatgctgcagatgaacctgctggaactcatccggaagctgcagcagaggggctgctgggcagggaaggcagccctggggctaggaggtccctggcagttgcctgctgcccagtgtgaccagaaaggcagccctgtcccaccatagccacaggcagcagaagtctgggcagagttcatcttcttgacctttggccactgccttcccagctgcccgcagggggttccccctgctgaggagagaccaggtggaccccagctgcctgtcacccttcatctgggacttgctgtcaaaccctaggatagtctcataaaggggaggctgggccagcctgctgctgtctgcttcagggccaggcagagagtgaggctgggggttctcacaccttactccaccgggcacatcccaacctgcactggggcccactcgagcgcttgttctggtctcagccgctcccttggcagctgcagcccccatgcagaagaggctcccaggcccaagctctgtgtgacccagagaaataaagatgcctcagtgtggcccgcatgtggcttgtgtgatagctgcaggttctgccataaccggggccctggtagggcccccacctctgttgcagcagaggcctctacctgggggccccttcctgggctgtgtgcccagcccaccacccctccccctgcctggagactgggaccctccagcctttcctgccccagccctggtcccaggatgctgtcactgccatctgtacaggggcccccatccaagccccagggcatgaggaccacatccagcctgctttgtggggctgggggctggagagcatgggagaaggcccgaagtgcaagtatgcgcctgccgcagcctggtcagtgtcctgtgggaaccactaggaggagcctgatgcaggtcactggggtagaggactcagggtggcaggaatggcctgaggaggagccctgcggggaggcgtgccaggcccacctggggagcttggcctctgcatctgcatgagtcccctccgtgctggcctgggcccatgggccctgctgggtccttgtggagtcagggttgggggtgtccagcaccctgggtggccaggtctgcgcagggcctggcccccaggaacagatgatgctggaagccagagtctgggatgagacttctctgaccctgtctgagccactccctctttgttgcccagagctgaccctgtgtgagggcaaagggctctcagctgcaggaacagtggtttattgaccaggcaggcctccccagcccggccactgctccccaaggggctcgggctgtgtgggctggccttggcagaaggtggacaatcctctaggtccaaggacatgggggtcacagaggtgggggccttgggcccacacattcgaggagagttcccaaaagtttccagtggctgtcccaggcaggtatcaggttcggcccacacctgagtgcccatactctgggcagggctgggaggcacctgacctcacctccagcagctctgcaagtgtggggtgaaaaaaggtgaatctgtgtgaggatggggttggctgcagctgtggtgatggcctgggcgggggcggggggtgctggaggctaagggtgtgctggcgggtgctaggcagggcgatggaagaggttgccagttcggagccgcctcaagagctccagccacagcagctgccgctcccgatgggtgcccttcatgaggctgctgttctccagggcacggcgggacaagtagggcagcacctccatcacggggccatagggcacgtacttgtacacggggtagccggcctggcctgcatgggggcagatacaccatgaggcccaggcccagcaccgtaccccatcgcaccagggagggccccactcacccagcgggaagctgatctggtcacacatgcctagcagctgtccaaagtacacccggtggtcagcaggatgcaggcccagctcctccatcctgtgcaggtgaagccaggaactgagggccagttccaggacactgtccccagtgcagggatacagggctcctgtcccagctctgagcctgtcctgccatcccaggtgccccatctgcactctccagacttcatcccctgcaaggtggggctggggtatgggctctgcctggccctgccccagtgaggcctcttcccagcaggactctgctgggctgccctactcgtctccctggggaggcctcagcccttggccaacaaggcctcccacctgctttccctcccctctcctctctcacctctcctctagctcccttcttggaggtgcagcccttcctcgggccctgacccacccagcagcctgccccacagggcagagaagctcctcagctctcctgccatcccttcctcaagcccctccagggttctgtggtatgactggtctccggcccctgccctcgccctctgtgggctgctgccctgccccatccccacagctgctgtgtcccacacagctgccaccagcccccgagtcctcggaaggcggctgctctgaatcgagatgtgttgcaaatgtcaaatacacacgggatttaggagactttgtagaaaaataatgcacgatgccgcgttgcttttctaaaagcaactggaatacaatttgaagtaatattttgaatattttgggttaattaaaattattcttgaaattcattttatctttttcctttaacgtagctactaaattttaaattacagatgtggcttgcattatatatctattagcactgctcagatactggggtggggcctccactctgtcctgtcttcacaccaccccgtatagcgtcttacaaagattctcagggtctgaaatatccacgcagtggcagttctcaagtttcatctccagcttactatatccaggtatcccgacttcgctggtctgcaaagcactggggtccccaccctggggtgagttccgcctgctgctcacgcatcacccgggaccacccagtctaaagcaggcacccatctctgccacatcgccctggcttccatcttgtgtcttcctcaaccccaggacatgaacccgagagccgggtgccactgctggctgccccctcccctgctggtgtgcacagcctctgccatgtgactgcggctcctcccagcacaggacagtggctcactccacctggcatctgggcttggcctcgtgaggcactttggccagcagggaggtaccaaaggtgacacaagcagaggcttgccctctccaggccttctggaagcctgagcccaccacgtgctcaagcctgggctggcctgtgggacgctggacccgggatgcagtctcctttactgccccagccatgaatgagctcattaggccccaccggccccagatcacagacgcaggagggacacaggcacagccagcagcagaagcatcagctgagccagcccacccctggcctacagaacatgccactgttccagcctctaagtttggggctggtttgttccttggccaaagccaactccgattgtttgagggtgggtggtgtggcagtctgggcccagcacaggacagagcagctgccatagtctagaaccacttacccatgggaggggaccccagctccccagagctccccaaccacccacagcaggggcagagctgaagcctgcaggggtccagcctctcaggcagggatgtgagcgtggtactgggggagcctggcacagggcccttggggccaagaggagagagcccggctgccactcaggggagggggaagctgtgtccactggggaagccactgccacagcaagatagtagggacagacaggtgccgggcggaagctggagagaggaagccctgctgagggcaggctgtcctttcggagttggatggtgatgtgtctagtcaggctgtgagtccaccagcattgagagtccacccagaggctgggagtcctgattacaagctgagaggaacccccaccagctcccgagtgctgggcagtgctggccaccaggcctgtgcgtgtggagaaagtgagtctgtcccatcaccgacacatctatgacaattagcagaggatcagggcacaaaaatgggtgtgctgcaatttcaggccatgaaaaagtagcagcatcgtaaacaaaggctgaatgtggacatcactgaatgatttcagagccgtgagtcagctcccgagcagcaccaggatgtgtcctgttggctgcagccctggccccaagcctggccctgtggcttcacagcttcttggggagccccctcgtgccacaagccctggatctggggcaccctgccctgctgagagtggagctcctgctcagctcctaggaaggcgagagccagcgaggccactgcccaggcccccgagggttctagggggtcccatccctgggaaggcggaatctgggaggggagggggacctaggaccccattgtgtgcatagcttggactaaggcatgagataagaccagggtgacagtacaggagtatccaagaactgacttcacctaacttctgcatttgacttgttagaattctaccgaagttgtgctccatgggacaaatgtttaaagagaaaacaaaccgttacattccagatgtagttaaaatgttaagggcgtattaatgaggtggcactgtggaggcctcctgagggactggcctccaacactgcatttgtacctttcaggagccatccgaataccctgatgaaatttagttttttaattgtgaagtttaataagtcagatgttaatttttaaaagtctgggtacagtggctgatgcttgtaatcccagcactttgggaggccaagaagggaggatcacttgaggccaggagtttgagaccagtctggccaacacggtgaaaccctgtctctgctaaaaatacaaaacattagccaggcgtggtggcacatgcctgtaatcccagctacttgggaggctgaggcatgaagaattgcttgaacttgggaagcggaggttgcagtgagccgagaccacgccactgcactccagcataggtgacagagcgagattctatctcaaaaaaagaaaaaagttaattttaaaaaccaacgtaactgcaaaaagccattgtgctctcacagtccgatgtccagaacgccagcgggcctgggcctgcccactgaagccaccctccagctcatttcaccagcctttccccacaaatgcccgaccacccagcaggtcgctctgcccaccctgagctctgcgctgctgccacctctccccagccggaggagacaacggctcaggttggggtttcggtgcagggtggggcacacctacctgcgcagtgcaaagcgcactgtgtcctcattgtgggaggccaccatcaccttggccttggcgttgtgcttcagctcctccaacacgtagtccaggcacctgtggagagtgccatgtgagcccagttccaggcctgtggctgcctgcacctctcattaccagctgcacagagaggaggccgagggcagacccagatccatccattgagctggctctttccaagggtatccacaggatcaggaggaacaggagcagcatctgcccctcccagcacctcatgaaaaagaaagaccagcaaccaagcaaaagcgatgtctgggaccagacaattcacgcagaaccagctgtgggggcagagtccctgcatcaaacgtgctgtgactctggggaccagcccaaacatgcccatgagcctcatgacagacacagctttgcttctggggagggatcgtacagtgcacccctggccctgcaaggaaataaaagggaagcaggtccctgtagggcacagtgggggtgggcatcccggtgcaccaggaagcccgagcagtacggccctcctgcagcgaggtcactcagcaggcttgaccacacgcacgttctctctgacccagcaattccatttccagcaacctaggacagctgcatcctcagacacaaaacccctgacggcccgtgtgtaccacagagggtgacggtatgtccagcgagtccattacaataaccagactaaaaaccaataagatcaaagatgctggacacatagccccgggcactccatgctggctgttgacagcaccactctgcaagcccacacaagaggacccagatggaacgcgaaatgaaaaacacatcgggcagaggacacgctacaacgcaaaaaacaatggcggagatgtgtgcgctgtggcacgacatgcacagcggctgcaggaggggagctggagccaaccaggagacacttggggtctctctgaatttgcagcatgcacacacgcctctaagaggaaaagcccatggttggccagcctgtgctacatgaaaagatcaccaagaaactagagcagtaaaagcaggtgcagaacagctgatgggcgatcccactgtgtgaactgaaaagcaaacaggctgagcctgcagggtggggaggaccgggtgttcatgcacatctctggatctaagtgtctgcaggagcaagctcagggaactgtggccaattttgctttgttcaataggcttttctatatttataaaagaataaccttaatgcttttgaaaaagtaacacatgacataaaagctgaggaaataccagttctgacctggggacacatgtggctgacaagttcagtctccaagcctctccctcaggcctggtttcttggcgccctgccctgagaagacagaggggtgggagagctgcgcacctgtggtacatggcgttggtggcctcgtacgtggggttgatggggtcctcatagccgatctctgccgcacgggctcgctcctgggccaggtatgcgccccgcaccagcttggccccaaaacaccagccctcacggcgagccagctccacgtccagggtcacattgtcataggcatcctgtggggccagggccaaaagtcacagggagcctgggcaagcccaagtgacagcaggatggggccttcctgggcccaggtgcagtcaccagggctgggcagcagctgcctggggaggtgcagctcagggcacctggagcaggtgtgggtgaggatgggcctccaacctctgtccccaaggagcaatggcagtggggacgtctgcaacttcctgtgtggcctgtggacggccctgtgggtgcagcccaggcgccagcagccatcatgtgctccagactcccaggccgaccgggaggggtgcatactgcatgctcctgcctggacccctccccatgccaccctgtgtcctctgggcatccggctcacccctgagagctctggacctgctaacatccctgagcagtttggggcccaaaggctagggtgggctccctgaatacatgtgacatcctgggtgagtctttccggggagggcccaaagctttcaggaggttcttaggggcgctgaactgaaaacacgctggaggaaatggtcatgtgacaccttccaagtttggggtgtcgggtacatctagtggaccctcataaagattgttgtcttcctcctgctccttagacactcttggctggttctgagaaccaggggagaggttgcgggcagcgggtctttcttgctactctgaggcagtcaccctggcctcagcctcctctgcaggcctggctgtggccaccacctaaggggctctttcctggaccctggggcccgctgggtgagctgtgctgcagaagaccccaacaaccccttgggggcacggcccactccctcctccatcccatgagctccctggtgggtgctgagtgtaaaaccagccaaatgccagggagctcagatgagaggagcccctcctgtggggtctccaagccccagggcaggcagggaggggctgagcgggggcttgccttgaggtagcactggtatgtgttgaagatgagcggcttctccacattgaacttccgctgcatctccagcgtcaggcggctgatggccggctggaagtaggtctgctcggcatccaccatcagccgcacgcccatctctgtggctttctgagaggcgcagggggtgggagagtgggagcaactgttgctcaagtgaggcaggtgccctcttctccacgagtcccaggtaccctctgcccgagcgggacagctcaccttggccaggacatccatccgctgtagcatcctggtcatctgtagctcctcctcctcagtgaaccgggacagcaggggctccagctgtcctgtctgggggtgcaacacgcggtcaggccacagcaagggcgggaaagtgccaccctgaggcccaggctaaacctctctcagtattcccagcccacaggaaccctctcacccgtctgtgcagggctgggagggagggccacctggacaagcagcacagtgcccctgaacctccaacgcagccagtgcactgccctatgcggggcctaggggtaccacgagggagctcagtgcccatgtcagtgggccccaggctcagtccaggcctgcactccgaagtgtgtactccccagttcccacagaggccccaccgttgtgggagagccccctgcaactcccatgtgacattgaacaagtgaacactgatcacccaatcgtcaaacagaagggctccacccggagcaggcagagggcccaggaggaagacccctggctacaggcagacagggcagttgtgcagcacgtgctgacacgtagccagggaccagggcaaccaccaggatgaggccttcaagttgctggtgctcagaggccgtggggacccatcccgcagggcctcccgctcacccctttgctggccccagcagccttgcctcactgggcacaaacagtaccactctatcccttgctacaccatgctaaagtctccaacagctggtggccttggtgcacagccacactgtacgcactgcgccccgaggctctgggtcgggggctctaagtttgaggctgggcccttagtggactggggctagatgtgtcatggaaagctgcctctgcaggatgttttctgaaggtgcttctgttctttctttgaatcccagtttaagctgtggtttcaagcagtctgccaggtcctgggcccccctcccacaggcagatgagtctcattcctctccccgctgtatacaggctggcctggtgacatgcttctaacaaacagaacttgccagaaaagacaccgtgtgacttctgaggcgaggcaggaaaaggtcacccagcttctgcctggctctcacgtctcaggtgacactggcccttagagcccagctgccatgttgggaaaaagcccaagccacagccagcaccaactcccagacatgtgaatgggtgcctcccccaggtcccagcgccaccactctgtgagtacagctacccaggagaccccaggggaggactgcccagctgagccctgtcaaccccagaaccatgaggcagaagcagagtggctgctgccgtttcaggcctctgaagtttggggtgacctgatgcacaagacagatgacttggggaaggcccccagaccccctctccttgtggtgtcttaaggctccgcgtgggtctctgtcccgccaagcactctgtggacactagtgggcttgtcttcttccccctggaccacagggggtctgtggggccatagtgtgcagtgattttggtcatgttaagttcccagggtaggcaacaagagacacacgtggcaggctgaattcccttcttagcgcagcgccctgctgagctgggcctcactgaggagcggaggtgttacctgtgcgttggggactaccaagtgcttggacagcttggtcctgctgtcgatgaggctgctccagtccagcaggtccatggtgctgagggaggaggcgcatcagcagagggggcacccccacctgtgggtgctagggtcgggtgggggatcgaggcccaaacctgtccgttcaccacccaccacaaaacccacctcggtgttcagttttaaaagacagaggaaatataaatattgttttctgtttaaaaatttaaaaccagtggcatgcgggggctcaaacttataatcccagcactttgggggctgcggcgggcaggtcacttgagcccaggggtttgaaaccagcctgggcaacatggtgagacctggtctctataaaaaataaattaattaaataaatttaaaaccaaaacacaaacagtcctgcatctaggcggctctgaaaacactgagtaccctaggctgttttgggcttgtggaggggccgagcacaggcagccaggcaggaggcggacacagctccgggcggccagggaggacacagtgggcaaggctggcagtgtgtgaggggatggctcactactgcaccaccccagtcacctccccacttcaactggaggctcctggtgatctgggtcccagcccctggctccaaggatggggcatggggctctgatccttcacctgccggcgtggactccagggagggctgagagtgccacctttgctctggacccagataattctataaagagccctctatggggtctgtgctggccctgtgtctcccctgcccagcccagccccagcctcagggactcctgaagccatcaagtcctgctgtgtgaaaagcagttccttcagcactgtcatcccagggcccaccctctcaggcagggcagccaggactgggagacgtcactggggcttggctggaaccatggctgatgctcgtgtcctctcagcctgggggctgctctcacccagacactcccagggtctctgccgtgaaccagtcctcaatctcagccctggatgcgatgcccaactttgcgacactttccttgagaagtgagaaggcctggatcagccccattcactcatattttatccttccccccacccattggcctctggtgctgtttctggctttattacatcgttagtaagaacaggatccatgtctggtttgtttctactgcatagacaggtctattcccaccccgctgctgatgcacgcccacgccctgcagggctgggtctccagccctcctgccagcatctcccctctctgttcagagtccctctgacctcctcctccccaccaggccaaccccagcagctgcagagtgagccacatgccctgggtgagttcccaaaaccacctccgaccactgcccaccatgccccgtgtgaccccacggtgcccaccccctcacaagccacaggagtggggaaggggaaggctgccccacctgcagcaccgccacctccagcttggtgtccatggcagccaggcccgcctgcccttgctccacagccatttggtgaaagaagcacctccacttggccagcacctctgagaactgcagctgcaaacgcaggcctgaatgccatctgcacacgcccctgcccaccccagtcccccacacagcccctgtggccagctcaggcctctaaggcatgggcacctgtgtttttggtggatgcccacagctgccctgagatctcgcacagcaccagactctgcaggtggaaggttctagcacttaccagaaactggggtctccccagtgctgtgagcttaatggctatgaagccgtcatcgctgactctacctgtcagaagccacaggaaaagccatgacagccctgagaggtgcatggaggcagcgcagggtgcgacagggagggccagggcctggccagcccacagcaggctcctgaccccaccccaccccgcccatgaagtccttgcacatggcgctctagaggccctgtggagatgggagggggctccgtggcggggtttctgtttccatgcaggtgtgggacagcagtgggcacaggagctgcctgtcccctgccaagcagcccccacaggctccctgcctcggtttccttccctgtgccaccagcaccacaggctgctcacacgtgggtcacaggacccagaaacaccgagcgtggctaagacagagacaccccagcgaggtccccttgctcaggcctctgccccagagaccgagtctctcaggaacctctgacgcaagcgcaggctcctgcccccgtgcagccagcccgcagtcccaccctgtcctccaggccagccctcctgcagcattcttgcccctgacacttctttccaagcaacaaccagaaatgttcctttaaagtgaaagcagatcttaccatctcatcttgtttcacgccaccccaatgcagggccttccccttccacctgccctgggagaacaggcaatggacgaggagaagacgcccctcaccctgatggcccagcattcagctggccactctgaccctcagcccccatcaggaggcggcttccaagcactgctcagaagtgccaggtgcagcggcatgcacctataatcccagcactttgggaggccaaagtgtaaggttcgcttgaggccaggagtttgagaccagcctgggcaacatggtgaaacaccatctctacaaaaaatatgaaaattagctgggtgtggtagtgtgtgcctgtaatcccagcactttgggaggccaaggtggagggatcacttgagcccaggagttccaggccaaccagggcaacatagtgagacctcattttttttttttttttttgagatggagtctcactctgtcgcccaggctggagtgcagtggcgcaatcttggctcactgcaacctccgcctcctggattcaagtgattctcctgtctcagcctcccaagtagctgggattacaagcgcctgctgccacgcccggctaattttttgtattttagtggagacggagtttcaccatgttgcccaggctggtcttgaactgagctcaggcaatccacccgccttggcctcccaaattgctgggattagaggcgtgagcactccagcctgggtgacagagcaagatccagtctcatttgaagcaaacaaacaaaaacataaacaggcctgggacccgctgcccctgacggagggctgctggggccagcatggggctgtgcaggtcggatgtttctaacactgaaggacattgggccttgctgacctctggcttctctatccctggaaacacctgctgcccccaccgctggcccccagaggctgtgtcagggaaggacagaagatgcggcaccagctccctgaatggaacctccaccctgggctaagtgtggctcggcagctgacatggaccaacttcctgcagctcccgatcctggccctgagccagggagaagggtggggggcatgaggcgggatcagggaacagggagctggggcaggagaggagatgccttctgggaggcagtggggcccctcaggaaggggctgaacagtgagggacccaagtgtggtcagaacccagccctctggctcctgccccagcttagtgttcacccaccggcacctccatgagcccaggggtccgctcaggctgggacatggcaggggtatagccagcaaagagggggccccacctgaggcttcgatgcagcgcaagaatgtctccatgtggctgtcgcacttggcctcattggcgtagaagtaggtgcgggcactgatgacaccattcctgcggtccccgaaggcccagtgggcctggtattgcttgtcccgcttattcgtgcctggaatagcgaatgcacggcctgagcacagctccaaacacccacccccagcacccacacaccaatagcccagggcccctgccctcaggagggctccaagcatagtggccttgccagcctggccctggcactgcactgccccatggttcccatccccaagcccaccctcctgtctacaccgcggctcttccacctggagtgctgcatccccctggctaagcctcctcatgaggccaggacggcagtctccttaacaaaggcctaggtccaccaggaggccatgaaaaaggagcagggcgtctccccagacacttgcgagtatgtcagagcccagagcgacagggcaggtgccctggacatagggaggagcccgggctccgacgtcaccccaaggcccacttgtgccccagcctagactctcctgagccaccaaggggtgtgcggagtcgggagggagtctgttcctgcgcggcagcctctcactcaccactgccatccctctccgcagctgaggtgcaggacctgtgggaaggagggggagagcaaaggtcagggtcacgccacctgagcctcaggtgacaggcacgttcccactgaggctgcacggagggccccaccacaaccccggtggagggtagattccaaggtgcagccccagccccacccctagcctggggtggaacacttgggcctgggaggggcagcagtttatggggctgctgtgtcccaagggctcaggaagcccggggctccttgtgggtggagaaatcagaacgatattcctgagctctcagaacagcccagggcttgcagcaggttctcaaataaaggtagttacctggttccaagacagagccagtcagggctgagaggaacggaggcgggaaggcaccagcacacagaggtccccaaatccccagcgaggcccccttactcaggcctccaccccagagccagggtctcccaggcagctctgatgcaagcacaggctcctgcccccgcacagccagccctgcagtcccgccctgtcctccaggccggccctcctgtagcattcttgccccgacacttcttttccaagcaacaaccagaaatgttcctttaaagtgaaagcagatcttaccatctcatcttgtttcacgccaccccacccagggttcccatcatttcctagtaatgcccaaagtcctgggcccctggcttgggcacctcaagaccagtgaggccaggatgcaggctgtcccccgctaggctggccacactctgctcagccaagcccctgtccttcctgcagaagcctctccatccccgcctggccagcacccccattccccctggcccctcccttctctagggtacctggctcccctcccccaccagccctgcacccctgccagagcctcctcttcttcctcctcctccccacagccacaatctgcttctggcacttggtttcagtgctgtgtcatccaggctagcaagagttgctgcggccgttaagtctgctgtgacaaagcgaccatggtctccctggcccccggagcagctctgagggtcacctgactttatattcaaacctgatcaagtcagtgaccacggagagagctcagctgcatgaccaacagcacccagagccttcctgaagctccccagaggcgctcggaccctcaggggcagctctgcccacactcacaggaaaggagagggtccccctcagatgccgggaaggggaaaggcagagcagtggtcagtgagccgcatcccagaggcctccatgtcaaggggcctcagctgcccactttccacctggctgctcaaggagcaagccctgggccaggagcccccgccaggaggccttccctcccacccactcctgggcagccccacatgggccagggactccacatgtgctgccagggcccctgaggctgcagcccagtgatgggagctggcaggcagatatgctctggccaccttatgctgacagagatgtgacagaagagggtggaatgtcaccatgtgactagggaacaggcaggcagcacgtgaacccctgcctgagacagggagctcctgggcccctggcttgggcacctcaagaccagtcatgagatcagccctaagaccttcacgccaaggcttaggtacagccaggaaaagccatccccaagggggactcactgtctatgttaaggccggggtggcagccagggccctgcccagggcagaaaccctcatggcaagtaacagcagacagtggggacagggcctcaggggcctccatgaccctgaagagaaggtcccatcctgaaaccacacagcccacagtttggataacacgggacttaaccacacaggtgtctgcctgtgaggcagctcaccttcatgaaacaggatcattatctgacaggtccccaggcagatgagttcccgctcagcattcccacagctgctgtgttcatcctctgaggtgggcctggcaggagaggctggggaagccagggctgctccctctcctgctctgacacactcagaggcagaacaccataggctaccgctgctcctctccgtgaacttccagagcacagaccaggctgacacagccaagcagtggccaagatgaccacacagcacgtgcagtggccagaggggcagccaggtctcagagtggatggctacgcagcaaggacagggccacactctccaacaggcatcatggataagtcacaaggagacacaaatggtggttcccaggcaggtcaggggtcctatttccactggagaagaggaagaaagcaccctgggagcagctgattcagaactgcgggtgccacacaggaaatctggctttcgccacctgggacgttgccacgtcctggctcaaggcaccacagggaagaggggggcacatggcactggcagctgtggggtgttagaggaggaagggtgaaccagtggatgtggggccctgatcagggtggggaccacatcccaatgcctccttaaagccaggacctgcctcgtgctcccccagtcccacccctcatcatgcccagggcatagtctgttgaagggcacatgatcgcacacatgggcacgacctgggacaacagaggagggaagagcgacaaggggacatagggcagaggaggacaagcacgtgtccccagggggtcttcagagacagcaggaagaccctgaccaccccctcagcctccacctcagctctgggtggctgtccctggggacgtgatgcctattgaaacaagcagagcatgggggtccacaccccgcccttgtccaactctctcctggagggaagcctggcaagccgcttcctacctgtacccccctccccagctccccaaccctctgcctccccagcccctcgctcaggacactcactgcacacatatcctgcctccagccagccctgggcctgcacagccagaccaatgcccccatccaccccctaggtgttccctcacagcccaatcatcaggaagatgccttggccccttccccatccccaagccctcagcctgcttcggggatccctgggactcctctcctggggttgggtggggccctggcctctgggaagcatggtccaccccccccccgggtgggcattgccctcctgcacctccaggctcccacctcctctttctttctcgggagcactgctgggactcactttgccatgcactcagacgcctccatcctccctgggcctctcacggccagcaccacttgccatggccttaatttggggcggtggcctcagtgtctctccccagagtagagcccatggcccttgtgacaggagggtaggttaggaaggcagatctctaagcagttccctgcactagggtctgcgtgactggtcactcctggccaagcaggccatgctgcagtgtggacatcagaccagtgcttgcagacccagccctacccccatggctcaggcccctctgaaagcacaaagcagctgagctcggtaggtgtcctcagcatgcacccctgtgaggacaggagggaaccctgttcacttcccagagctggagcaggacccctgcagacagcagccaccagcagcaagacaggtgaatcccttgcagggcaaaggactcaagctcctaaggacacaggtgcccagccccctggcagagtgcaggccagtccacctccagacactcagcctgcagggcagggaggaagccaggcaggaccaccctgggaaaggagtcttttcataccagaggcgcctgagaggaaaatcccattgtgaaaccaagtccccacccagactccttctgagaacacacaggccattggttattcaacaggcagctcagcaaaggctgcagccaagagctcaggcagctgcaaggcccacggggcctgctaggaacacagtggggtgctggggctgtagtaccccaccttcaaaacagccaatcgcaaggcaggggctgggctcccctggccaatcctctccaggcagctggcagccgacatgctgaggcaagcctcagacattccgttcccagggctggaggcctcatgtgactgcctttccctccccttcccaggccagccaccaggggaggggcaggaacaaccaccaaggcctgaccaggtccacagagggactgtcccaagccttatgtgggtcaggcccggctgctgtcagggtgcaggggacccaaatacataggaagacatagggagatcccatctttacaaaaaaaaattaaaacttagccaggtatggtggtgcgtgcctgtggtcccagctacttagggggctcagatgggaggatcacttgagcccagaaggttggctgcagtgaacaatggcaccactgcactctagcctgggcaacagagcaagaccctactttaaaaaaactggttgaaagaaatcaaaacaagaataatattttgtgacacaagaaaattatatgaaattctaattactatggccctactgaggcagagtgaagccgttgtggcagggagggtgtggcccgactgagagtctgtgctacctggctgtttacacaaacttgctgacctgatggaggaggctctgctacagcctctcttttgcagggattcctgacccgcaggcaggtcccactgcccgacccttgcctggcctcagcctgccctgcagttgtggaacctcccaggcctggcccctgccccattgtcagtggagaagggaattgaagccaggagcagtgtagcaggccggcctggagtcagctcctggaggccactaagctgatacaaggccccttccctgggcagtgagtgtagagggcagttggtaccaccctgacccgccctcctgggcagggcatcaggacagaacaacaagaccacgtttccctccacttcctggagcagtccctggctcatgtgagatccaggcgagaccaaccattctttgcagagtgcttggttcatatgctggtgcctgtgctcctccaggcggtggactagatagggccaagggccattctgtactctgcttcctcaggcctcacgcacaccaggcctcccatgaaagcccagagctgtccaccgcatgaaacaaaaatgcaagaactccaggcagagcccaggagggtcatcggtagttgggctgaccaagctctcctagccttggcctctgcccagctgaggctgaagcccagcagctggatacatcccacctgctcccactgggtgctccagggtcatgatcagaaagcccgcagacaccgggcaggccttactccatctccttgtgctctgcctcctcggggctcaggtcctcctccactccatagtccaggatggcgctgacaccgaaggccctgtagtgccgaagcaggggctggatggactcctggtcctccccggctacaaaatgcccatagaaggtcatcttcatgagcttgttgaatagcctctgtcctagaagtttcctggaaacatacagcagctgaaaggcaaagggaagccgctgtcctgggctgcctgaactctcctttcccagcaaggcaccgctgctcatccccgaccacacttcaccccagccatggggcctcgatatggtctcttggcgactgggctttcagggtcagtttcatggtgaagaccagctaaagccgcttgcttctccaccctgtccatcactccagttcccatccagggcagagagaccacaggaggtgctgcctgcttggcctgaggacactgttcccacctggactctgccccttcagggccccacccatgagtcactccagcagcacacagtgggtgcctgaccactgcttggtggataaaaaggagaatggccagcctccctggggatgacagccggcattttgagaccatcctctgtatccacaccttggtagttctgctgcggaagaggaggatctaacttgactttctagtacttgagtgcccagatttttcaatgttttgttccctcttatcccaagtcccttaaacagtgtgactggcatgaggccagcccccgaatggatgctaaataacaaacgtgtgaaactcaggctgagtctgcgcccagctggagggaggcatgccctggcaacaaggacaatgagctagatgacagtccacaggggcctgtgagatgactcccaccccaggacccatgcgctctgcagggtcatctggggctgaccagccactctgacagatgctgcccgggaactgtctgtctcctccaatcatatttcaccacgtcgctcattcagatgtcccaagctgccatgcaccaagcaccttttatagactggaaacaaccaaaggaaaccgaccaggatctcacatcctggtggtaaaggaaccccaaaggggaaggagggactctgcctatgactcaggacagggggatggggcagtgcctgcagggtagggcaggggtgtttactaacccagatccaggagtggggcttgccaaggcgaggagatggcatggacaactgtgggagctccagcacgggggacagccagggcagaaaggacagggacaacgagaggctacttggagaggagggccgagtgtgatgctcagaagcacacctccgcgttgtgtctgctgcccctgccgactcagccccaacacaggaagagcctggggtttctcaaacccaatggatactagaactccttttatgtggggagcatctcttgagaccgtagtttcaggaacaacttctagtctaagcaaaaccattagcgagtcaaacacttacacccaagccagccctgagcacccacacgcctgcccacaggcagacatagccccacagccttaccctgaacattggtgccccatggagacgcctcctgaccatcacccctgggcacgccatggggcagccccaaggaccagggtttcccaggcactcacccctgccttcctgcagcctccaagcagaatctgactttaaggcattttgttcttttatcaagaggattagaaactggaaaatgaacaggctgacatgttctccgtctcccactgagcctgagccaggcctcattcctgctggcagcacccagggatagttgggagaacaggatgggtctgaaacatatcaaagatcacccaagtggcaggcggggcagaactggggacctgaacaccatcactgggcttatccacatccgctctgagagaaccatcagaaaacaacaggagggagggtgggcaactgtcgactgccgcacggggccacgcagtctccctctacctaactgctcgcctccgcacggccagcactaaatgaaggggcgggagcccaggctgcactgactccagggatgcttattcacaaagatggggggctgggggactgggcccgggctgagggtggaagctccctgcacagggctgcagaagcacacaggcagggctggcaagttttttatttatttatttttagaggcagggtctcactcctgggctcaagcgacactcctatctcggcctccagagtagttgggactacaggcatgcaccaccacactcagctaacttttattttttcttttttttgaggcagagttttgctcttgttgcccaggctggagtgcagtagcacaatctcggctcactgcaacctccacctcccaggttcaagcgattctcccgcctcagcctcccaagtagcagagattacaggcgcacaccaccatgcccagctaatttttatatttttagtagagatggggtttctccatgttggccaggctggtctcaaactcctgacttcaggtgatccacccgcctcggccacccaaagtgctgggatgacaggcatgagccaccgcacctggccccagctaacttttaaaaatattttgtagagacagggtttcacgatgttgctcaggctggtcttgaactcctagccttaaatgatcctcctgccttgacctccttaagtgctagaattacaggcatgagccaccatgcctaggcatgagcctagggcttgtaattttaaagctgactccacagcaaagcaaccactttaacaccatcctggtgtcactgatgtccccgcatggcactacctgagaccagggcagccccacatcttcttcaggtgaggagatccttcgaggatttagaaacctgcaccagtaacacatacacttgtaccccctgtgaaagactcaaccaaatgtgtgcagagtaacactggtagagccggttctctcccctccccccactcagggaaccactgtcaccacgggtcctgtcccttctgtgagggcgcacacccaacctcagtgctgttgtcatggaaatcctgggactttcctaaaccctcctcaataagtctggctttcaggcaagggcgggccccactgctgtccccatccaaggcagcagctcaaagatcagctactacaacctgacacgcctgtggcagatgtggcctcactgcccgggtgcctcacagacctgtgctggctcagcagaaggaatctccccacagcccagagggtgagggaaggaactcccctctggcccgctcacaggaccaggttctagtgagcagctcacaagcccaggacctggcctctgccttcttccagtgctgaggctgccgacacccatgggaccactagcaagacaacagtacagaccccactgagggacttcccagggcacaggtgggaccctaggggagcctgggagaggtcacctctggatgccctgcctcttccaggtactcacagcaccatccctgagccctggcacttgcctcaagaaggcacccaagggacagcggagccaacagtttcctcccacagtcacggaacagcacctggcattccccgcagcagactgggcaccaaaccccacacccagctctgctggcttctctgtgcaacaacttgtcttgaatctagacaagaaaccttagggctgtgcctacagaaacctgacctggtgccttcctagccccctccccatcccagccatgcttagggctgtgcctacagaaacctgacctggtgccttcctagtccccactccatcccggccacaaggtgggcatggcttctgcacgactggccccagctgccacctagcatgcccgtccttgccctgggcagggacctgtggctggccactccctcccctggcatttctgccctgctgcctcctcctcctattgcagcaccaccagcactggctcctcttttgggatgccccttagatgtgggcactccccaaagcctccacatcgccgtccctcaccttgccagttcctctacctgggatgtcccttctcgccctcctgtctccttggccggggctctctatgaccaaaacttgaccttaagacatccttgtgtgcacacacagcaatgccctcccagagccctccatctgtccagttcagctccttcttcctccaccatcctccgcactcccgccaccacgggtcctaggctgaccttggcgctccccatgggattcgggccaacagcatctgactctgagttcgtggatccctgccctcacctcgcacccgccgaggcctcacctaagctcaactgtggctcggtgcttctcatctgacaccgtcccccgccttcccccgcctcctgttgaggccaggggtgcagcccccgacctctgtacagtctcacctgagaaatcaacaccaccagataccctggcgccaaaaagcggaaccttgcaaactcttcccagggtcacctggagataaccgtcatctctagtacccctaggctgatgcggctaaaacagtgttctgcttgttgccccccaccaccgccaccaaaagccctgacactttttaaagctaccatgggtgagttcaaagctgggcgtttgaggggcttcccatttttccccaacagtgttctcagagtggccgtgtctgggaagctgctgggtcccggggtttgaattccggggttccaggctatgagccctacaccaggattctcttgtctcaacatgaagaatactccattttaaattccaagtgataactctgtattcccacaagtggtatatatcgtaaatatgaaaacgaccattgtttttagttggtagacatcgacaaataggaaaatttgcgaggtccgagagggactgcaggaaacgcctcccttcctggcttcccttgctccaggagatgcttgggaggcacccgtttcaggccaggaagctccgtaaaggctcccgggaccggcagaagcccccgcgcccccgcctgcaccccgcgcacctgctcgtggcgcgccagcagcgcgggccaggcgcacaagcgcagcaccagcaggctccgcgccagctcccaggttcgccggctgcggtacgcctcctgcgcgttgccgaagtccacggcgggcaccggcggccgcactgccgtggccgacccacctcctggcacggccgctgggcccgctgcgggctgctcgcgggaggccggcgccgtggacagcgggacgaagcggggaatgcaggggcgcagcgcgggcagggcgcgcctcagagccatggcgggacggcggtacccgcccgggccgcttaagtgtgcgctgttggtcccgccccgccccgccccgccccgccccgccccgctcggtcccagaggcctcaccctatattcctgacaaatgccagacaagggcttagacttcacaagcaccctggcacttcagctgcatggtggggaccctctgccggcagggctgaggccaaggcccactggcttctcaaagcctctgctcctgctctccgtgaagacagcaacagagtgagaccctgtctcaaaacaaaaattatgtattttcagatagcttgaaggagaatattgagtgttcgtaatgcaaagaaataataaatgtttgagatgataggtatgctaattacccttatctgatcactatacacgtacagaaacatcactacgtaccccacaaatatgtacaattattatgtgtcaactaaaaaataaaaatagccgggtgtggtggctcacgcctgtaatctcagcactttgggaggccgaggcaggaggatcttttgagcccaggagtgccagagcagtctgggcaacatagtaagacctcgtctctacaaaaaatagaaaattaaccaggcatagtgttgcatgtctgtaatcccagctactcaggaggctgaggtgaggggattgcttgagcccaggaggttgaagctgcagtgagctgattgtgccactgaactccagcctgggcaatggagggagaccctgtctcaaaaataaaagtgaattttttttttttgagatggagtcttgctctgtctcccaggctggagtgcagtggcatgatctcagctcactgcaacctctgcctcccgggttcacgccattctcccacctcagcctccagagtagctgggactacaggcgcctgccaagcctggctaattttttatgtttttagtagagacggggtttcaccgtgttagccaggatggtcttgatctcctgaccttgtgatccgcccgcctccgcctcccagagtgctgggattacaggcgtgagccaccacgcccggtgaatttttttttttaaagaaagattccggacacaaacggccacaagttgtatggttcgttttatatgaagagttcagaatagacaaatcgatagagacagaagtcacacgaagacaagcccatagtggagcctggtgagtatggcactggcagtggtgcctggaggtggaggacgggaggagtgggaggggctgccaaggcccacggagtttctttggggtccggaaatactctggggctagagagtggtgatgtttgctcaaccttgtgtatagactaaaaaaccattcaatatctcaataaagctgttatatttttttaaaaaagcaaagttctagcatttgcttcaaggaagcctgtggccctgcacagaggcaaaggtgggcaggggctgccaggggcagggctgcagagagggcagggggagaagcgaggggtgcagggatcacagagatcaccactcacgtccagaccatagcagagcaggcctagcgctgggtgcccaggcccacgggagagcccacctgtgagggcacctgtgggaacaaggctggcctgaaagtcactggctccatgtgacaatcaatgaaacaaccgagtttcacaggagctctgtaaatcctaggaagcaggtcttaggctcagctggggacccttggcaggtggctaccctgagccagctgatggctttttttttttttttttttaagagacagggtctctctctgttgcccaagctggagtgcagccatgtgatcacagctcactgtggccttgaactcctggtgtctcatgtgtccctgtgaagggaccaccaaccagctttgtatgagcaacaaggctgtttatttcacctgggtgcaggcaggctgagtccaaaaaaggagtcagcaaagggtggtgggattatcattagttcttacaggttttgggataggcagtggagttaagagcaatgttctgggggcaggggtggatctcacaaagtaccttctcaagggtggggagaattaccaagaaccttcttaagggtgggggagattatgaagtacattgatcagttagggtggggcagaaacaaatcacaatggtggaatgtcatcagttaaggctattttcacttcttctgtggatcttcagttgcttcagcccatctggatgtatccgtgcaggtcacaagggatatgatggcttagcttgggctcagaggcctgacacctgggctcaagtgatccccctgcctcaacctcccaagtagctgggactacaggctggactgcacctagctaatttttaaaaaatatttttttgtggagacagggtctggctgtgttacccagtgtggggaaaagcaagagagatcagattgttactgtgtctgtgtagaaagaagtagacataggagactccattttgttatgtgctaagaaaaattcttctgccttgagattctgttaatctataaccttacccccaaccccgtgctctctgaaacgtgtgctgtgtcaactcagagttaaatggattaagggcggtgcaggatgtgctttgttaagcagatgcttgaaggcagcctgctccttaagagtcatcaccactccctaatctcaagtacccagggacacaaaaactgcggaaggccgcagggacctctgcctaggaaagccaggtattgtccaaggtttctccccatgtgatagtctgaaatatggcctcgtgggaagggaaagacctgaccgtcccccagcccgacacccgtaaagggtctgtgctgaggagaattagtaaaagaggaaggaatgcctcttgcagttgagacaagaggaaggcatctgtctcctgcctgtccctgggcaatggaatgtctcggtataaaacccgattgtatgctccatctactgagatagggaaaaaccgccttagggctggaggtgggacctgcgggcagcaatactgctttgtaaagcattgagatgtttatgtgtatgcatatctaaaagcacagcacttaatcctttacattgtctatgatgcaaagacctttgttcacgtgtttgtctgctgaccctctccccacaattgtcttgtgaccctgacacatccccctcttcgagaaacacccacaaatgatgaataaatactaagggaactcagaggctggcgggatcctccatatgctgaacgctggttccccggttccccttatttctttctctatactttgtctctgtgtctttttcttttccaaatctctcgtcccaccttacgagaaacacccacaggtgtgtaggggcaacccacccctacatctggtgcccaacatggaggcttttctctagggtgaaggtacgctcgagcgtggtcattgaggacaagtcgacgagagatcccgagtacgtctacagtcagccttacggtaagcttgtgcgctcggaagaagctagggtgataatggggcaaactaaaagtaaaattaaaagtaaatatgcctcttatctcagctttattaaaattcttttaaaaagagggggagttaaagtatctacaaaaaatctaatcaagctatttcaaataatagaacaattttgcccatggtttccagaacaaggaactttagatctaaaagattggaaaagaattggtaaggaactaaaacaagcaggtaggaagggtaatatcattccacttacagtatggaatgattgggccattattaaagcagctttagaaccatttcaaacagaagaagatagcgtttcagtttctgatgcccctggaagctgtttaatagattgtaatgaaaagacaaggaaaaaatcccagaaagaaacggaaagtttacattgcgaatatgtagcagagccggtaatggctcagtcaacgcaaaatgttgactataatcaattacaggaggtgatatatcctgaaacgttaaaattagaaggaaaaggtccagaattagtggggccatcagagtctaaaccacgagggacaagtcctcttccagcaggtcaggtgcccgtaacattacaacctcaaaagcaggttaaagaaaataagacccaaccgccagtagcctatcaatactggcctccggctgaacttcagtatcggccacccccagaaagtcagtatggatatccaggaatgcccccagcaccacagggcagggcgccataccctcagccgcccactaggagacttaatcctacggcaccacctagtagacagggtagtgaattacatgaaattattgataaatcaagaaaggaaggagatactgaggcatggcaattcccagtaacgttagaaccgatgccacctggagaaggagcccaagagggagagcctcccacagttgaggccagatacaagtctttttcgataaaaatgctaaaagatatgaaagagggagtaaaacagtatggacccaactccccttatatgaggacattattagattccattgcttatggacatagactcattccttatgattgggagattctggcaaaatcgtctctctcaccctctcaatttttacaatttaagacttggtggattgatggggtacaagaacaggtccgaagaaatagggctgccaatcctccagttaacatagatgcagatcaactattaggaataggtcaaaattggagtactattagtcaacaagcattaatgcaaaatgaggccattgagcaagttagagctatctgccttagagcctgggaaaaaatccaagacccaggaagtgcctgcccctcatttaatacagtaagacaaggttcaaaagagccctatcctgattttgtggcaaggctccaagatgttgctcaaaagtcaattgccgatgaaaaagcccgtaaggtcatagtggagttgatggcatatgaaaacgccaatcctgagtgtcaatcagccattaagccattaaaaggaaaggttcctgcaggatcagatgtaatctcagaatatgtaaaagcctgtgatggaatcggaggagctatgcataaagctatgcttatggctcaagcaataacaggagttgttttaggaggacaagttagaacatttggaggaaaatgttataattgtggtcaaattggtcacttaaaaaagaattgcccagtcttaaacaaacagaatataactattcaagcaactacaacaggtagagagccacctgacttatgtccaagatgtaaaaaaggaaaacattgggctagtcaatgtcgttctaaatttgataaaaatgggcaaccattgtcgggaaacgagcaaaggggccagcctcaggccccacaacaaactggggcattcccaattcagccatttgttcctcagggttttcagggacaacaacccccactgtcccaagtgtttcagggaataagccagttaccacaatacaacaattgtcccctgccacaagcagcagtgcagcagtagatttatgtactatacaagcagtctctctgcttccaggggagcccccacaaaaaatccccacaggggtatatggccccctgcctgaggggactgtaggactaatcttaggaagatcaagtctaaatctaaaaggagttcaaattcatactagtgtggttgattcagactataaaggcgaaattcagttggttattagctcttcaattccttggagtgccagtccaggagacaggagtgctcaattattactcctgccatatattaagggtggaaatagtgaactaaaaaaaataggagggcttggaagcactgatccaacaggaaaggctgcatattgggcaagtcaggtctcagagaacagacctgtgtgtaaggccattattcaaggaaaacagtttgaagggttggtagacactggagcagatgtctctatcattgctttaaatcagtggccaaaaaattggcctaaacaaaaggctgttacaggacttgtcggcataggcacagcctcagaagtgtatcaaagtacggagattttacattgcttagggccagataatcaagaaagtactgttcagccaatgattacttcaattcctcttaatctgtggggttgagatttattacaacaatggggtgcggaaatcaccatgcccgctccattatatagccccacgagtcaaaaaatcatgaccaagatgggatatataccaggaaagggactagggaaaaatgaagatggcattaaaattccatttgaggctaaaataaatcaaaaaagagaaggaatagggtatcctttttaggggcggccactatagagcctcctaaacccataccattaacttggaaaacagaaaaaccggtgtgggtaaatcagtggccgctaccaaaacaaaaactggaggctttacatttattagtaaatgaacagttagaaaagggtcatattgagccttcgttctcaccttggaattctcctgtgtttgtaattcagaagaaatcaggcaaatggcgtatgttaactgacttaagggccgtaaacgccttaattcaacccatggggcctctccaacccgggttgccctctccggccataatcccaaaagattagcctttaattataattgatctaaaggattgcttttttaccatccctctggcagagcaggattgtgaaaaatttgcctttactataccagccataaataataaagaaccagccaccaggtttcagtggaaagtgttacctcagggaatgcttaatagtccaactatttgtcagacttttgtaggtcgagctcttcaaccagttagagaaaagttttcagactgttatattattcattatattgatgatattttatgtgctgcagaaacgaaagataaattaattgactgttatacatttctgcaagcagaggttgccaatgctggactggcaatagcatctgataagatccaaacctctactccttttcattatttagggatgcagatagaaaatagaaaaattaagccacaaaaatagaaataagaaaagatacattaaaaacactaaatgattttcaaaaattactaggagatattaattggattcggccaactctaggcattcctacttatgccatgtcaaatttgttctctatcttaagaggagactcagacttaaatagtaaaagaatattaaccccagaggcaacaaaagaaattaaattagtggaagaaaaaattcagtcagcgcaaataaatagaatagatcccttagccccactccagcttttgatttttgccactgcacattctccaacaggcatcattattcaaaatactgatcttgtggagtggtcattccttcctcacagtacagttaagacttttacattgtacttggatcaaatggctacattaatcggtcagacaagattacgaataataaaattatgtggaaatgaccaagacaaaatagttgtccctttaaccaaggaacaagttagacaagcctttatcaattctggtgcatggcagattggtcttgctaattttgtgggaattattgataatcattacccaaaaacaaagatcttccagttcttaaaattgactacttggattctacctaaaataaccagacgtgaacctttagaaaatgctctaacagtatttactgatggttccagcaatggaaaagcagcttacacagggccgaaagaacgagtaatcaaaactccatatcaatcggctcaaagagcagagttggttgcagtcattacagtgttacaagattttgaccaacctatcaatattatatcagattctgcctatgtagtacaggctacaagggatgttgagacggctctaattaaatatagcatggatgatcagttaaaccagctattcaatttattacaacaaactgtaagaaaaagaaatttcccattttatattactcatattcgagcacacactaatttaccagggcctttgactaaagcaaatgaacaagctgacttactggtatcatctgcactcataaaagcacaagaacttcatgctttgactcatgtaaatgcagcaggattaaaaaacaaatttgatgtcacatggaaacaggcaaaagatattgtacaacattgcacccagtgtcaagtcttacacctgcccactcaagaggcaggagttaatcccagaggtctgtgtcctaatgcattatggcaaatggatgtcacgcatgtaccttcatttggaagattatcatatgttcatgtaacagttgatacttattcacatttcatatgggcaacttgccaaacaggagaaagtacttcccatgttaaaaaacatttattgtcttgttttgctgtaatgggagttccagaaaaaatcaaaactgacaatggaccaggatattgtagtaaagctttccaaaaattcttaagtcagtggaaaatttcacatacaacaggaattccttataattcccaaggacaggccatagttgaaagaactaatagaacactcaaaactcaattagttaaacaaaaagaagggggagacagtaaggagtgtaccactcctcagatgcaacttaatctagcactctatactttaaattttttaaacatttatagaaatcagactactacttctgcagaacaacatcttactggtaaaaagaacagcccacatgaaggaaaactaatttggtggaaagataataaaaataagacatgggaaatagggaaggtgataacgtgggggagaggttttgcttgtgtttcaccaggagaaaatcagcttcctgtttggatacccactagacatttgaagttctacaatgaacccatcggagatgcaaagaaaagggcctccgcggagatggtaacaccagtcacatggatggataatcctatagaagtatatgttaatgatagcgaatgggtacctggccccacagatgatcgctgccctgccaaacctgaggaagaagggatgatgataaatatttccattgggtatcgttatcctcctatttgcttagggacagcaccaggatgtttaatgcctgcagtccaaaattggttggtagaagtacctattgtcagtcccatcagtagattcacttatcacatggtaagcgggatgtcactcaggccacgggtaaattatttacaagactttccttatcaaagatcattaaaatttagacctaaagggaaaccttgccccaaggaaattcccaaagaatcaaaaaatacagaagttttagtttgggaagaatgtgtggccaatagtgcggtgatattacaaaacaatgaattcggaactattatagattgggcacctcgaggtcaattctaccacaattgctcaggacaaactcagtcatgtccaagtgcacaagtgagtccagctgttgatagcgacttaacagaaagtttagacaaacataagcataaaaaattgcagtctttctacccttgggaatggggagaaaaaggaatctctaccccaagaccaaaaataataagtcctgtttctggtcctgaacatccagaattatggaggcttactgtggcctcacaccacattagaatttggtctggaaatcaaactttagaaacaagagatcgtaagccattttatactgtcgacctaaattccagtctaacacttcctttacaaagttgcgtaaagcccccttatatgctagttgtaggaaatatagttattaaaccagactcccagactataacctgtgaaaactgtagattgcttacttgcattgattcaacttttaattggcaacaccgtattctgctggtgagagcaagagagggcgtgtggatccttgtgtccatggaccgaccgtgggaggcctcaccatccgtccatattttgactgaagtattaaaaggtgttttaaatagatccaaaagattcatttttactttaattgcagtgattatgggattaattgcagtcacagctacgggtgctgtagcaggagttgcattgcactcttctgttcagtcagtaaactttgttaatgattggcaaaaaaattctacaagattgtggaattcacaatctagtattgatcaaaaattggcaaatcaaattaatgatcttagacaaactgtcatttggatgggagacagactcatgagcttagaacatcgtttccagttacaatgtgactggaatacgtcagatttttgtattacaccccaaatttataatgagtctgagcatcactgggacatggttagacgccatctacagggaagagaagataatctcactttagacatttccaaattaaaagaacaaattttcgaagcatcaaaagcccatttaaatttggtgccaggaactgaggcaattgcaggagttgctgatggcctcgcaaatcttaaccctgtcacttgggttaagaccattggaagtactacgattataaatctcatattaatccttgtgtgcctgttttgtctgttgttagtctgcaggtgtacccaacagctccgaagagacagcgaccatcgagaacgggccatgatgacgatggcggttttgtcgaaaagaaaagggggaaatgtggggaaaagcaagagagatcagattgttactgtgtctgtgtagaaagaagtagacataggagactccattttgttatgtgctaagaaaaattcttctgccttgagattctgttaatctataaccttacccccaaccccgtgctctctgaaacgtgtgctgtgtcaactcagagttaaatggattaagggcggtgcaggatgtgctttgttaaacagatgcttgaaggcagcatgctccttaagagtcatcaccactccctaatctcaagtacccagggacacaaaaactgcggaaggccgcagggacctctgcctaggaaagccaggtattgtccaaggtttctccccatgtgatagtctgaaatatggcctcgtgggaagggaaagacctgaccgtcccccagcccgacaccaagggtctgtgctgaggaggattagtaaaagaggaaggaatgcctcttgcagttgagacaagaggaaggcatctgtctcctgcctgtccctgggcaatggaatgtctcggtataaaacccgattgtatgctccatctactgagatagggaaaaaccgccttagggctggaggtgggacctgcgggcagcaatactgctttgtaaagcattgagatgtttatgtgtatgcatatctaaaagcacagcacttaatcctttacattgtctatgatgcaaagacctttgttcacgtgtttgtctgctgaccctctccccacaattgtcttgtgaccctgacacatccccctcttcgagaaacacccacaagtgatgaataaatactaagggaactcagaggctggcgggatcctccatatgctgaacgctggttccccggttccccttatttctttctctatactttgtctctgtgtctttttcttttccaaatctctcgtcccaccttacgagaaacacccacaggtgtgtaggggcaacccacccctacaacccaggttgatctgaaactcctgggctcaagcaatcctcctaccttggcctctcagagtgctgggattcaggcatgagccactgcgcccagtcatggattattttgaaagaatgatgccctgccagggccagaggatccaggtgggagttggcggtgggggggtcctcagggagatcggctggatgggagttgagtgccggggacagaggggtggggtctgttctccagctcaggagacaggcagagctgagagggccagacttgggcatgtggtggtgacccagctgctgggcgcccccgaggttgggccggtcaccagggcctgccactcccaaggaggaagcagacaagaaacagaccttcgagggtagagaggccgctgtgctgcctgtccgggcccctgcggacatgcagtcagccccgctcaggactccttccattctcccacttgcactcattcccagcgagataattgtttctcctcagccatgagcatgacattggagctctggcaaagtcaggtttttttgttgtcttttttgccatgtgcctcttacctgtactcctgaaatatttgtttctgtgctggaaccatggctccctgcattcattctgatttgttgcatttttgctgcttgccctgtagctacttttaccaatacatttgctctgtctgcaggcaaaggaattcattcacatttgtttaatttggagcttgtctttcctttatcagcctgcaccaaacctgggctgctgggtatataaatttccctcatcggtacgttatcccattatccacttcatgctgccgttcacagatcctacttgagttctgttcagctatgtcattttattcattttttgcaaagctagtaaaatgtgattgcatttcctgaagttaagattgtctgctggatcccagaacacgccactgtttatgtgaatgcaatcacacttcaccactttatataatcattttcaatgcgtgtatgagaaaaggtagttagatccccccacccctgctagattgtttcctgctgagaccagcttagtcggggagaccctaacacggtggcgctagaataattaaagacacacacacacagaaatacagaggtgtggagtgggaaatcaggggtctcacagccttcagagctgagagcctcaaacagagatttacccacatatttattgacagcaagccagtgataaacattgtttctttcttttttttttttgagacagagtctcgctctattgcccaggctggtgtgcagtgggacaatctccacttactgcaagctctgcctcccgggttcacctgcctcagcctcccaagtggctgggactacaggcgcccgccaccacacccggctaattttttgtatttttagtagagacggggtttcaccatgttagccaggatggtctagatctcctgaccttgtgatccgcccgcctcggcctcccaaagtgctgggattacaggcgtgagccactgcacctggcgtgtttttatccattttaatgggttactagctgctaatctgtctgcagctccttcaagcactccagttcctggcattaaggtcagatgttcctgggatgctttaaatatttgttcttttaattttgcacatccaaagacaaatttgtagagggcccttctagatgcttttttattctttcccaaattttgatcttattaagaactgttaatagtttccacaaatccttatgtgaagctcctagagcgggccatatcatttgagattgaggtgccactatactgccatggttccagataatgggaacttttgccatacttcttatcatttctaccacctgaccatttgttcagaccagctgaacatagggtggccgtggcatgcagactgagaggtgcaattcaagctaaacatccccttaggggaccaatcaataatgattccataggaatcgctgcgcagcacctctgcctgttctgcaatgcaatcttcctaaacaagtacgttcattatttctggccaggttctattttgtttacaaataggtttttgaaggcagtatgcctcaattataggagcagatttattatggtaaatactgagatcagaaagcatgtgtaaatacgtcatagagtgattactttcaggcattattaccagtcaagattgataaatatgccctgtaagtataattgttctctgtgtcagaccttgttgaaggaatactcacggcagtggtgataaccgatatcatagctaccagtaaattactcattgtgactggttgtccctctttcctcaggttttcttctgccatctgtgacagcttcttgatctgtccccaggtgggtggctgtgttcaatgggtgttgcttgtgacagttggctggtgtgagatgtgtttcagccccaggtctcagccagtggtcgcccagtggcacagtcagagccgggcctgcctggttccctgggctggcactctgagtccaaggtggcacggttgggcagcgacccctccctgagcccccaacctctgacctcctaggcactggcctgagccgtggcttctgaaaaggaaaacctgggaattccttcaatgtccaccttaggtgatgatgggctcagggcaccatggggtgtgcccaagatgatgagcccctccctgcatgtcagtaacagggacacacatctctgatgcgcggggagggaagagtctgagtgtgtgaagctgtctgtccatgcaggccacatgtggatggggggcaaggacatggaatggaggaagacaggactcaatgtttttgcatcgaccgctcttgtataagagcggtctttacaaagtaataatgccttgagttaaccccacagtttatcttgtaatgtggaacagtcagggccaattgaagatgagcatccccctgaggctgactcatagccgggccgctggagccaggcccttcggggtatttgagatttctttagccaggcctggggggcactggcagggagtgcctccagagctgttcacggcctttgtctcccctctgggaagggcactgagtggagtcaggtgaggggcccgtgctcgcccaccagggttgttccaaacacaggcagcagggctccctggcaagctcccgggtgccctgtgagcagctctgacgtcggtggacagtgttcccagtgagtctgccgtcagtccttgtgcccagcattgattttccttccgcggtcaagctaggctgtgttgttggtactcgctgtacctccaggtgctgagcaagctgaccttggcctccctggccccacggctgcatgaggctaatctccccctacacaccccacccctctgcccccgccaacaccagggcacagaggggctggcccatggctttcttgaaacggtgcatttcacttctgattataaaactaaggcgtgctttggtagacagcgtggtggatatggggaaggataaaaggacatcaacctgttctgacatcccagcacccagggcagggacccagaggggagatttgggtgtatttctctccgttgtcttctctgcaggcatgacacaggtgtgcacacactcatccagcccactgacgtgtgcacaagcatgaacacatgtgggacacttgccctgcgctgcagtgtgtgtgagtcatgtgcacgtccactgccctctgtggaaggcgtgttcacacctgtgcacatacctgaggccgctctatcactgcaggcccctgtgcatttcctgggaggtatgttcccatttcattaagaattctcggccgggcgctgtggttcacacctgtaatcccagcactttgggaggccgaggcgggtggatcacgaggtcaggagatcaagaccatcctggccaacatggtgaaaccccgtctctactaaacatacaaaaattagccgggcgtggtggtgggtgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaagaaaaagaaaaagaaaaagaaaaagaattctcagtgatggatctactccaggccctgcctcaccatcactagccacagagctactcacagccagtgctctcctcacaggggtctgaatggcaaggagtgagccgcaggatgacccaggacaagtggcagcaacagggtgagttcccaggatgctggacaggctgtgtgcagctcccggttctcagcgggtacagagatcccagggaaagccgtgagatgactcctgcacttgtcctgccagcaacctgcaggggtgggtgggatcaagagtgacagaaaccgcaggcaccaggcatccccccaaaagagcaagggggctctgggtgatgtcctggaggggcaggagcaaggagggaggccaggggcaccgagggcatctcatcacatgggctctgtcccagccacagtgctgtctctcccagagccctgtgtagcctcctgcccataggtgaagacccagcctcagctccctgcacgcagcaggcccacccatccatccatctgttcacaccaggaagcccagaggcaggtggatggcctctgtcctggcagtgcaacattgctggaagcatcctccaagagtcacccatccccacagacactgatggaggacagcaatgatgcttcctgacagcaaccaccattcactgagcattcagcaggggtgggtgtcagggtcagcctccaccacgtcactgtgggaacagcccccaggacccgctaactcattttatacatcaggaggaaagccagggagcacggtacactctccagctaccgtggggccagcacactgtccagccaccttgggccagtgaaacggaaaaagttcccttgttgccctagcagtgtgtgtgagaaggggagtggctcgcttcttcagtgctccactgcccaaacctctaggggagcttacagacgggcaggctgtggagctccgaccccacagcagtgtctaggggtgaaggtttacagctgaagccccagtgggcgtgtgtcacgggggcttttttagtttgtcgtctgtagggtggcttgtgttagtcagagggctttctggatcctggggttcttgcctttgtgtaccagaagagtcagatcacacgtggacttggagaatgagtgcaaggttttattgaggggaggtggctcccagcagataggggaagctagaagggggtggagtgggaaggttttcccctggagtggggccgctgtgcacccgggctgtcctccaactgccccagccaaactccgcgtggttctgccagtcagtggcctgccagcatgccggtgcctatcagtgcgttcatctcgacatccagccgcccgtgtgtgtctccgctgatgtgctcctctccacgtccagctgcctgtgtctgcctgctaaggtctcaggggattttataagcacaggatgggggcgtggcaggccagggtggtcgtgagaaatgcaacatttgggtaggaagtgcctgttctcacctaggtccgtggggttggagccctagtctgggaccatgccctcctctacccagcacttcctttccctgcttccgtatcatttaaatggaccacacttttcccttcccagcacttgccttccctatcaacagcacattctctagccaccatggggtcagcacactctccagctacgtcgggccagcagcggctgggctccaactcaggtctgcaccagaccctcattcttaaacccctgcgtctcggcctgcccatgttccagcttccccaagtcttgactcccaatgtcccagcctccttgaggtctcagtctccctgttccaggcctcagcctcccctgagtccctgcctagcccagttcctacctcccacttcccctccccaggtctctgctaccatggcccacccagctgcacccccaccccacacttctcctgggacccaggaggccactcatgggctaagcctggtggcatcttcatgtaaaccttgccctgagcacacgcccgtggctgtggctgctgactttcactgtgcatattaaatgccattaagatggttgcgattggttttcagtgtccagaggactgcagcacacggagaaacagccgccctgcagggcctctccccgagctctggcgggtgagcccttgtgggaggggctggggagctgggacccatttagggtgtggttgggggagaaggcaggaggcaggtgggacctcccccggaacctctcctgagacaccctaagggctgggaatgggagctacttggtgggggaacccagcaggggtttcctgtccccgggctctggccatgacgaggaccctcctgctgttgcctctcccaaggccactcggcccctgctcactgtgcaaccttacagagcagctcagcctctctgagcccctctgtcatctttagccactgcccaccagagtccccttggagctgctggccaaggcaaggctgggcaggggcttgacataggctctcacgccttcagatgccctcaaatgggattcaaccccgtcttggctcctgagacctcccagcctggggtctgagggtctgtccagatctgcaggtagatggctgggcctgcagggacagaggcggccggcggagggcagcagagggccgcagaactgagcggccggcactcaccaggccgggatgtggccaccctgcatgcaagcagccctgcctctgccctgggtcttgtcccaccccccaggacacccaggccctggcttggctgcggcagggaggccaggcctcacccctctccctcctgacacctgcccagccactggcttgggccgccgccctccaggcctctcctgccacccaccccagcaccaggccccctgatgcccctgcttccctcccaagggtccctcctagacaccatcctggcccagccaagatgccagcacaggatctccccaaaacactctgggccctggaggacagggtgaggctccggcaccttccaggtggcactcatgatggacaatctcaggggccacacaccctggacccacctcccccagtgcagagacccccacggcaggctctcagccgtgaatatggacacacaaggctcccgggacatgggcaaagggttgacactggctcatagtgtgggcaccatgtcacagggcgagacggagactcagcccccagggtagcggccagtgctgaccttgggctaggccagggcctggccatgctgaaccaggtctgagcatcctcaggggccagcctctccctgtggggtccccacaaaggtggccatgggctgtcctctgatgacaggaagccccccttcccgtcagccccgtctgtcagctccctctgccctggggtgaggcctctatggtgaggcccatggtcctggctccaacctcgcactcctcgggacccactcccatgcccggctccctgccagacccacacacccaacccagctaacaccagccccaccctgtcctgccccacgggggcagtgccctccactctccttcactggtcccctctccgtcctcctctcacccactcttaagaaacctcccacacatgagcacccgtccgtccccacacctgctcaccaggcctggctgggcctgaccctctcctgaagtgagggctgcagcctggtcggctcagctcatcagcacagacttgtttctgtcacaacagctgatgaggactgagcagatcatgggctagccaggtctccatggcctgccccaggcaccgtgatgttccaggatggtaaaatgagggaggaggtccaggtggctgacagctggctgaggcagaatgcgctgattggcgctgcccagaggggaggtggacccctgggctaagggagctccaaggaacagagctgaacccaccactaacaaaagatgggccagagccagcaccgtatgccacagcacgcagaacaaaggcctcgtgccctgtgcccagctggccgtgtgtcccctccaggcccgtcactgggcttcctgaccgcctcatctccactgtctctggtagccaccctcattgtacccttctccatggtgccctctgaatgaggccaccatgtccgaggggacatggatgactccagctggcatggccttgcccatcccttggggctgcagcacagtggccaccctctcctcactgctgggaatgttctggagctgagttggtgcagggagggtgaagaggccccgagccctccacacacccacctctggcagcagttagcagcagctggggagagaagggtgtgagctcttgcagacatggcaccccagggtatcctgtgccaggggacactttggccatgaaggaactgtcggggcatggcaagctctggggggcatcgagggtgcactgacagcacttgtaggggagcggggtcccagtctcagcactgtccagtcagacaggcctggcctgagttccaactgcctctcccagctgtttgaccccaaacatcatggttttctggcctctggaacggtgctggagagggatgaaagcatcaccgggggtgcaggaggaaccacaaagtcctgtggaagttcatggcagctgtgagcctttcattctgagtatctgagaccccaggaggggctgggcgctcgtctgggctgatgtctcacagtgaggggcggcggccccagccaggatgcaccattcattgccattgatgaggtctgggaagagaggtggtttgggggacatcatacggggtccctgggccggagggtcccatctttggaacagaggggccgggggccattccagaacagtgtccaggagagaatgggctctaagccgaccacccagccccctcctgccatgtggggctctgtgctgagtgcatggccccccagccccccgcctgtttgatggcttctcccctcccctctctgctgcctggtcccctggagctctcccttccccagcatggggctcagttaaagaaaaaactgattcctgcagatgaggggaggaacagccctgctggaggcaaggtgggcgtggggggagcttgtctcccctgatgcgcaggcagtggctggcggagcgtcttcgggggtgggggatgaaagctcagactctggcctgtgggttccagctctaggcttcccaaccaccaggctccccaaaaggtctgtagtgtcctgggcacccaggccccgatctcgggggcagggggcacagtgcctcccacaagcggctctcggcccagcctcagggctcctcacgcacacccagggcctctggagtgggcaactcctgcaccctccacttccctcagctcaaaaccagggcaggttcgaaacgcgcgtgcagctcatcataaacacgggtttggaatttctaacgcggtgcctccaatttcacaaaatattgccccactttagacattctcaaggaaaggaaatgggggctgggagggcccagggcctgtggagggtggggctgggggaagcagccatgggaccctttccctgctgctttcaatctggctcagatattttttagatgaaataaaatctgattcagtggtggtttctgcactgcccccagggtctggggtcagaattcccccgctggggcacaataggtgccatttcccatgtttgggggctcagggaacagggtgtaagccatgaggggaggggcttgggaaggtggggatgggctgctggaggccgtgggccggcgtcttggtgtggcagcctccaccacggcaggcaggtcatttgatgcccaaggcccagggccccctgtccaaggtgaggagctgtggctgggtctctggggaggccaggctgcctgcagtggaccggctataccctggagccccgcgctaatgcccatcctcagatgctcccagctccggcttgcctcagggccttggcactggtgacccctcccggtctcctgcactgtcttcagagcctatggcagcagccccacctgagttccagctctgcagtctgctttgggccacatttcctcactgcaggcccagctggctctcagcatggtatctgcccgggtgcccacatcacagagactggggtatggaggatggcaggctcccagggaccctctgggccgatctccaggttgggtgcatgctggacactcactccattctgccctccatttgcccatgctccgtccacccagccgggcccggagggtcaggggtgtgtgggcaggtgctgctcagaggccctggctatggggcagggggcccagcctcaagactgcggcctggccctgagcgtgggcgcagcctggctccccgactctccctccccataaataaaagattcccttcctccttccagcttgcgcagccgccgcctgctcgccggcccggccctttgtgcccacgcgttgccatggagatgggcgattcaaagtcctggcacttcaaggcttccctcctctcctggtgggccggggcgggggtagccgggatggttgcccgagccccagtgggtgccgcctcctctctctgtccagtaaaatgccagatcctgccggggctagggcacccaccaattctcactctggtgtgggtggctgactctggcccctaccctgaaaacagatgcgcttttacagggaccttcttcaaagtttgatagaataagggaaactgaggcacagctggtcccttggccaccgtggggaacacagagccgaccccctgtatcatgcaccatttgcacagtgggctgctttcagctgtgtgctggccagggtcatcaggctccaggacgtggccctgcggagaggctgcccttcctccatcccagcatggacggcccagggctggaagccgggatttggggtgagctgcacggggatgactaatccagccacaaagccgtcccctccacactctgcccgccatgcgggttggagctatctctgagtcaccgtggagacgttgagaatgtcgcagggtctttgaggctcttccgctccccccaatcctgttccccactcatactttttatctccccacaatctgccctttgatcatctcctaagactcatgcaaccagcagaattgacggcagcactttctggttcagccactgcctcccacctaccccactgcggcagccacttggtatttgttgcctgctcactgtggcagccaggcaagtctgggaccccttagagcctcggtttcctctcctgtgtaatggaagcagtcgtccactcttaacaaatgtccagagatgtctgggggccaggtctctgtgctgggcctgggaacaagacacctgattttgggggagattctgtcccccttgctccaccccatgaactctggtgagggtgaccaccacacaccacagttacttccgggccccaagtggctggcccatcagggacttcccgggagtcacaggttggagggaaggaagccagggagaggtggcagagctggctgcaccccaaggctgtctccaaggggcccacccttggcctccatccacccctccctggcccggacccctgtcctgcctcagcagcccagcccacggcagctgtcccctcacaggctacaaagatggtggccctggtcctggccgtggagcaggcaaggcacgtggaacataaagaaatatggttgtgaagtggccaggccatggaggaagctcgggggacctcgatgtctacattaagacctcccaggagtgggttgtcccttctggaagggtgctggggacagccgtgtggcccttttcagtggaaggatcccacatcctcaggcagtgccatcacatcccctgagaagccctgaaacccaggcatgaggatgcagctggcccggtcccggcagggaagggagtgcagcagctgggctccggctcgcctacccactgattgccagtgtcctgggtgagaaagcaggaggcttttgtgcacacatgggcctcgggactgggtcagggctcaggctccccagacgggagaaagtgcatgcagggccaccggctccccagctgaggctgagggaggtgtccttgccttccgtgctcggagccctgtctcaggtgcttggcgctcttctctgcatcttgggtttccagcaggcctgccccgccccaggacttgtggggaggctgggactgaccgcgatcccccaggaacaaggcagatgattgatagaactgggccccgcctgctctctcagcccccagagcccccagaggtgagctccagatgtcaccagggctaatttgggagcccctgccccatagaggaaaccccctgcaccaggcagagccccgcttggcccctgcttcagccgagggctgcggcccatgctgccacctcccctgccctgcagcggagctagatgatggctgttctgtcaagggggccctcggcctagagcatcagtgccactcggccaggactagctcaggtggtagtttggggctttgaccctggcctgtctgatctgcaggccgagcatcccccaccacactgttttctacaggatggaatggaaaggaagccagagaccgggagacccagccacagccatgcaggagagggctggtcagggctgaggctgctgcccctgacctgagagcaacggcaccatgcccctccatctgccatctgcacacagggtcgcctccagcccacagggcaagggggccagggctgggtcctgagtgcaggggtgtccttggcagggtaagagtcagcctaactcaaactccactgccacactttgcagtgagactgacaggtggaataaacccaccaggcccctcagcaccagtaagagctcttcagagtggcccaggcctggccatgtccctgagagaggggtgctgctggcgcgccctgagcagggggtgggctgggccctactgcttggttctatctcagatttttgctaataagcccgtcttttttcttttttttttttaataaacttttcaactttagaacagttttatctttgctgaaaaattgagaagacagtacagagagatcgcatctaccacacaccagtttcaccgttgtgagcatctggcattggtaggttagagttgctgagccaatagcggcacactattatcagccatcgtccatgcagtgttcacatttccttcgtccttaccgatgtccttttctccataccaggatctgactttggtcattgaaattgccaaaaacaaggggacacaggagtgtgtttggccaggtgggccacctgctgctgctgcctccaaatgttcatcccagccccccacgcactcgggggattttcaaagggtctcacgtgttgggtgccagagacaccctcctgggccttggattcctcctctgtgatgaaggccggggctgctggctcctccacaccacactcggcccccagcagacaggcaacaggggccttgtcccactgtagctgtggtcaggtggtccagggctagacggtcctatggggagctgaggcccccacctcgagatctccctgcccaagacaccagtggggttggggtgggtcaaaggcctgttcctccagggcccatagcaggggcttcttaatctgagggtgagagggtttgggaggtgacaccccaactcccaccccaattctcaccctccacttctcaccccacaagctatcaccatgactgcccacctccacttctcacccccacctctcacccctacctctcacctgccgctctcacctaccacttctcacccccaattcacacccctacctctcacctgccgctctcacctaccacatctcacccccaattcacacccctacctctcactcacacctctcacccacacctctcaccttccagctcactccctctatttctcccctctcaacctcttccttctctgagctcagcctccactgaaaaggtggccttttccccagatagctgggcaggggctggaccggacagattgctggcaggggaggcacacttgctcttctttggtgagagtggctcttgcctcctatgatcctggagctcaggcctgtccagcgcccctcctggaggcagcagggtgggtgtgttcctgcagacatggacagcccaccttggcactcagggcccagcaatccagcccctcctccaggcagccatcctggatcactcctcgctgctttagctgactggcatctcagcacctccccagggaatgtccccaggccctgcaaactcagtcctgtcagcccccagcccgctctgggacccctcaggaatgctcctttcctcgagtcttcttcctcccacggcctccattcccgtggattctccctgctaggaagtagatctcatcccgtttcaccatcagggaaactgaggctgggaaggtaaaggtactgcccagagccatgcctgtgggagggctgggacttgctggtggcctgtgaaggttgggcaggggtggatggctggagtccccaggaccaccaggaccacacctggcagtggaggcctagggtgagggactggggctgagcagggcctctgtgctgccactgttgaatgtgacacagctcctgagaagcaagaccagagacaagttaagcaggcctctgctaatggggcgctaacaaagacaagaagggtgagcaggcatcaggagcgcttggggactcgcggtgggacagccatgagaactcagcccacagccatgtcagtggtggcaaggagaggacggatgtcagctgttttttattttattttattttattttttattattttattttattttgttttattatttttctagagggtcttgctctgttgcccaggctgaagtacagtggcatgatcagggctcactcgaactcctggctaacatgatcctcctgcctcagctcccaagtagcggagactacaggcgtgcaccataacagccagataattttatttttttaatttttgtagagactgggactcactatgttccccaggctagtcccgaacttctagcctcaagggattctccctgctctgccttccaaaatgctgggatcacaggtgtgagtcactacagttagcctgttttattttaaaatatatatatttcctgttttgaatgggtatcctctccttccaccccatccccagcgacctgacacccccagctgtacctgcaggcggtccccctcctcacccccactagacgtatctgtgagtgcctcaccccggccccaccagacctgcaggcctctccctgccctccaacagccagacctgtgggagcccctaagcagcccccctagggaacccccagcctgatgcggctgccatccctgtgggtgaggggcagcatctcactgcagcttagatctgcgtgtttctcactctgagtgaaggtcagcagcgggtgatgggaggttcctttcatgcctttgcccatttttctcttgggctgttgctctttttcttactgatttgtattgagaaccaaaaacggccctttgtgaactgagttgccgatgtttttaccctttgttggttatcattttatggtggtttttttctctccatgcatctgccttttattttcacgaggttgaatatacccatcttttactttatggcttctgggttttgtataattcttagagtgactaaagattggttttttgccatccatgctttcttctaggagttttatggtttcatttttactttttaaatcttagttccacttggaacttgttttagcgtcaaggagtgaggtaggaatccaaatgtttcctccatatgtcaattccgttgtcttaaggccaagtgttgattgtatatgtgggattatttgttgaatattccatctctcctcttggatttgacctgcctcttctcatatttgcatttgagcctctttctggactctttcccatcgtgtgactgtccagggtctgtgttaattatcatggtcttagaatataaggcgtttcaggatgtgacatggcccatctctctccgtatgctccttctttcatgtgaacttcacaattgctctggatgggcctcctgattcattcaaggaacaagccgtcaggcttcagccaggccagagaatgggccgtgggtcccagcactgggctttcatctgggttccatcccattggcctgtgccccagggcctggctcctcgggactcagccagtcctgccggtggagtgcgcaggcgtgacgctgagtgctggactctgtttccacgcgaggccttggggtggaggggtgtctcaagggagtggccaaggcagaggaccctctttctggatgtcctcacttgcccatgggaagggaggtggtcctggctgagccacaaggccctgcaggcccaggccctgcacacatgcaccttggcagagccagccagagaggcctgatgaccagagcacccaagcggcaagggcaggcaggagtgcccaggagggagccaagctgtggccgctctgctgagccatccgttccagcaggcagcaggcagcggactgagaatgctcagttcagaactcgagcctgggcatgaaccggagcctccagaaacctgccccttaagcgggccggctaagagtggcagctgggagctggagacccaggacacaggcagcccccagcagcccatgtggcctcttctcagccacaccccgagggccccgggctctgctcccaccatggccggcctcctgggagcccctcgcctggctggatgggccagtgaggcggtggcattgagcagagggtggtggggccggcagaccccagatgtcctgacacaggctaggagaagcgcctccaaggctggcagcaaaccccagccagcctatatagtcagcaggaatcctggctaaaaataccccagtctcagaggcccaccagctgctgcagtctcagaaccccctcctcacgctgggcactgcccatgtgcccctccacctcccttgcaggcaataaggcctgcggacacaggaggaaactcaggccctgtgccagcaagtcctagccccagggcctggcctccaggactgcccacagaggcccccatcttactgcaaggccagggctggccccgccctgctctgcacccgtgagcctgggcaggggtcagggcaggccccatcaggaccagctcgggcaggggcgcaggctctgctggccccaccctgcacagctccctgtcccatggctctcagaggcagagccactggctggggggcagagccccaaggacttggtctgagtcaccatggcagaatgtggggtgctaggtgggctcttcccagtcacccctgtgggcttcaagtgaccacacggcatggctatgccctttatcctggaatcactggctggggaactcaggccaaggcccacctccccggggctcagtttccccacctgtacccagtggggatatgtggaataggggtccagtaaaggtatacggggtgttacagcttgcctctcagagtgtttgttgagtgactaaatgaatgaggaagtgagcagatgaaggcagtgagggaggctgtgaagggtgggaccactgcgctcagagcaagccctcagcctctccatctgggaaacggaacaaacctgcatgccgcatggatcatggtggcccagagtggggtgcccagggacccagggagctcctacaagagcaaggctgggcactagccagccaaggcatcctagggaccatctcactgtggccccaaggtgggtttggcggtccaccctgccttccactccccacccactcctgctgacagctatcgccatgccttccctgccttccctgctccactgggagctcgtgggtgctttcaacaggtgcccctcccccccaacccaggtttgactgcctgctgggctcctggtgttaacagcagctcccaatttagctgtcactgccaggtgggtggctctagaaggatccgtactccctgcaggggtgggggaggggcgtgaagccacagcggatgccttgggcacagcccagggacccccaccttccggagctctgcccctgcaccagatttgtgcctacagggaccagaagcctcctactccccagccccacccagccggcctccccagagagaggccaccaagttggttgtgcccactgagagaagaccctgagcccatctgctggcgaacacaagtggcccgagctcatctcaaggtccaggaaccctggggactcaccccttcctctgggcaccaggaagagtggtggaccaggggtccaggtgccagcctggcatgtcccacttggtcgagtgtcctttcatctctgttcaggttcccatcctggagatgggccacaagggatccagtccagggctgggggaggcagccctgtgggaggaggcccttgctagtgaagggtcagaggcatttggagatgggcaggcccagtgggattcttggggccactgccaggatttggttgtcggtcccttccttgtgccagccccctttgctgctgcgtgtggctttgatgaataagagatgaggaagcatattaattatggcttaacatgcaccaaagttgggcagagggactcctagggatgggagtcctcaggggtgcagaactgatgggggaagaccaggacaccctctgcagccctggggatgggggatggtgagaggcttctggaggaggcagaggctgtgggcaaagagagggctgagagaggctgccaagacgtgggtccacctaagctccccagacctccttctctggtctggaaaatgggtggtggtagtagtgtctacactgcaggactgaatgggatgactcactcagcaggcctggcacagagtcctctcgggccttgggcatgcagccaccctctgtggtgagagcagatggcaggctgacgccccccagctccctggcaccgggaccacatccctagccgcccactcagagtgcagggaagggttggtcacattgacacgcttgggcagcaggcatgtgcttgccgcatgaccttctagcttccttcctggtctctccttgcattggcctggagtggcccagaatgtgtggagcaaagacccaatttccttgctgcccatccctccccaggagacaccgagggcctggatgtccgtgagaaccgcacaggcatgccaaggaaagccatggcacgcctatctctccaggcgggagatgagcctcccgaagccctgggaagaagggaccttccaaggaggctgaaccgtgtccctgtcagcccaagacgggccactgcgaaaggtcccctcatctcaagctggcttctatgggcaggcatggagttttgagtgaaaaccctgcatgatcctctcaggggacaggaggggtgaacaaaggagggacagtgaccagctgaccaggccctgaggcattagcgtctgcctcgtccacatgctgtgcaagctcagcgaggccaaggggctgggccgaggtcacacagctgggcagggccctcatgaccggcatgctggtcgtggaggccgagccccaggttgggggtgggggtgggaggtgaggcagcccctggcctcactggaggggggtggtgggctggggaagctggcaaaggatgtgccctacatggtgggtgtgaggtggggaacgattcgggcagatgcccgtgtggccctgctgacccagtccaggcagggtgtgacaggtctgcccagccctgaggtcacagctgtctgcagtctccagctcactcctgatccccagggccacgtgtccagaaagcctgggagcttgcatcagctgggcacagatggcctgtcctcccagcacccctgctggggcttcctaggaactgactggtgtagactccgggcagcagacggccaggctctgcccacagggtccctggctcctcccatgaggtgacccgatagaactggctgtgccccttgaccaggggctccagcccttgtcaagccctccctgctagcccctcaccagccgtcagctgccctccctcccttgcccgttgggccctgggggggtgatggctccgcggtcgcctgcccagagagtacaccactccccatgctgccccccgacctggctacaccctgaaaaatgtggcttaccaaaccctcccacatgcacagcctgagaagcgggctgtgccttgctggtagcagaccgaccggctgcctagccctgctcaactctgcctctgcacccccataactccctatcagcgctggcccacacctaatcgttccagctagcacccaggagtgggctcagcttccagtggggagggcgctggccaaggtgctgaccgaggtggcggacacaggaaaccagccggtcccccagcgctccctctgtgggccttgggcctgctcccactgcacagacaggtggggaggtggaggcccaggtcccagcccagagcagctgggaacagccggacttgatggctggagagggctgtggtgccagaagcctccaggttagccctggctccccatttccccccatgcccatcccatgccccagaatggtcactttggctgctgcaggaggggtgggaggggctttaaacctatgagatagggtgtggggtcacaatcttcaattgtagtgggccgctctgggtcactggtaattgaagagacgcctgcatagtaagcacgcaagtgtcctctcaagccctctctgcaagcacagagcagcccgagactggagcctggtccaccccagcgctgtcctcagactgatggtcagtgcctcatgactcatctagggtctgatacatccctgtggtgagagctcagttcctagtctaggggctgctgcgtgcagggaccctggaggaagaatgcttgtttaggggtcaggcctcagcctcccactggctctgtcagcttcgcctgaggttccccatctgtgcaatgggtgatgacatcttggtgtggctctgggaggacctgttgagccacctcaggggctgagctggtggcactcggcagccagcaccctctggggaggtggcagtgtgtgcacagcccaccccttcaggaggccaggggacagagtggctgggggtgtctgggccccacctcaccttctgtgtggctgggaatggcatgcactccacaatgccctcataagcctaggctgggacaagggtgatagggataaagcaggccaaggtgatgagggccacagagcggcagccagaggcatgtgggcagtgcagcctccacaccaggcagagggcccggccagcatggctccaccctgggaagctgcctgccactgggatcagatgggagcaccagggctctgggaggtcctcacttcctctggacaaggcaggcaggtcaccagccctgtgccctgctcatctccctcagggccacctccatggccaggggcaggcagagagcacagggctgcccagtcaccaggtctctctgcttcatatcagtggacctgggctctgaggggagccatcaagacctcaggctggcccactccgtccttgagtcagggtcctacagactgacaccaggttggcctgcaagaccctggtcctgtcatgcagggtgggcctggggaggacccagcccagctgagctgactcccagcactcctccaggtgcagggacagcctggcagttgtctgaagaccccgggatgggcttaggagctcatcatcatcggatgccccccgagcagaagacggagaaggaacacccccaccctgtgtggtgtgtgtaggggtgtcactgggttctctggctccatgacgcccccccggccccgctgggggctggcttagtagagtgggggatgatactaagcaggcggcctcggagagcgtcttctgggtttggaggccacattccgcaggaaggaagaggtgggggacccctgcagggttatgggtaacatcaggcctgggtcccctccctggggtggtgcagagagggccacaaaggcccaagagggcccccagaacgctcttaagccttgagcctgtttcttactgaaaaatgggggcgatcgtgctccagcaaggggcttctgtgcagggggcgggggggggcggggggttcatgggtttcgtgaggccaggaagcgagtgggtcgcgcagaggccatccccaggcctcaatggccccagccgccatcccctccgccgcctgcagggccgccgcctcttcaggaatgcgcggctttgtctagggccgggtgggctgagcacctcctgctgcccggcctacgctccccggccagccgcgccgctcacgccccaacttgggcccgcgccccccagcccccgcccaggcccgcgccccccagcccccgcccaggcaggcgcctgcgcccaggtgagggccccgcccgccgccgcctcccgcgccctgcgcgcccgcggcccgagccccgcccgagccgggcggagcggagcgcgcggagcctagacccgctgccgggccggggctgggccggagcggcggcgcctggatgccggcccggggctgggccggagactggcgcccgccccgaagcgactttcggtccccgacccgctccgcctgacccctatgatgaagagggcgtccactggaggtgagtgtccacgcggcgccagagcccagcaggcggcggggcgcagagcggggtggttcgcccctcctcggagccgcagggcccgtccagggcttccaaggctggggaagcgtagccgggcggccgggagggccaccgcagtgccgcgccaggctggggccaagggcgccccggccccgggagggcggagccggaggcagcaggaaaagttgccgcttcccgggtaagttgacggcgatggcggggccgggggtggcggcccgggggtccccgaggctgggccaggtccggggtgggggccgcgggctggaaggacggggtccggcctcggcgccgcggccacgaaggggttaatgagcgggtttttttgcagaaacgcgggtaccgagagtaggtggaggtatcgggccgcctccgcccccgcctcgcggactgggctcagaacctcccgtttttctgaggtcaggcctcagggggatcaatgggggcgttggcggcagtagagggcgtgggggacaaggttgtcccaacgctgcctccagggcgggcggtgagaggaggcagcaatgcccagacatccgcagcccgagggacattgagaggcttggctgggggaatcaggggtggtggggcaatcagcatcccctccctggcagccttcgtgagactcccccgccccactgggtgtgaggtcccgcagtggggggcaagggagggtgggctccatgtgagttgggcatgccctgcctggagggtgctccccaggtgcccacccaggctgccctgctgatgtccatggtgtcgcaggctgcacacacgtttccttgcacgtgcacatgtctacacggactgcacacttgcacacctctggtgcacatgcgtgccagcgccaccccagtgtacacatgcacgaacactgggtgcacacacggactctgagggtgcatatctgtgtcctcgcccccgcttgcacgcccacggccacacatgcatgtacgcgacatgcctgctgtggtctccacgggtggcacatgctggggcccctttcacaatacccactcccgcacccacatgctcgtctgttgagtggggaggccaggcccacagacaggggcaagacatcctgggccccacctctgcctgcctgcctccgtgtcctgggggtccccgcctcgggcgtgtgtgcgtgtgtgtaacttggtatgcatctgcacgtgtgtctgtgcgcgtgatcatgtgtgcctgcgagcacataggcatatgtctctttgcctccagggtgtgggtgccccttgtgtgcctagacaggctgtggcctaatctggagcagaggccctggaatgtgtgttgggggctcattgaatgcccccagcccagggtgtgaggggcagggtctcccagccactccgcacccaccagggctgaggcagtgatagatgatggtgggctggaacctgtctggtcagggaagacccatttcaggccatgaggtcaacactgtgaccaacaggccagaccctgggcacccttggtggccgctgcagcttggctgactggagcacgtgacccagcgtgactgcagaggccccgcctccagtacctcagtttctccatggtgaggaccttcttggtgaggggttccgtggtgggctcccctacctccggtgttgtgtagggtgctgagcagatggatgccatgctgcatgatgggcaagggtggcccactagcactgtggcaagggccctgggctggggcttcaattggcaggccacacctcctgctcccctggccaccaccagaggctcatctatagagtggggaccagcaggttatccttgtaggttgtgtgagggtgaaacatactagcagaggggcagctgaagcagtggggctggccagtctctttttctaagcctcagtcttcccatctataaagggggtactgttccctgttcttctctactgaggtgaggaggaagtgagctcccatgccgggggtgggaatgggtggccatcagcacctagaccccacctggcagaggggcacgtgcagggcctgccgtggcagaaccgtgacctggatttgggtcctggctcagccacctgctggcagtgtgaccttgggtgtgacaggtcacctctctgcctcagtcttcctcacctgcaccatgggccagtggtcagggattatcggggcacttccaggctgaggctgggcggaattggcccggctttccctgtggagttccgactctggtgcttctgcctcagaatgcccagaacacctccccacaccccaactcagcagagtcctcctgggacctttgcatggccagctggcccctcaccccatccatttgcagaagggacaataaaagcccctagtcaggcaactcaggccacaggtgagtggagaggggacagggcagggatgctgcccagcttgggagaccctcccatagtaccttcactccctccctgccctccccctgttcctcacctgggggtctgtggaacccctgagcctcagtttccctgtgccagggtccttccactgggactggcagaaacgtaggtttgcatggagtgagaagcaggggagaggttgagggagggcctggcccagcaggtctctgaaagccagagggcttgtggagggtctatggaggacacccccacaggggctggggccctggaaggtgggggaaggtcctgttgtcctgggaggctggggactggcccacagcctgtggaggggctggggtttgtttgctgttgctgtgagtgacaggcaggctgtgagggccagggcatgtgggaccgtgccctccgcctccctctgcccaaggacagtgcagccttgtagcactgccctctcctcgtccctgccccagccttgaattcatgctttgtggcacggacggccctgtgcagccggtgcaacaccaggagggtccagctggtgaggacaggacgggtgggaggcagaggagccctcctgctgtcctgggcctgtggcccggaacctctcaccgggagccttggtctgtgcacctgggaaaggggtcaagaacaggaagcatacggggagtttcaggatgacctggaaatgaacaaatgcatgtgtgagccaggcgccctgcccggccctggcacagggttagtgagggctcccgacgcttggctactgtctgatcaatgaggttcatgccgtcccgcccccattctggcaagcctgacctctgatccccaggctggcctgcctgaccctctgcagccacccagggcctgggctttggggtctgcaggagccggcctggctgcctgctgcctctgcagctgtgcagatgccctctcggggccctctctgcacccctcagtgtccctgctctgcagcctggctgcacccaggccaaggtcacaggcaccctcctcgaagccagatcccagatgctgcatttgccccaactgtccgttcactttctcatttgttcattcatttgcttgttcgttcctagcctgtcagattctcttctgagccaggcaaatcaaggggtgcaatccttggcatcgtgcatctctaggattaaatgctttaaaggataggaggtaacagagtggccccggggaagcccgatcggagtggcgggcatgctaccccaccctgcaaatctccctgcactgtccctggggcccagctgggttccccacaccagttgttctgtgctgccgtttcttcttttatcgctgtattttaaacactttgcacatcgggaactattcttgtgcatcgtgggttttctggtgtgtgtggaatcccttcctgagaatgcaccatcatttatttatccaaacctgcaccggcctcctgcactgcctgcagccgtggagctgggcaccgggagatgcagctctgcacacccaccccaccatgtcctcagctggcacccaccaggtctaggggctggtcacgtgcctctcccctgatgcttgagctgatttcaggggactcggcagcagggccagatcccgcccctcctagccagctgaggcctttgacaaccgtgggctggccgggtgggtgatggtgagtgagtagagtctgggcatccatttgtgcagtgggtgccttggggccgcctctcctctccctctttcacacagcctctggtcttgcccgctatggcctgcggggcctcttctgcggggcagcagggcagcggggcatggggtaatgctgacactgttctgcagctgtgtcctgtccaatggaggcaacccacggcagccagaccaggaggtggagaagaaaggcagggctgttggcacacctcgagagtggccttaggagaggctgagtgggcacaggccagggtccccatgtagttctacacaggcctggcaggcggtaagccccattcagggccctggcacatggagccgggctgatctgggagtgaagtgtcaggtgctgacccagcctcactcagagcagcctgccctgggcccccgggtgcctcttggctctccagtcggcaccctggcattcttagctggctgtcacgggtcacggtccatggagttgaaattctttggaatgttgggggtatcacataagggctttgtggtcaaatgtgggacctgctggaataaatggtgctgatggtgctcctttcccgcagggcatcttgggctctgttttggagaggggtgggcagcaccttctctgagaggcacccctatgcgatgtacctcagggcctggtgtgcccaggaacctgttttgggaaacagtggttgaagtgcctcggaggaccagaggagacctgtgggcctccagcaagtgccccaggatgggtagaccctgccacacaaaccccgcacccacggggcgcccagtgggtggagggaccactgcttcccccagcagtttgaggcgatgtgcaaatttaacctttggatttatgactcaatttctttgtagcaaatgtcacgggaaatgtcaggccaaggctgaggctgggtgaggggcccgtcgaggaagcgggtagggctaggcaggctagagtaccgaggaggggctcaggccagggtgggcttcaggcccctcacctcctcctgggagccttcctggattgtcccttgcttgcctggatccccggcactgtgtcctcaatttgtcccagctatcacaaccttgttgagatgttgcctttatttgccttctaccagggcccagatgaggccagctcggggacatgccagaagtcccccattccccaaggctgggcagccatgggatcagcttgtgcagtgccggcttgctgtatgaccttgggcagctccacccttcctggtcaccgtaggcctctctgcagtccacagctggtggccagaggtggtgttcccagctcagtgccttcaagagtgggaaaacgcctagagtcctcagtatgtggggtgtggggctctggaggaagtgggtgggggctgaatgcagggctggggttgcggagggctggcccttggtggtcccaggggctagagcagcccctgcacacagcaggtgctcagtaaagaccaaaaggcagtgcgtggatgtggaaggtggaggtggattccagctgggagtccacagtccccagttacatgtcccccctccaccgccacatgccagatgtcattccaaggccccacgctggcccgtcaccagctctgccctgcctcccaggcccgggcgggtcagggaatggtgactgcctcctccctgccgtgtgccaggcctgtgcactggagcaggggttcaggctccctagtgctctgcatctctcctgcacacacagctccccacactgcacaccttaggcctccagatccagcctgtctgctagtgtcacatcctccgtacccaatgtccaagcccagagtctcagcctcttccctcgacccatccccaaaagcaaaatcagtgtcaaacctgcaccctgtctcccggtccatcccctttactcctcactgaggaccagcctcagacctggcctctgtccccagcctgtggccacagctggcccctgcaacctccctgcctcctgggttcaagcgattctcctgcctcagcctcctgagtagctgggattacaggtgcccaccaccaagctaatttttttgtatttttagtagagatggggtttcaccatgttggccaggctggtcttgaactcttgaccccaagtgatccacccacctcaacctcccagagtgctgggattacaagcgtgagccaccgtgcctggcctctgaaggacactttcaagagaatacacaaacaacaaatcaggagaaactatttgcaaatcatatatctggtaaaagacttatatcctaaatatacaaataataactctcaaaactcaataataagaaaaaaacctattcacaaattgggcaaaataattgaacagatggttcaccaaagaagacattttgtcagcaaacaggcacctgaatagatgctccacatctttagtcattatggaaatgcaaaatagaacctcagtgagataatatttcacacccactaggatggctgtaatttaaaacagaaaatatcaagtgttaggaaggatgtggaggaactggaactctcatacgctgttggtgggaatataacatgatgcaaccactttggaaaatagtttggtagtttcttaaagagttaaatatgaacctaccatatgacagtcattcccctcctaggtatttacccaagataagtggaagcatttgtccagacaaagatttgtatacaaaggtttatagcagctttattcgtataagcaaaaactggaaatgacccagaagtctgtccacatgtgaatggataaacaggctatgtgatatcaatacagtggaattgacttttgacacatgcaacgtggatgtgtatcatggatgaatatcaaaggattttagacatggataaatatcagaatgattatgctgagtgaaagaagtcagacaaaaaggagtacatactgtatgtttctgtttagattaaattccacaagatgtaaactaatctacagtgacaatatagaagaatggttgcccggggcagggaagggcacggggaaccttttgggggtaaccacctcaactgtggtcagaggttcacaggtacaaacatgtcaaaaggtaccaaattatacgttttaaatgggtgcaatttatgtcaattacacctcaacagagaaaaatacaatgcttattttatgcaaagggttattttgtaaaactcttttgaggaggaccgtcctggtcagcggccctcaccatcgagactctccctgcacatgggtgctgtggtgactcggcccctgggctcaccctctggtgctgtgtgcacctcaagagcaggatggaaaggtcccctccccacagcctggctgtcagacccccggcacagaggtgcaccgtgcagcctcccgtcatttcccatttgcctgcccaagctctcagtgtctgagctctgtcctctttctggaagacagccaggtttagtgttgggagcaggagaccagcatgggctagcccagtcccaccacctgaacagaggggctgtgatcctccaagctacccagggaaggtgccacctgggtgcacagctggtcccaatggtcaggcctccccttgacagaggggcagggccgtgtcatggtcagggcctgtgctctaaagccagactgagggtcaaaacccagctgccccatttacaagcttcacggtctcaggagtgtcactctgcacatcagtttcctcatctgtaaaaccgatcagtgacatctgcctggttacctgctggggcaagtgggtgagttgagtccgatgaagcacttagaacggtgcctggtatgtggcagtgtacagagcatggggcaatcactgcagccgacctagctggtggctccagtgggccttagtgccccaggcatctgaggagcccactcttcagcactgcccccgagtggctgcagcacacactcccccaggactcattcagccctcccaaggagtgggaagcctccggaacctggtgctgtccgaggcacgacacgcaggaagcagggcaggtgtcctccctggcccctcacccttcctagccaggctgcagctgatccgaggtggttccttgatcctggagtctgaagggacattgaggggctacctgtgctccaaacagaccagcccgcttctcatctgcttcacacacaggggttctgggtaagatttcacttcatttctttgaaacaccactctgctgggccagccaagtcctgtagaccccatcacttgtaccccttgacctcagcaacaggaccaagacctgtagaccccaccacttgcaccccttgacctgaaaaacaggaccacaacctacacccagccgtcctcacctggactatgaggatggtactgctcactggctccggacagctgtgtgactccaggggagccagctgtggttgagatctcgggggtcttggtaaatctggtaaactccttgtgcagttctagcgagcccagtgtgaggactgcctgttggctgggaaccgtaaatctgcttgggtttcatgagaatcttgccctgagtgacctccagctggggaactcaccctccatctgcgccagggagagcttggtcattgtctgcagggacccaactaatcaggacgggcttccacgaggagacagatttgaaagtatgctctcttcgggaagcagtagctttaaactggactagctcttatataatgggcactgtgtccctaacgaaaccaaaatatggtccaataatggcttctttgagggaagcacagggcagttgggttgtccaaagccttctttggaacttcacaggtttaaaaggtgatggttcaagaggccccagtattattcagccatataaaggaatacataaacaaaaatgtggcctagccatacagtggaatattactcagccataaaaaaataacattctaatacgtgctacaacatggaagaaccttgaagcatgatcctgagtgaaagaagccagacacaaaaggtcacatgtaatgtgattccactcatatgaaatatccagaataggtcaattcaaagcgacggaagatacattagaggttgccaggggccagggaacagggaaatggggagtgactgctaatgggttctgctttagggtaataaaaatgttctggaattaaacagcagtgatgattgcacaccattgtgaatgtactaaaaccaattaattctaccctttaaagtggtggatcttatgtgaattatatctcaattgtatctaaataaataataatttgtaaaggcctcaggagaggagctgataatcaggacttaatccctgacttggcacactacctgtcacccaactgtctccagtccttcatactcatcaggagccttgtgcaacatcacctttgcacttgaggcttcctctgcttagaatgctgatctgcctgccccagcatgtcccatgagcctgcctggctcagctcagtgactctcggcttctgctctccccattccaggtatcacagcttgtattctgctttcagaaatcaggtagtcaatcttgctggtgcctaggggactggcattctgtcacatataaagagtgggtgaccgccaggtgcggtggctcacacctgtaatcccagcactttgggaggctgaggtgggaggatcacgaggtcaggagatcgagaccgtcctggctaacacggtgaaaccccatctctactaaaaatacaaaaaattagctgggcgtggtggcgggtgcctgtagtcccagctactcaggaggctgaggcaggagaatggcatgaacccaggagagctaagatcgcgccactgcactccagcctgggcaacagagcaaggctccatctcaaaaaaaaaaaaaaaatgagtgggtgaccagcattagagcatcagggaacaccctcacccaggcactcacctgtgggatgaagccacagcacatcaccatgtggaagccaaacttggtcacatactgaggctcagcaccctcacctcttcagcctgttgacagagatccttggcctgaaggagctgtttgtctttctcttaaatgccagacctcagcagagcatcagtacaagcctgggctgcacatgctagaatatgggtggtctaaggatgtactacatacagtagcaattagtcaatatatggatctgccaggacactcctacctgaagcacactggacagcagggttgggtataaaaggggttattattacctcaagcacaccagacaagagggctgggtataaaaggggtcatgtgccaattctactagcttatcagctccatcaaaattcttatttaataatgtcattttcataatgtagtgtaaagggagatggtatacaactcaacctattattgaaatgccaccaagaagtaccatgagcaccaatctagggtagacaatgtggctgggtcaaggtacccaaaagcaatctgaacatacccactgtgttctcctccttcaacttctccctgagcttctggttgtaaaggtgcaaatctgccatctggtctccaagttttgatgcttaacggaggaaagaagaaatgcccctaattaaaataacaaataaaaaataacattatccagtttgttccattttcagaaatgttttaaatacattaaaaactactctgcactctttaaaaagtaaaaaatgaaccccaggcaatgactcttttcctatttcttttttttttcttttcttttttgagacggggtcttgctgtgtcatccaggctgtagtgcagtagcacaatcatggctcactgcagccttgacctccaggcctcaagcaatcctcccacctcagcctcacaactagctgggacaacatgcatgtgccaccattcctttttttttttttttttttttaagatatggagtctccctatgttgcccagctggtcttgaactcctgagctcaggcgatcttcctgccttggctccccaaaatactgggattacaggtgtgaaccactatgcctagccctggcaatgacgctttccaaaatataaaattgtgtaatcacaaagaggaattaagcaggtgagcttcaacagaagtcttagcaggtactaggaattaaaggaggagtgctgaaaaagtaacaataagtgaaaatgcagggtcaggcacagtggcacagtggctcaggcctataatcccagcactttgggaggctgaggtgggaggactgcatgagaccaggagctgaagaccagcctgggcaacatagtgagatcccatctctacaaaaaatttaaaaattaaaaaaaaaatagctataaattttttgtgaaaaccaatgtaaatcacatataggaaaaagactgggactgggtgtggtggctcacaactgtaatcccagcactttgtgaggctgaagggggtggatcactgaggtcaggagtttgaggccagcctggctagcatggtgaaaccctgtctctactaaaaatacaaaaattagctggttgaggtggccggatacctgtaatcccagctactcgggaggctgaggcaggagaattgcttgaacttgggagggggaggttacagtgagccaagatcgtgccattgcactccagcttgggtgacagagcaagactttgtctcaaaaaacaagcaaactgtctgggtggggtggctcacgcctgtaatcccagcactttgggaggttgaggcaggtgcatcatgaggtcaggagatcgagaccatcctggctaacacggtgaaatcccgtctctactaaaaatacaaaagagaaaagaaaaaaaaatagctgggcgtggtggtgggcgcctgtagtcctagctcttagggaggctgaggcaggagaatggcatgaacccaggaggcggagcttgcagtgaaccgagatcgcgccactgcactccagcctgggtgacagtgagactccaactcaaaaaaaaaaaaaaaaagaattgcgtatttgtttgttttgagacagggtctcactctgtcatccgggaaggagtgcagtggcgcgatcttggctcactagagcctctgcctcctgggtccaagcaattctcctgcctcagccccggagtagctgggattacaggtgtgtgccaccacaccctgctgtgtttttgtatttttactagagacggggtttcaccatgttggccaggctgatcaagaactcctggcctcaagtgatccaccttcctcggcctcccaaagtgtaggattgcatgtttaaaaaaaatcaaacctcatgaatgagaccaaagcgtctactggcgcacaggaaaagaacaccctttacttgaaattaccccagggaaaacccaggcacagcctccccagcctggcagcccctgccagcctgtacctagggtgggcgtgagcgtccacagctgggagagcagccggcacaccccagccctgctcccagggtgagccacgcatgcaccaggcagagaactcctgggcttccggctgctaagccccaggggccccagcgtcacctgctctcgtgcgtggactgagcacctactgtgtgcaggcccttctcaggggtgggagggaaggagtggtctcaccctgcagagctttcaggacaactgaggaagtttcccagggtccatgggaagtctgaaccaaaaactgcttcccagtgagtgggactcctcactttgagggatttgggttctgagccagtagagcaggcaatgcaagaggatccgatcccacatccaggctgcatggctctgggagtcctcctgccagcactctccaccaggacccctgctgcccctcagagcaccccccaccagagtatgcagggcctcttgagcccacttgggccaggagggcacccaggcctgcctttccctgcctgcctgctctcaagggttaagctaactttctccatttgtgctaacgttttccatacattctttatttatttaattttttttattttttgagacagaatcttgctctgtcgcccaggctggagtgcagtgttaccgtctcaatctaggctcactgcaacctctgcctcccgggttcgactgattgtcttgcctcagcctcctgagtagctgggattacaggcccgtgccacccccccgcccccactggctaattattgtattttttagtagagacggggtttcaccatgttggccaggctggtctcaaactcctgatccacccacctcagcctcccaaagtgctgggattacaggcatgagccaccacgcttggatttccatacattctggccattgggacgagctgtgcacccaggtgtcacattccctgggtagcttggaggatcacagcccctctgttcaggtggtgggactgggctagcccatgctggtgtcctgctcccaacactaaacctggttgtctcatccacgcagggcccccacaggacctccagtccatgcagggcccccacgagaccttctggtctgcacagggcccccagagaccaggaaggatcccctcgctggaatttgagtcccagcctgcgagttgggccagtggcatttgttctccacgtgtgactctgtaaacagctttccctcctggtttctgtctttttttttttttttttttttccgagacatggtcttgctctgttgcccaggccggagtgcagtggtgtgatcttgactcactgcaacctccacctcccgggttcaagcaattcccctgccgcagcctcccaagtagctgggattacaggcgcccaccaccacgcccagctaattttttgtatttttagtagagatggggttttaccatgttggccaggatggtctcgaactcctgacctcaggtgatccacccgcctcagcctcccaaagtggtgggattacaggcgtgagccaccgtgtctgccctggtttctgtcttgggtgtggtccccaaactcttaagcacagcctcacacctccacccagtcattcacatagaccctggggtgcgcagaggcagagggtcacccgcagaggagctgtccgcatgtccatggcagcctcagtgtggcttctctgctcagcccagggtgtggtgattccgtcactgctttaaatgtggggttcaggaggaattctgatataacagggatgtctccacatgtcttccctgccttagcgtcttgaggtgtacgtggaaaaacctctggcagggctcactctgacagagtcccggcctctgacattgaatcacccacagtctctctagtttatgtggtagggttcgggatttatgaaaatcaagtactaaaaaatgacttccttgtctctttgaattcaactctgattaatgtttgatcctatttattaacttaaaccatgaaattcccttaagtattttaaatggaattaatatacgtcatatatttgatttttattttcctatatcagttgtttggctagcaaacagaccttccaagcatttaaacagtgcttgtaaatctaataaattaagctaaaaatatgaagcacgtttaattctctggattttaatatactttgtgagcttagtaacatttttctattcctcttaaacttaaaaaaaaaaattgaaaactaggccagtttcagtgggtcatgcctgtaatcccagcactttgggaggcctaggcaggtggaacacctgaggacaggagttcaagaccagcctggccaacatggtgaaaccctgtctctattaaaaatacaaaaattagctgggagtggtggcacatgtgtgcctgtaatcccagctactccggaggttgaggcgggagaattgctcccaggaggtggaggttgcagtgagccgagattgtgccactgcattctagcctgggcaacaagagcgaaagtctgtctcaaaaaaaaaaaaaaaaaaaattggagactaatattaaagagcacaatctaaagtgtagggctggaatgaatgaatgagctctctaggcgagcaaagcctttcagggctgatgtccctcggtcccacgagccaggcctccgcaggctgagcactgagcgctgtctgtctgaccagaacatcatccactcgggcagtgccctcctggccccggccaccagggcagcgtgggagcagatccagcggagcgagggtggcacggcacagctgctccggcgcctcgagggctacttcagcaatgtggcacgcaacgtgcagtggacgtacctgcagccctttgtcatcgtcaccaccaacatgagtaaggcactggctgcgttgggggtggaggcctgcaaccctcaggggtgcgcccaggagctgggtccccatgggtggagcaggtgggctcccggcccccacttggccatgctcttagaaaaatgattcagaggctgggcgcagtggctcacgcctataatcccagaacttttggaggccgagacaggcagatcacatgcagtcaggagttggagaccagcctgggcaacatggtgaaaccctgtctctactaaaaatgcaaaaagtagccaggtgtgatggtgcatgcctgtaatcccagctacttgggaggctgaggcaggagaatcacttgaacctgggaggcagaggttgcagtgggccaagattgcactattgcattccagcctgggtgacggggagactctgtcaaaaaaaaaaaaaaaaagccgggtgcggtggctcatgcctgtaatcccagcactttgggaggccgaggaggggcagattacgaggtcaggtgatcgagaccatcctggctaacatggtgaaaccccgtctctactaaaaatacaaaaattagctgggcgtggtggcaggcgcctgtagtcccagctactcgggaggctgaggcaggagaatggcgtgaacatgggaggcggagcttgcagtgagctgagatggtgccactgcactccagcctgggcgatagagggaaattccatctcaaaaaaaaaaaaaaaaaaaaaaaaaaggttcagcagcaaggcctccatttcctcatctgtaaatggagcctttgggaagacagtctgcaatgacacacccatggctcccaggggacaggtcctgggcttgggagatgttaggccgtgatcttgggggtttggcaggccttccagaccctcaggtgtgagactctagaagagtgagtgtcgaggatcctgcctcacttcaggctcactgcagacaggtgtaggtacacatgggatgcaggaagttggaagtcgcttctgttctaaagatggttagtcaactggatatggcggttcacacctgtaatccctgcattgtgggaggctgaggtgggcagattgcttgagcccaggagttcgagaccagcctgggtgccatagtgagaccccatctctatttaaaaaaaaattagccaggtgtggtggcatgctcctgtattcccagctactcaggaggctaaggtgggaggatcgcttgagcccaggaggttgaggctacagtgagctgagattgcaccactgtactccagcctgggtgacagagtgagaccctgtcttaaaaaatacatataaataagtaggctgggcacggtggctcatgcctgtaattccagcactttgggaggccgagggaggcagatcacttgagatcaagagtttgagaacagcctggccaacatggtgaaacccattctctaccaaaaatacaaaaaattagccgggcatggtggtgtgtgcctgtaatctcagctactcgggaggctgaggcaggggaactgcttgaacccaggaggcagaggttgcagtgagcagagattgcaccactgcactccagcctgagcgacactgtgagacaccgtttcaaaaaaattaataataaaaaataaattaattaataaatatgtccagccagtgtcagtgtgacagttgtggtcattttgataacagcaagggttcaagaaagccctgggagtgatgtctgattaaatgaactgtccccccagttcttgctgtcgacatctttgacaagttcaacttcacgggagccagagtcccatggttcgacgccattcatgaagaattccccagggagctggagtcctccatctccttcccagccaacttcttcaaaccacctgaagaaaaaggtagaaccgcttagaaacctgctacttcccttggagtccccagcgttcagggaggggagggctccccctgcgggcatcccaggaggatgaacacgccatactccctgcgcactgaagatccggggccggagtgttccgagtgttcgctggcaccaagtcctattggtgacagcaggttgttttgtccaagtgcttaggtagaggttgagcatcctaatcctgaaatctgaaatgctccagaatctgaaccttcttgagcaccaacctgacacttaaaggaagtgctcattggagggtaagtatgaaatgatactttaaaataaaaaaaaatcaaaatccaggccgagcacagtggctcatgcctgtaatcccagcactttgggagaccgaggcagggggatcacctgaggtcagcagttcgagaccaccctggccaatgtggttaaaccccgtctttactaaaaaatacaaaaaattagccagctgtggtggtgggcacctgtaatcccagctactcaggaggctgaggcatgagaatcacttgagcccaggaggcagaggttgcagtgagccaagatgtgccagcctgggttacagagtgagactctgtctcaaaaaaaaaaagaatccagaatgttcccaaacatttcagttaagggatactcagccttgtaactgataacttgagaaagaaaagagaactgaaatttgtatgtgagctgattgtctttgatgggcagttgaacccgtgaagttgaacttgtcaaagatgttgacagcaagaactggggggacagttcctttaatcagacatcactcccagggctttcttgaacccttgctgttatcaaaatgaccacaactgtcacactgacactggctggacatatttatttatttatttatttatttatttatttattattattaatttttttgaaaaggtgtctcacagtgtcgctcaggctggagtgcagtggtgcgatctccgctcactgcaacctctgcctcctgggttcaaagctgcttctagctgggcatgatggctcacgcctgtaaccctaacactttgggaggccgatatggggaggatcgcttgagcccagaaattcaagaccaatctggacaacataggaaaaccccatctatactaaaaaagtttttttttaaattacctgggcatggtggcacatgcctgtagtccaacctactcaggaggctgaggcgggaggattgctttagtccaggagatgaggctgcagtgagttgtgattatgcctctacagcccagcctgggcaacagagcaagaacctgtctgggtcgggggaggcaggggaagctgattctaaatagaaatagaaattttagactcaccttcccttccctgcaagaaacaaacaaacaaaaacaaacaagaatgctgtctgtgtatgtacaaatcttcactcctgggttgagattatgatacaaaacagtttgaacattctgaactttcttaaggtgctttttttacagatctgtgacaattactaaaaacttccccaaataaaaaggacatgaaaaggtaaactccataatggacagtttaaaattggaaaccttcttagtaaatggattttgtcaggtatatggtgttacctcatgtgtcttttttttgtttgttttttttttttgacagaatctcacgctatcgcccaggctggagtacagtggcgcgatctccgctcactgcaagctccgcctcccgggttcacgccattctcctgcctcagcctcccgagagtagctgggactacaggcgcccgccaccacgcccagctaattttttgtatttttagtagagacggggtttcaccgtgttagccagaatggtttcgatctcctcacctcgcgatccatccgcctcagcctcccaaagtgctgggattacaggcgtgagccaccgtgcctggccctcatgtgtcttaaaaagaggggtgactctgatgtggggtcatgcttgaaactgagaggacgaggtccccgaccctccattgcagccagctctctctggaactaacagagtgagaactcgctcattaccaaggggaggacaccaagccattcatgggggacccacccccatgacccaaacaaccccgaccacgcccacctccaaccctgatcacatttcaacatgagatttggaggggccagacctcaaaactgcatcagatacattcatgtttaagcagtccatctccagaactcttttcatcctgcagatctgaaactctagcccacaaaacaccaactccactccccagccactggtgcccaccgttgtttctgtctctgaatttgactcctctagggacctcccataagtggaatcatacaatatttgtccttttgtgcttggcttatttcactgagcgtaatgttctctaggttcacctgtgttgtagcaaacgtcagactttccctccttttgaaggctgagtaatattctgttgtgtggatggagcacgcattgtttatccactcacctgttgacgcatgcctgggtcgtttccacctttcggcctgtgtgaatggtgctgctctgaacaggggtgaagacgtatctgggcgtctgctttcagttcttttgggtgtatacccagaagtgggcttgctgggtcacgtggtaaatcctgtggttgattttttgaggacgcaccatactgttttcggtgggacatctgttgggttttgagaagcacctgctggcactgagagctgtcttggggaacacaggtgctcctgccggagtcctcacgctctgctcacgttgcagaaggccccctggtaaggccagccagccggaggaccaccccgcagaccacacgcccagggcctggcaccgagggggaggccccgatcagcaggtgaaagcgacaccctgatgacactggctagttcaccttcactctggtcatcgtttactgtaccccggggcagctcccgcctgagccctatgaccccaaccgccgcagcctctggtaaggcctgggtatggggcacatggagagggcccattccagaggctcctaagtcaaaagagattccacaagtcaaaatcctgatcctgatcaagcacaggccttcacagtgacatttcactgtgaccctggcccagagacagagaccactgtcctgcagtgtccctgggagggaggttctgggtctgccacaggacaccacaccctggaacattgcacaccctttgcctggccttttcccagtgtttctgtcagaaatgccccctcccaagcatacaccccatcttgtgccccgagggactcgattctctccccacacacccgacccgaggctgtcatgggtagtgcctgctgctggccccagggttagggctgctcagccagtcctggctggaaaggatgaatgtcccacaagcagctttggggcctgcttggtgggagcagcccgaggatccgcccttcgtcctcctgccatttcccacttccctggctctggggtcctcatgttcacgtggttctcagtgactgggtgattgacccccatgagctgtcattattttggtgtcttttgctggacatttaagccattccttgtgtttctgccattagctattatgggctgtaacatctttgcacctgtgccttctttctttttaaatttctgaagtcctaatttgacccaaaggtgacacatctccctgtgtgccctgtcagtgatgaaacctgctctggggatgaagatgccgtggggcccacagatccaagctctcggagtgtgattctgtctcccctagaaacacatccatggcatgtcctcagggcatttgtgcatgggattaagcaaatgtttcctaatcatgtttgtccctgtgctctggcttcttgacctcaggctgcctcactggcccatcattaatacgtcgatggtgagcgcactggtgtacagcgagggggctccacttccgagacccctggagaggcccgtcctggtggagttcaccctgctggagatggagaagcgaaccaagcctgtctgtgtgttctggaaccattccctggcgtaaatgtgatgccgggagttctgcatcttcatgtgagggctttgccaagacacagagaacccgcagggttgttggctcagcggcagatcgtcccacggggacagtctcttgtggtctgtgtctcccccttcagccccctgtggggcagtgagcctcctgctctgcttctgtgggtgcatcagagcccccccagatgcccacacgcagacgcgcacaggcctgcacgtggaaacacagacatgcgcacacgcaggcccacacacagacgcacacagagctgcacgtggagacacgtgcgcacacgcaggcccacacgcaggcccacacacaggtgcacgcggacctgcacgtggagacacagatgtgtgcacatgcaggcccacacacaggtgagcgtggacctgtgtgaacagatgcgcgcagacctgcacgtggagacacagacatgcaggcgcacaaagagatccctcaaggctgacacccaggaaggggcctctcacttgtgggactcccgagatgcagtggccaacacgagtgtagtgcccagttcactgctggataagacagaggcctgttctggtcacacatgggaggcagaacccagagactgggcccaggagcccttctgctgacagtgggaactcccagctacgtgtgggggtccccataccagacaaaggtccctgaccttagtcttgcccgagaggccgacacagcccagctttggggtctggctttacccacaagaggccacaccttgccacagcactgtttatctggcctgtttcagaagcaccgtcagagtggcgaaggcaggaggtggtgcacgagagtctacgttctagcatccattcaagtgagggaaaggcgtttcgtacttagaaaaatgcaaaattaatgattctcacccacacatgagactgtggattcacccatgtatgagatagtggattcagagccatgctgtggctctcatctgctgggagccagtagtgtttgtgctttggttttgcttttttagctacatggtttatgtgaggtgcggacttacttgagttgctctgtctttacagggagcttgctttttctctgctggtttgttttcacttttgctgtctctgtttagaagaaaacattagaactggggtgtggtggaaggatgggagcacaatctgggaggggaagacctgctctctctccacataccaggagggagtggcaggaaggggagacactgtgccggactcagggagtcaagagcgtgagcacccccaggcttcaatctgctgaacgttgtgcatctgggggcgcccgtgcagcaggaacactctccccatcacaattcctctgggcacagtggagagccatgagtgggggctgtcctgggggctgcgctatggtgagtgagcccacgccaggagccagttcagcccagcctcattcttctcctgcttctttgctttccaagttctagttcataagcaaccagcacagtacctggaatgtaagaggcgcttggcttataaaagagagaagaaaggaacccctttcaccacgagggacgtcaggcccagctctctgtcccgggcattcatcttttttccggcaattagcttcagctctaatgacctgctgtctgctttatgttgcacctatgatttccagattgtaaagtttgtggcaaatgtattaacgttcacatcccatttacagattagcaaactaaggatctgagaggttatgtgattttcccagtctggcggagggcagggccctgtcagaagccgagacacacctcgtaacagcttgttatttggggcttcccatcagtgaggcaggagtcataatggggccctggcttctgggcaattcccataaaacattgtgccacctgaagatggaagtgtcagaggaaggcgagatgttatttctgaaagcatctaccctcagaaagagacagaggagtgcatcgcagctgtgtgaacccggggtggtggtggttccagcagcggggcacgtggtggacgcaagacggccccgtttgagttttgctgctaggtgacatgtagaacttgaacttcagagggtgctccttggaggccctgatgagagagacacagaagggaagggagactgttcccatggtcctgcctctgcggcagcgagcctgctgctcttgcagctgggtggctgttcggtgcagggggccggtgaggaacacggtggggagcagcctgcgagggcgccgggctttcagcactcactatacctgctgtttggtttggccaggatggcctgggagtccccagggccgggcaaagactgcccccaacagacatgggcggagggaaccgtctcacccctgcctcttctcccttctctacgcagtgtcagtgggacgggagggtggtctgcccggggcttcaagctcctgtccaggaaccggacccatgtcgtacgccagtgcagccacacggccagcttcgaggtgctcatggacgtctccaggtgtgagatgggcatcttcttgtggccactatgcccgctgagcctacccccaaacctgcccctcctcaaactaaatcttccattctaagcgctttgaacgaagcaaatcaaccaattaaaaaaatatattccaggattggccagagtctgtgaagatttccataacaaatccccgttacaagggttttcagagagccctggttgtgcattaaaccccgcgatggcaaacccaaagctcaggctctgaggagctcttggagtctgcccctcgcttcagagatggtctgtgcgagggtgccgctctcctcccgctttgatcataaggaaggtgacagctgctggggacggtaggcactctccctcagggccacaagctgggctgcaggataaaagactgggcggctaatgtttaacctctggcattttaagcggcctgggagtgtgagccggccattgtgggcctgcagatgaactggggagtggcccgagtgctgtcctcggcaggacagtgctatccagccaggaagtgggtggcagccagcctgggagtggcctatgtgggaccctcctgtctaggagtcagagccagaggcctgggtggcctcccctggcccctccccagggctgcgctgtagctcaagggcccaggccaccatccttcccgagggctttctgatgtgaagtggccctggtttctgtcacagtcttggaagggtgagtcagccctggggcagggctggaggagggctgtggcttcctgtacaatgtgcgggggaagctgtcccacctgtgcccccatctcatgggcaaatggcactccccagcaggacccagcctggagaggggttcagtgattagtggactttgttcatagaagggcagggttgggggttgtctcgtggccaggacgccgggcaacatgtgggccaaggaagctgaaattgaggcggaaggaaggaggctggagtgggagtccgaggctcccatggcctgggtgccccaaagttagcggtctctgaacagccctgaaccagtggagggagactggggtgctgctcctggccccagggatgtccagggcccgggcattgaagggacctcagaaggggcagttccaggcccagggctgtgagcactcggcctccccaacccagccaggtcttggcttcccagctcctagttccacatggtaagcaacgccttccagaagttaccagagaaccagagcttgttgttccccaaatgcagaaactccccagggacctgggtcctgggcaagtgtcctggtttgtaaaagcacaggaaacacagcaatgtgaacctacacactgctgaactgtacgcttcaaagtgtccaagatgatatgttttatgtcatgtatattttagcacaattttcctttttttgttttttgacacagttttgctcttttcgcccaggctggagtgcagtggtgaaaccttggctcactgcaacctctgcctcctgtattcaagtgattctcttgtcttagccttccaagcagctgggattacaggctgcaaccaccatgccgagctaatttttggatctttagtagagacggggtctcaccatgttggccaggctggtctcaaactcctgacctcaggtgattgacctgcttcggcctcacaaagtgctgggattacaggtgtgagccactgtgcccagcctgttttttaaagacatgttcactgcctgtaagaaatgcataataaggtggggtgtggtggctcacacttgtaatcccggcactttgggaggccgaggtgggcagatcatttgagctcacaagttcgagaccagcctgggcaacatggcgaaaccctgtctctaccaaaaatacaaaacttagccaggcatggtggtgcatgcctgtagtgccagctacttggcaggctgaggtaggaggatgacttgagcctaggaggcagaggctgcagtgagccaagattgtgcctctgcaacagagccagaccctgtctcaaaaaaaaaaaaagcataataagggatctggaatttaaaaaataggtccatataacaagctataatagagacgtgcagctggcacaggacatccatccactggtgataatgatagaacacgtcatattgcacgatagtaggaaaaacaggacagatgggaagggtgcggatgaccagcgccgtagcaatctgaagcatcgagcctgccagtccacataactgaaacctgaagctctgcccctgcccagctctgtgacttccagcaagttgtttagcttctttaagcattgattttctcacctggaagatgagggttgcattcacactctcttcatagctgtgacctaaggatgatatgaaacgacgcccttggcagatctatcagaacccctaccacataataagtgctcagtaaaaggttttgctgaacaaaggaaattacattcatgttgtattaccacaattacccactttctttataaagcggtagtaagtctttcagccaaaagaataagtccatgatgggattaagtgaaagtccaagaggtactgcatgcacctaaggtggagatgtgtttatcttttgcataagctggggatgtatttggaaggtttctgctagcccagaatttgggtggacaggctgagcccctcccaacagcaggattcacctatggggttggttttgggtagacaggctgagcctgccccatggaactgtaggggcttacgaaggcatttcgtttggggaaggagctcatccaggaggactgggatctctggttatatgtgacttctgacctctgggcatggaggtctctctccagaggcccaggcctggacacgaagggagagaggcctccattgtcccacaggggccgaaatgcagacggtgcatccccggtgccctggggaacccttctctgatcatcaggattctcttggactccggggtccttgtcctgctcaggcatccctgccctgctgtccttcagggccctcaacacgatcttctctggacacgagtctggggatagccgggtgttgtgggctccaaagggttgactccttgctcctgggccccacagagagtccttgtgctcagtgcactggctgtgctgcaagatatcctggaattcgaagcacacagtgctggcttgctgtggtacctgtgcaatcaaattgaaggcaagatcaccaggaaggaacacagggcttgcaagatcacggaaaaccttcttggagttgttttgacacaccactcatgtcaagtgtctgggtacttgtaggatggcccgccactccacccaggggcaggagcaacagggagatcccacaagcaaagtgaactgggggatggggtgagtgggctccaggcaacagagccctactggcaggtcctcaccccctgggccggaactggagtgaggggcacagagtgcccaggtaaccgctcctgggaacagtggggaactgtcagatgctcgaactttcgagagctgggctctgagcgtcctcgtggagctgccaactcggccaaaggagaagcgagcagtttcttctgttgccgggcaacacgccttttaaacctgagcgagtgggtgcgcatgcaaagaacgggcgcgagtgacagagcgaccttaacggattagcaccttaacggattagcaccttaacggattagcgtggcaaggtatgcaagcaagtcacctgctggcaatttgggggtggggagggggaggtgcgcaatacatactggaaggagaggcacccacacaaaggacgcaggaagaacaggtgcgcacaaaggcacaatggcggcagatctgcccgtggatcactgaagattcctgctctcctgctgaggtggagattgcagtgaactaagatcacaccattgcgctagagcccgggcgacagagcaagacttggtctcaaaaaataaataaaataaaataagtacaataaaataacaaaacaaaacaaagtaagaggagatgatatctggtcgtgttttatggccatctggtaagctagattctttcctttggttttattgccaatcaatgattagaaagaagcagtttgctgttggcttgtttttcccctcaactaaatgtaagaaaaaaaaagagtcaaaaataccgaagctaattttaaaatgtatgtatagagagagacttggtcttaccttgtcatccaggctggagtgctgtggtgccatcacggctcagggcagcttcgacctcatgggctcaggcaatcctttcacatcagtcgaccagatagctgagattacaaatgtgggaaaccacaccctgctaatttcttgtattttttgtagagtcggggtttcaccttgttgccgaggctggtcttgaactcctgggctcaagcaatctttctgcttctgcctcccaaagtgttgggattataggcatgagccaccattcccgccgaaatatttttgagattcatagagatgagtaggtcataataagagtgcacaacttgtagttatatttaatatcttttgaaattactcggcacccccattgtaatttaaatgatttgttcctgacctggttttactttgttcctgagggttgcagatcccttgaacaatattccacgaatgaagcagtgataataaacctgcagctgccccgagggggcgctgtgcggaggttcacaaagggacctgggtctccctggtgcggatgcgggggccgcctccattctgctttctgacactgccaccgcggggccaggcttgatgtgaccccatcactgctcagttcactacacagtttcatcttttgatatggaagatttgactccatccacgttccttaggaggttactggaaatgacagcgctgtaaatttctgggtaaatgagcagccaacatttttgggagctgtcacacaaccacactgcccttccctctgcctgaaaacctttaggcctgattgactcggagaaagcccattaaactcagcccccactgacttgttcatttccactcaaacgtttgtgatagtcccaacacaaggcttgtcctccaagggacaacttgtaaacacttctaagagaaagggttgactgggcccggtgcctcacacctgtaatcccggcactttgggaggccgaggtgggcagatcacttgaggtcaagagtttgagaccagtccatgatcttggcttgaagaggcaagaccctatagtttattgaacattttaagcccactccttgatccatgagccgcagaatggatgttgtattagcaaaaatgaaaacaacattaatctccttgtatcatcattagagctcctggctgactggttacattgtcaatcaacagtaatattttgaaaggaacagtgggcttaaaatgttcaatatgctgtcaacagatgtgctgtcatccaggctttgttattccgtttatagagcacaggcagagtagatgtagcgtaactcttaagggccctaggattgtgggactggtgaatgagcactggcttccacttaaagtcaccagctgcttaggccctaatgagagagacagcctgtcctttgaagctttgaagccaggcattgacttctcctctgtagctatgaaagtcctagatgtcatcttttaatagaaggctgttctatccacattgaaaattgtcatttagtgtggccaccttcatcagtgatcttagctagatcttctgggtaacttgctgcagcttctgtatcagcacttgctagcttcgccttgcacttatatgttatggagatggcttctttccttcaatatcgtgagccaacctctgctagcttcaaacttttcttctgcagcttcatcaccaatctcagcattcatagaattgaagacagttagggccttgctgtggattcagctttggcttaagggaatgttgtagctggtttgatcttttattcaaggcaggaaaactttctccatatcagcaataaggctgttttgctatctatcatttgcgtattcactggtgtagcacttttaatttccttcaagaacttttcttctgcattcacaacttggctaactggcctagctttcagccttttggcttttgccgtgcctttctcaattcgcttaagcatttctagattttgatttaaagtgaaagatgtgggagtcttcgttttacttgaatacttagaggccattgtagggttactaattggcctaattttaatattgttatgtctcaaggaatagggaagcccaaggagagggagagagacagaatggctagtcagtggatctttcagaacacacacaactttatagattaagctcactgtcttatatgggcacagttcatggcaccccaaaacaattactatagtagcatcaaagaccactggtaatacatcaccataacagttataataataatgagaaagtttaaaatattgcaagaattaccaaacttgacctagagacattgaagtgagcacatgctattggcaaaatagtactaacagacttgtttgttacagggtagccacaaacccccaatttgtaaaaaacgcagtatctgtgaagcacaagaaggtgaagtacaatctgaggtgtatctgtattttcttccacgttgttaggtgtcttcttataacctaagttttagattttcctagacaataacttaaataattttagaacattataaattacttctcccttgaaggattgcttgtggtcaggagtttgagaccagcctggacaacatagtgagatcttctctctactaaaatttaaaaaaatatatagccaggcatggtggcgatcctcccacctcagcccagctacttggagggctgaagcagggggatgacttgagccaggaagttgaggctgctgtgagccattatcacgccactgcactcctgcctggacaacagagcaagaccctgtctccaaaaaaaaaaattacttcccctttgattatagaactttgtcacatatcaagttgattaaatgaagataattcaagcattaagtaattatttaatgctttttgtgttcttctagtttgagttctatgattctatgatcttaagatatttaccttaatatatagagagacatatatattaattattatataacacaaatcaattatttcaattaataatttgaagtttttttccatttacttggtacttagaatgcagggggaaatatgatataggatggttagtcatacataaggaaaattctttttgtacacttgacagtcttggctacatacccaattctctgcttttttatttcctatggacacttctttgatgatatatatgtatggcttgggggaggcggttggcttttgtttcctgtgagacagatatctaagttccatagatatctgttccttccctttagaagcaaagaggatactggttcttttatttcaagatctgtaagttaaaattggacagtctgaaatgcataatctttttcttttttgagacggagtctcactgtcacccaggctggagtgcaatggtgcaatctcggctcactgcagcctccacctccctcccagtttcaagtgattctcctgcctcagcctccagagtaactgggattacaggtgcctaccatcatgcctggctaatttttgtatttttagtagagacggggtttctccatgttggccaggctggtctcgaactcctgacctcaagtgatccgcctgcctcagcctcccaaagtgctgggattacaggcgtgagccactgcacctggtctgaaatgcataatcttttaaaactgaaagccatttctaatagtgttcttaatttgtcaagaatcgtatgagaagtgccagtgccctttgcctgtctagctataagtggattatcatgcccaccctttggagccagcagttttggttcagtcctttggtctctgactactcacagtctgcaggaaagagcaggttgtgacacttgactagtttatgagagcagaagctgttacgtgacacttagcacatactgctctcagaggccccagatggatcattaatgctcggaacgtgcgtgctttatggagaaaccgcctaatcaacggaggtagattccctaatacccatatcatctttcgttaactctcttaagagtcaccctaaaattactgtgctgacgatcactgtatttcattaagtatccattacaaaacaagcccttatgagtttagcttttatttaacaaatacattgttctcttctaacttgtgccttttatcatccgttgaagctttagaatagtagaatgttcatgctgaaaacgtcttggcattctggtttattatcaggtttacagatctgggactgaaacccgcacaaggataaatggctgcctcaaggctatcttgtgagtccagggcgttatgtaaccagctttcagtactattgctttaagggttgcatcttcctttttttctatttttaaaaaatcagtgcctctgtttatacacaattatgtttttaatttaaatatgcagctaactgtaataatttttaagtgcttatcatgagaaggggtaatcgagttcccatttccttatctctaaaatttcgctgtccagagacaaccatttttaatttttttagctgttgtctttagggattgatggtactagattggtaatacaagaataaccaaccggaatagagaagatgtttatacattcagtaaacttttctttggttttagatttttctgtctatgagctttagttgcgttattgttttcttgctctggaaaaccctaactgaatgcaatcaagatgcctctaaaggttcaattgagagagctttattttgaatgaaaaatctcattgttttttgatgaaatgctagacttagaaatggattggttaaatctgaagaataatgaaaccacttaatctagtataaaatacttttaataaatgaacagaagattttagtgctgcctgaggtcatttaatctcagattgacattgagaatgcagctttattgggggatgtacttcatgaatgtgtgggccacagaagaaaagattggctgtttcttgctggagatgagtggaatcaaaagaattaatgggctggaatggtttagcaggcatatatttatgtgttatgctttgcttgcattctaagctttttttcctaatataaaagttaataatttgtcaactagtaacctctgtgtcaggtagtgtgctgagtgtttaaatagaagttagggaataaaaatagtttctattctcaggaagtttatggactagtcagtaaaaaatacatcagtaattaaaactcagtaaattaaaacttttgtttatggttataacagaatatcagaccaaatctctgatgagactactgtaaaaactgtttaaaatacaaaaacaaatatctttgatggcactggggactaaccaaggcagccaggtcaaatttggcaggagccaaaattgtagagaaaaatcctattgagttgagcccgtatgtacccctgcttttttcccttagggtggtggctaactctacacatggggtggagaccagacaaagcagtggtccagagtttgtttcataaccactgagtagtgggagtaaaacttgaattgagggattctaaggcagccaagatttgagggtccaagatcctaggaaaaagacaacctcaagagtaatgaactcagtcaacatggtggcacatgcctctagtcccagctactcaggaggctgaggcaggaggattgcttgagcctaacagttcaagattacagtgagctttgatcacaccactacactccagcctgggcaacacagtgagaccctatctctttgggaaaatagagagagagaaagagggtagtaaactcaatatttgacttagcttttgctgttaaggtatttttcaaagtcagaaggagaaattcagtagaaagctattacccaagcctaaaaaacgtaagcacagtttttgttctcacaggagtaggttgacaaaaaattagatttcaaggccagccaaagaggaatgacaatgggaaatactccaggccttcggctgagacctcagaagaattatgacctacaaataaaggttgaccagaagttatcagcttgaaatccagcttcaaaactttgattggatcagggtgatcagcccttattctagttacctgccagaagaaacttagcccctatactcttggaacatactatcctgcattccatcaaaataccaggcatggccaggcgcagtggctcatgcctgtaatcctggcactttgggaggccaaggtggtaggattaccggaggccaagagttcaagaccaacctgcccaacatagtgagaccctgtctctataattaattaattaattaaataccaggcatgccaataagcacgatcaagtgaatgaaaatcaagagaaagaatgagtaacagaaagaacttgaggtgatccagatattggaactcttagataggcttttaaaataaccgatttatgagtttaaggaaacagatgaagagatagagagttttaccagagaactggaatctataaaatagaatcaaatgaacattttattttattattttattttattttttattttttgagatggagtttcactcttgtcacccaggctggagtacaatggtgcaatcttggcttgctgcaacctccgcctcccaggttcaagcgattctcctacctcaggctcctgagtagctgggattacaggcacctgccaccaggcccagctaatttttttttttttttgtacttttagtagagacggggtttcgtcatgttggccaggctggtctcgaactcctgacctcaggtgatcctcccaaagtgctgggattataggcgtgagccatggcgcctggccaaatgaaaattttaggactaaaaatacattagcttgagttacaaactcccaagcatgtgtttcacaaccactcaacacggaaaagatttgtgaattagaggactgatcagtaagaaatatctacagtgaagcaccgagaaatgaaaggatgaaaaaaatacagtgtagtggagacacaggacataatagaggggttaagacacatacaattgggttatactaagagaaaagagagggctaggagtgtcataagtgctaaaagtcaaggacagcaaaaaaaatctttaattgctagagaaaaaagatactaggttaagaggaataataagattggcagccgatttctcaatagataacaaaaagaggatttgtcaccagcaggcccattctgaaagaaaaaggaagttctcgtcgcagaaagaaaataataccaaagggaaacaaaatttcaagaaggaataaagaacagtggaagagtaaatatgaaggtaaatatatatgaatattgactgcagtgtaataaaaatgtcttatttaaagatacatgcaggtttaaagtttaagataaaatggttcaaaagttaggagggggcagtaaatataattaaggtgttgcaaggtctttgaattgttcagaaggttaggaaattaatttgtcgtagactctgagtaagtgaagggctgcacattgtaaatctctagtcctacacgctgctacagttgacattcattgcacggagttactgagaactcaaatgtgactattctgaattgagatgtgctgtgattataaataaacaccagattttgaacacttagaagatttcatatagaaaaatagaatgtaaaatgcttcatttaaaaaatactgattacatgttgaaatgatctcttttttttgagacagagtctcgctctgtcacccaggctggagtgcagtggtgcatcacggcaggctccacctcccgggttcacgccattctcctgccccagcctcccaattagctgggactacaggtgcgtgccaccacccccggctaatttttttgtatttttagtagagatggggttccaccgtgttagccaggatggtctcgatctcctgacctcgtgatccacccgccccggcctcccaaagtgctgggattacaggtgtgagccactgcgtctggctgaaatgatcatatttttaatatgtttgattaaataagatacattaatatatatttttaactttttcaatgtggctactataatatttaaaatcacatattgttaacaaagtaataaaagaatggaaaataagaggctaacagaagagaaatggaatattaatacttgattaatccaaaataaggcaggaaaggagagaaaaggaacaaagaactaagggtacagtaatagatgtaaacccaaatatgtaaaaatcacattataggtaaataggctgcatattccagttaaaagacaaagattttcagattaaaaacaatagacccaaccataattttgttcaaaagacccactttaaatagaaagactggaagtaaaagagttggaaaagatgtactatgcgagcactaaccaaaggactgctggaagagctatactaatttcaaagcgtcatttctcagaaagaaatattactagagatagagattgtccgtaatgataaaggattaaaacaattacaatagccaaggcacccttagaaaacaatgtgggaagacttcacgctgcccagtaagactttagaggcacgtagagcacatcataaattcatatgtatctagtaacgcagccccagagaatataaagggaaactgatagaactaaaaggcgaaataggcatatttggaaattttaacacattcctctcattaacgaatagaaaaagcaaatgaaatttagtagagctacagaacatgtaagtaatgctattaactactttgtcctgactgatccataaaacactgcaccagacaacagcaaattgcacattccctttgtgtgtgtgtgtgtgtgtgtgtgtgtgtgtgtgtgtgtgtgtgtgatggagtccctctctgtcacccagactggagggtagtggcgtgatctcgactcaccacaacctctgcctcccggattcaagcgattctcctgcctcagcctcccgagtagctgggattacaggcatgtgccaccatgcttggctaattttgtattttcagtagagacggggtttctccatgctggtcgggctggtctcaaactcccgacctcaggtgatccacccgcctcggcctcccaaagtgctgggattacaggtgtgggccaccgcgcctggcctgcacattccttttaattggccacagtatattcatcagaattggccacatgcactctcaaaaaatttcaatgaattaaaatccttcagagtaagttctcaaagtggagggaaaaatgtgatctaatcaaagtgatgaacaaaagcatttgataaaattcaacacctgtttattagtttccaaaaaaacccccacagaacaaatttctaacaaactgggaataaagggacttttaaaaagatgataaagggtatctacacaaaataatatttatagtggacattaagcctaatggtgacttattgaaagctttcttccagagatgaggaaagagacaagaccctgctctcatcacttctattcagtgttgtatgtaaagctctactgggagactgaggcaggaggatctcttgaggccaagagttcaagactcacctgggcaacatagttagatgcccatctctacaaaaaattaaaaaataaagttctagtcagggcagaaaggcagaaagagagataagaagtataatacttggaaagaaagaaataaaattctatttgcagacatgattatgatgtaggaaatactaacaaagatgcatgtaaaatatgagaattaatagcaagtgaaaaaaatttcaggatctaatttttattagcatttaaaaaataaagtacagtggccaggcacagtggctcacgcctgtaatcccagcactttgggaggccgaggcgggcggatcacaagatcaggagtttgagaccagcctggccaacatagtgaaaccctgtctctactaaaaatacaaaaattagccaggtgtggtggcatgtgcctgtagtcccagctacttgggaggctgaggcagaagaattgcttgaacccaggaggcggacgttgcagtgagctgagactgcaccgttgtactccaaaatgggcgacagagcaagactctgtgtcaaaaataaataaataaataaataaaaattatagccaggctttgctgtgcctgcagcagattagacacagaatgcctcattttaaaagctcataataccaagtgttggcaaggaagcagagaaacaagaacacttgcaccctgctgatagggctctaaactgttctcgccagtttggaaaacattggcactatctgctgaagttgaatagtctccttaagagtcaaaagctggaaacaacccaaataatcatcaagacatgaatggacaaatgaattgtgatatataaggtatacaaaacaagcaaaaaaaaagaacaaactgttgcaacatgcagcagcgtggatgaatctcacacgcataatattgagcagaagcagccagatgcacgggagtctgaactatgattccatttaaatgaagccaaaacagtggtgggaattaatctattataatatgtcagaagagtggttatctttaggggaattgagggaggctttctgggattctgattacattctgtatcttgatttgggggaggtggctacatggtgtattcactttgtgaaaatgcttttagctgtacttatcatttgggtacttcatgtatattatacttcagcaaaaattaataaaaaatatttttggtattttcaggaatgttgttgccccaattatctgtggttctgaggtttttatgtcacatgtttctgatattttactcttcttcatttattccagatgatttattaagatccattagattcattttcttttctatataaaacaaattatttatagtatagtgtattcgttttctgttactattgaaattactacaaatgtagtggctaaaacaacacatagttttcagcttagagttgtgttggttagaagtccagcatggctcttactggactaaaatcaaggtgtcagcagagctgtgttcttttctcaaggctttaggggagaatctgtttccttgccttttccagcttatagaggcagccatgttttttggcttgtggccccttcctccatcttcaaagccaacagctggtcaagttgtcacattgcgtcactctgaccataggttatctgcttttaaggtcttgtgtgatttgattgggtccacctggaccattcaggatcatcttcctgtccttaaaattcttaatcacatctgcaaactctcttgccatgtaagtgaacatgttcagaggttccagagagtaagacatcaatagcttatggggctaccacagataccttatacaattatctcctgaaagttgagtttctaggatttagttgtgttatttttttttataacttgcataccatacaactcaccaagttggacagttcagtggtttttaatgtatgcacagagttgtgtaaccatcatcacaataaattttaggatattctcaccacctcacagccctaggcagccaccatgggtttgcctgtcccagacatttcatgtaacaggaatcatttgtggtcttttgtcactggcatctttcaggtatcattttttttaggttcttccatgaggcatgtgttagtacttcacacctttctatggctgaatgattttttttttttgagacagagtttctctcttgtcacccaggctggagtgcaatggcgcgatctcagctcactgtaacctccgcctcccgggttcaagcgattctcaggcctcagcctcccaagtagctgggattacagacatgcaccaccacacccagttaatttttgtatttttttttttagtagagacagggtttcaccatattggccaggctggtctcgatctcctgtccttgcgatccgcccgcctccacctcccaaagtgctgggattacaggtgtgcaccctgataagtgacaagtgctgattaatttgcatttctctcattatgagttaggttgatcatcattttctgtatttgtgtgtgtgtgtgtgtaaattgattgtgtgattcattcattttgctcattcttctgtctttttttggtctttttcccttcaattttaaaccattttggatgtattagggaccttaagcatttacttgtgagatattgcaaatatactttcccagttttttatgtttttaaattctatttatgatggttttctcgtcatgcaataacattttcactttttttaattaaaaggattttttatttttaagattttaatttttatgtagtcacatcgatcaagtctttgttttacaatttcagatttaaaatcgtagttagaaaaccctggactttatatttgatatggtgtgaaataggtctcagcatttatctttgccccctttgtgtatacacttgacctagcactatttgctggaagactcttgttttctgcattgctgctttggttataaaacatgtgtctataaatatgcagcttcttcagagactgttttactagtttattcttgtgccagtgctgtattgtcttaattattataagtgcaaagtttgtgatttggtgcccttgtgtatatttaactttgtcattacccaaaggcaaattgtaaccagagaagtgtgatgagtaatccacgttgacatgacaatggagggtggttttcaatgtaattattatcaaatgaaagaatatttaacttacggaggaagaaagattagttcaaagacaattttacttttattagcaggatataaaagaagattgaaaatataagaatatgttgagtttatttactggctaatagaggagggacaaattggcaggaaagtggtatgactttcattgtgtgactttttggcatcatagttgatggccagtttttgtgaacagaaacaagtcttaaagaatatgaacaggccaggcgtggtagctcacacctgtaatcccagcagtttgggaggccgaagcaggcggatcgcttgaggccaggagtttgagaccagcctggccaacatggcgataccctatctctactaaaaatacaaaagttagctgggcgtggtggcacacgcctgtagtccagctactcaggaggttgagtcagaagaatcgcttgaacccaggagggggagattgtggtgagccaagatcatgccactgcactccagcctcagtgatagagtgagactttgtctcaaaaaaaaaaaaaaaaagaaagaaagaaaaagaaaaaaggctaagcgcagtggctcatgcctgtaatcccaagcactttgggaggccaaggtgggtgggtcacctgaggtcaggagtttgagaccagactgaccaacatggtgaaaccccatctctactaaaaatacaaaatttagctgggcgtggtggcgcacgcctgtaatcccagctactcaggaggctgaggcaggaaaatagcttgaacctgggaggtggaggttgcagtgagccgagattgtgccactgcacttcagcctgggcgacaagagcgaaactctgtctcaaaaaaaaaaaaaagaatatgaacagtccttgaaattaatgaaattagtgcagtgtctctctctctttttatgtattctagatttcataatgtgacagccctaaatcataaatcaccagagttaaattctgtttaattcattgaaaatattgatccctttttctgcctcttttttttgggggggcaggtggggacagggtctcactctgttgcctaggctggagtacagtggcgtgatcacggctcagtgcagctttgacctccttggctcatgcgatcctctcatttcaaccttcccaatagctgggactacagacatgtgccactttacccagttaaatttttaaattttttgtacagacagattctccttatgttgcccatgatggtgttgaactgggctcaagtgatgcacctcggcctcccaaaatgctaagattacaggcatgagccactgtgcccagccttttctgcctgttcttaacctaatggtactgtattagaactttcataattgaataacagaaatacactccacatggagtcactgacatttagaactggaagagactttagagattagttacttataaactactttgatttgtacaaataaattcagtacaattatctgagagagggcatggttccagataggagatagtgtaaatcggttggctaactcatgccaaagagacaaaacttttgggttcttttgataaaaagtagtttttattttttttccccacagatctttaactcctctgtgttcccttcatttctagaggaagtgaaaacatttcttcactactttttagaataataaatttacagccaatttattatccatagtgttttttaaagctcatattttaaacattgtctttataaaatataaatattgcaaatggtctttatcaagtaatatgatcatttagacagcataacccttgctcaaactgtaaagtctctagttttttattaatatattatgcatgttttagaaaatacctcctttcaatggtgactaaaatttgactactacagaattataaagtaaaaaacataaatttcagaaaaaattctttttttctttttttttttttgtgacagagtctcactctgtcacccaggctggagtgcagtggcgtgatcttggctcactgcaagctccacctcccgggttcatgccattctcctgcctcagcctccctaagagctgggactacaggcacccgccaccacgcccaactaattttttgtatttttagtagagacagggtttcaccatgttagccaggattgtctcgatctccagacctcatgatccacccacctcggcctcccaaactgctgggattacaagtgtgagccaccgcgcccggcccagaataaattcctttagatactggcctcatcatggaatcactttagagcaatgaggattatttgactctcaatgatatttctttctggaaattgcaagatgacacttcctgtggcattataggattttcccaagatatcatgtgctatcccccatcatctgaatctggcatatgtggacacatctcaggcttccataaagtctttgattacatatatgattttattgttttaaaaagaagtacatgatttggccaggcacagtggctcacgcctgtaatcccagcactttgggaggccgaggtggctggatcacaaggtcaggagtttgagaccagcctggccaatatggtgaaaccccgtctccactaaaaaaaaatacaaaaattagctgggtgtggtgatgcatgtctgtagtcccagctacttgggaggctgaggcagaagaatcgcatgaactggggaggcggaggttgcagtgagccgagattgtgccactgcactccagcctgggcaacagagccagactctatatcaaaaaaaaaaaaaaaaaagaagtacgtgattgtttataaacctgtaaagttctatttctgtagcgcagtatggtgtgctgcttactacccgtcagaaagttttggtaatagggctcttgaactcagtataaaagtcatgagctttgttgagtctcaaaatatctaatcttgcttgatctactaaattcgttttcattttctgttgcttctagaccaagagcagtgatgaccttttagctggaatggccagaggggtaacggtgactaatggtgttaaagggaaggaaagctcctgcccatctgcagcaccttcggcatctgcccctgccatgaccactgtggagaacaaatccaagattagcacaggtatgggtgacattcagtctgagacttcaactgcttttttgtttgaataggcaggatgcattggtgtttacagtgttccatctcattataggaaattgtagacatacaaaagtagatggattgatatttcagcccaatacgctcatcacgctcatcaccattatcagctcacagccagttgtaactctgtgatacccaccctcccctcttattattttgaagcagattctggacatcatatcatttcatccataaatattttattatcttggaaagagaaggattcttttaaaaatataatcctaataccattatcagtccttaaaataattgataatcattccttaaatcataccttattcaatgagtatttaaatttctaacagtcttataaatatttttgttttatttactatctatttttatgtttggatcaggactcccataggtccatatataattggctgatgtgtctcttaaatcttcttttttaaatctatgggtttaacccaattcttgcagtttaatttttgtggaagctggtcacgtgacctatagagtttctgagcatgtggatttttatatcacaatatccccatgacgtttttgcccatcaccctttgttgtgtgtatttattgtaaatggcattggagacttatgggacagattcaggtcccctgtccccccaatttgaaaaaaaaaaaaaaaaacaaccaaaacaccatgttgaccaggctgatgtcgaacttctgacctcaggtgatccgcctgccttggcctcccaaagtgctgggattacaggcatgagccaccgcatcatttaaatgtactgaaagtccaggcatggtggttcagagctataaccctagtactttgagaggatgaggcaggcagatcacctgaggtcaggagttcaagaccagcctggccaacatggcaaaatcttgtctctacaaaaaaaaaaaaaaaaaaaaaattagccctgcgtggcggcgcacggctctagtcccagttacttgggaggttggggcatgagaatcctttgaaccccggaggcagaggctgcatgcagtgagttgagatggcaccactgcactccagcctgggcgacagagcaagaccctgtctctaaataagtaaatgttgccggtaatcctagcactttgggaggctgaggcgggtggatcacctgaagtcaggagttcgagaccagcctgactactatggtgaaaccccgtctctactaaaaatacaaaaattagctgggcattatggcatgtgtctgtagtcccagctactcaggaggctgagacaggagaatcgcttgaacccaggacgtggagggtgcagtgagccgagattgagccactgcacttcagcctgggtgacagagtgagactccatctcaaaaaaaattaaataaaataaaaaataaaaataacagctccctaacagctccggaaagataaacagaaaacagaaaatgacatgctcagcccttgaggccaaaatgcccttccccagagcagctgccagaagacagggagcaggatcgggttggaggtcacttctgggtgagggggagaatggtcagacccgtggcaggggtgttggagcctggtcggcctcactggaacagaagagagctgcttcatgatgctcaactgacaggcagagcctcgcataacccaagttctcatggttcagagaggccagccagtgcggggacaaagacaggcacgcactgaaatggtttcctggaagacggcccggttgcatctctcaaacgggaccagattggaagggagaccagctgctttgggcaaccgaggctgcttctgggtgaactcccaaactagatggtgccgagagccctggacctggcagctgggctggacatcacatggctctgtattccaggaaacggcatctcagtgcttgtctggccagttctccaaaagaaccatccacaggccatttttccattcccttcctatgcacagactgggctgggcctgatcagaaaactctcccttagggttttcagtcactggcgaaacttgagcccggcactgaggataggatgttaaaatgtgactctgggccaggcggcggctcatgcttgtcaacccagtgcttttgggaggctgagctgggagggtcacttgaggtcagcagttcaagaccaacctgaggaaaatagatctctacaaaaaaataaaaataaaaattagccagctctggtgacatgcacctgtagtcccagctacttgaaaggctgaggtggcttgagcccatgagttcaaagctacagctatgatggtgtcactgcactccagcatgaaaaacagagtgagaccatgtcttgaaaaaaggaacaaactaggcatagaagaaacatacctgaaaatggccaggcccagtggctcatgcgtgtaatcccagcactttgggaggctgaggtgagtggatcacctgaggtcaggagttcgagaccggcctggccaacatggtgaaaccccatctctaccaaaagtacaaaaattagccgggcgtggtggcgggcgcctcccagctactccggaggctgaggcaggagaatcacttgaacctgggaggcagagtttgctgtgagctgagattgcaccattgcactacagcctgggtgacaagagccagaatccatctcaaaaaaaaaaacctagaaataataaaagctgtatacgacaaagccatagctaacctactacagaatggggaaaagtgaaaagcgtttcctctgtaaacaggaacaagacgaggatgcccgttctcaccacttttattagacatcacacaaatatgcaagagaaaaaaataaaagccacccacactggaaaagaggacatcaaattatccttgtctgatgaagatgtgatcttggatttacaaacatgtaaagcctccaccagaaaactctagacttgataaataaattaatacagtcatttgcaggatacaaaatcaacatacaaaaatcagcagcattttatacaccaataatggtctaggaaagaaattaaggaggcaatcccatttacaatagcaacaaaatgaaaaatgatatgccacagaggaaattttaccaaggaggtgaacgatttctacaaggaaaactacaaaacactgatgacaaagtttaagaggacggaaagaaatggacagtcatttcatgctcatggaaggaattcatagcattaaaatgaccacactgcccagagcagtctagagattcaatacaacccctaccaaaataccagtgtcatctctcacagaactggaaaatcgtaaaactcatatgaaaccaaaaaagagctcaaagagccaaagtcatcctcagcaaaaacaacaaaactagaagcaccccatttcactgcaaattagaatgacaaaatttttgacaagtgcatggtaaccaaaacagcatggtcctagcataaaactagacacatagatcaatgggacggatgacagagcccagaaagacagccacatagtcttggggcttgtgtctctcctgctgtgcatccatgctgggtgctttacatacaacaggcagacaagaagtccctgttgcaagtgaggacaaagtgtgggaaggccgtgagggtctgcagtcccagatggccttggcctcaccccgcagtgcgcttttgcaccagagtgccaccttcttctccaggtccaggtcttcagcagtgaccccagaccccagctgtaagggaggtggcagcatcagaggctccccttgcctgagtggcagcagaggaaacttgcatctatggggcctagaggcctgggatgtgggggagccattcctgggggcaagtgtctgccctggtgctgcatctgctgccttttcacactgggtgagaccccaagagacagcctgaggccggtcctcactcactgtctttgaggacctgaggggcagctgacagtgggatgaggctggccccctcctctttggtgacaggaagcctcccatggaactgtaggagctcacgatggcattttgtttggtgcacgaactcatccaggaggtctgggatctctggttttatccgacttctgacctctgggcatggaggtctctctgcagaggcccaggcctgggcacgaagggagagaggcctccattgtcccacaggggcctaaatgcagactgtgcatccccggtgccctcaggaacccttctctgatcatcaggattctcttggactctggggtccttgtcctgctcaggcatccctgcccccctcttcaggagggccctcaacacgatcttctctggacaggagtctggggcacaactggatgttgtgggccccaaaggggtgactccctgctcctgggccccacagagagtccttgtgctcagtgcactggctgagctgcaagacatcctggaattgggagcacacagcaccggcttgctgtggtacctgtgcattcaaattgaaggcaggatcgccagcaaggaacacagggcttgcaggatcacagaaaacccttggagttgttttgacacaccactgatgccaagtgtctgggtacttgtaggatggccctgccattccatccaggggcagtggcaacagggagattccacaaacaaagtgaactgggggatgggatgagcaggctccaggcaactgagccctactggcaggcccttggcccccggggccgggacaggggtgacagacacagagtgcccaggtaaccactcctgggagcagtggggaaccgtcggatgcttcaactcttgagagctgggctctaagcatccgccttagctgccaacttggccaaaggctatgcgagcagtttcccgttgacgggcaatgcatctttccaacctgagcgagtgggtgtgtgtgcaaagatggtgcgagtcacggatctgcgcaggaagggtgactttaagggattagcatggccaggtatgcacacaaggcacctgctggcaatgccttggtggggagcgggcagtgcacacaagaggtactggagggagaggcgcgcgggaagaacaggcgcgcacaatggctgcagatccacctgtggatcgctgaagattcctgctgagggttgaggctgctgggctggaggactgtatggtccatgcattgtaatgtccccttctctccctggcccggagccccaagagctatccggactctctccaagacctggttctggcccagcaaagaggtctcggcaggggagcaggattcccggcccagcagctggctcaggaggtgacagctttgggattcgcatctgagcatcctcctactcttctcctgggaactctgttggggagggttgctcagaacagaagtgcctgggacgcccagatcctgctggagtggcagctggggtgatggccagggcaggctgggagggacatactttccataggacccagtgctttcatctccgtgcaactgaccaagagaaaccaaacccaaactccttcctttacacagacctatttgagggaggctgggtattgtttgtgtatttcaacctaacaagattttgagatagttggaatgcagaaggagacaggaggactcaagtgtcctgtcttttgcaaaaatgtcaaacgtagctactcagtctcttttttgtttttttgtttgttttgaagactatggttattttgcaaaatatatattatttgagtttctctaggtgctatttttagataaattaatatacttttttcatcagcacatgaaacgttcttcaaaacagatcctttgttagtccacaaaagctgtccctacacattttaggaaatcataatcataatcattccaaagatcagacaacagaggaataaacctagaaatggacatcaaggcaaactacagaacctatacgcatacatgaaaattaaaccccaccctcctgaatgagcactgattcaatgaagaaattaaaatgaaaatccgaaaatgttttcaaacaaatgaaaatggaaacatcatataccaaaagcctttggattcagcaaaatcagtgctgtgagggaaggttgtagcaataaatacctacatccaaaaagtagaaagatgaaaaattaataaacttatgatgcaccttaaagaactagaaaagcaagaacaaagcaaaaccaaaattagcccatgaaaaaaataataaagatcagaggagaactaaataaaatagggtctcaaaaacaacacagaaatcaagaaaaggaattactggttcttagcaagaaaaacacactttgggtatttcctttttttttttttttttttttttgagaaagcttttttttttgagaaagcgttttgctcttgttgcccaggctggagtgcagtggcaagatctccactcaatgcaagctccaccttccaggttcaagtgattctccttcctcagtctcctgagtagctgggttacaggtgctaaccaccatgcccagctaatttttgtatttttagtagagacggggtttcaccatgttggtcaggctagtctcaaactcctgacctcgtgatctgcccgtgtcgtctcccaaagtgctgggattataggtgtgagccaccgtgcctggcctcaaaatattcttttgagggactcttgcatacaagccccaagaggcaggtgcaaaaatgtccatagaaacacagtaatagaaaaaaagaaaatccagactgattcaaatgtccattaacaggagaatgaataaattagttggaatcttcttttcttttcttttcttttcttttttttttttttgagacggagtttcgctcttgttgcccaggctggagtgcaatggcacaatctcagtttgtggcaacctccgcctccggggttcaagccattctcctgcctcagcttcctgagcagcagggattacaggcatgcgccaccacacctggctaattttgtatttttagtagagacggggtttctccgtgtttgtcaggctggtctcaaactccggacctcaggtgatccgcccgcctcggcctcccaaagtgctgggattacaggcgtgagccaccactcctggccattagttggagtcttcttatacagtggtgagactgaatcagccacagttgcacaacagaatggatgaagcttagaagtaatgttgggtttaaatggccagtcccaggctgttacatttaccatttgcaataacaataggaactaaggtaactgaagaatctaacaaaaactatgcaagacctgtatagaaaaattataaaacttgattgaaagacatttaaaaaatctaaataagagagataatacataatctactctttgtggattgggagattcagtattataaagttgtcgattctccccaaattgttctacagatttaatgcaaatccagtaaaaaattcaacaagaggctgggcgcggtggctcaagcctgtaatcccagcactttgggaggctgaggcaggcagatcacaaggtcaggagatcgagaccatcctggctaacatggtgaaatcccgtctctactaaaaaaaaaaaaaaaaaaaaaaatgagccaggcgtggtggcgggtgcctgtagtcccagctactcaggaggctgaggcagggaatggtgtcaacccaggaggcagagcttgcagtgagccgagatcgagacactgcactccagcctgggcgacagagcgagactctgtctcaaaaaaaaaaaaaaattcagcaaggggtgtgtgtgtgtgcctgtgtgtgtgtgtgtgtgtgtgtgtatgcaagccatagacagaatactttttttttctttttgagacagagtctcactctgtcgcccaggctggagtgcagtggctcgatcttggctcactgcaacctccgcctcccaggttcaagtgattctcctgtccctgcctcctgtgtagctgggattacaggtgtgcaccaccacatctggctaatttttgtatttttagtagacacagggtctcaccatgttggccaggctagtctccaactcctggccgcaagtaatctgcccacttcagcctcccaaagtgttgggattataggcgtgagccaccgagcccagctagtacacagaataccattttttacttaagtatattaatctagaagagttttttttaaaatacagtataccatttttatctataacacttaaagacaatcaaagccaaattatgctgtttcaagataccatatacttagaaaaacatctataaaaagcaagagaaacatacaaatcaggcccatctggagagaagggagtgaagcattgcgctgatacggggataaatatgctggttgggtagacaggcagtccttatgcttttggctgacgtagatgttacgtactatttcatgtgttatcacactctccagtaaacacgtaacataagagaataattaaccactatcaagcgttctcatcttgagacaggaagatgtagaggaaagaccttgatgtgtgtgtcagttacaaggatgtacaccagtgactgacatgacttggtgcaaatcttgggtagagacctatacttaagctcctcacccccacctgccgaggcgtaagggctcagagggggttccatggggtgggcgggagtggtaagggtcgaggtgcagccacagcctggctctgtgcacaccccctccctccccctggtcccatgtgcacaccctctccctgccccctgccccttgtgcacaccctctgtaccccccttcccgccccagcctgtgtttgcagtgctacagggtggctgcagcctttgcctcccacagctcctcaaggtcagagggctgggaacccctgggatgtggctgggatgaggaccctgcccctcctcaggcatttccaggcaaggggcacagagacacagccagcccagcagctgagcccctcctatcaggccaggtgggaaactgaagcatgaacacaaccccagactggaaataaaaagccgtcatgtactgtgtgcctactgaatgccaagccctatgccctattctttaatgtcatctttaatgagatgtcttcactcagttcaccacatgatagtagacaggtatttatgatgcgcctactgcatgctgggcacttttctgggccatgaggactcagggaggtccctgctctggtagaagtcaaacccgacaggagacagagactaggggcccacacaccaggaggaagaacccagtgcagagagtgccagcaggaagccacaggggcagggaaggcgctcctgggagggtgggtggctgcgtcctgaggctgagcagggggagctggcctcgggacaggatgtgcgcaggcgtggagcaggaagttcctggaatgatgggcaagagggagcaggtcactgggggcaggtctaaatactgggggctgcattgggatagcagaggcctcggacaggcccgctcagcatgtagactcccctccctggccccttccctaggatgacagtggaggtccatccccaggtggtggtgagggcaatcctgacacagagaccccagcccagctggcaggggaaggggagcccccaaggacccctgtatgttggggcgtgtcccgccaggcggccctccatggtgcccagcagcagccctgcttgcggaccctctttagtccccactgttaaaaaaataattcagtgaaaattgacactagctgggcatggtggtaggtgcctataatcccagctactcgggaggctgagacgggagaatcgcttgaaccagggagtcgggaggttgcagtgagccgagatggcgccactgcactccagcctgggtgacagagtgagactccgtctcaaaaaaaaaaaaaagaaaaaaggaaaaatgacacttgccaaagcgctgtagggaagactgtccaggaccgtgtcactaggcataagggaccacggtgatgagattctgcagtgggtaagagactgggctcagcctcgaatacagcatgggcaagtgggatcggaccgtcaaggagcagggggaagactatccaggaccgtgtcactaggcataagggaccacggcgatgagattctgcagtgggtaagagactgggctcagcctcgaagacagcatgggcaagtgcgatcggacagtcaaggagcagggtggggggcagcgcatggaaagtgactaagaggaagcatcagcagccagggattctggcttaactcccctaacagaattcttgctgaaggccggccaggatggccagaccgcacctgggggacagagggggaacccgatcagatgtcaaggacggggggcttctcgctaaactgactttgcaggattcttgctaaaactagagtttataaggaagtgctcagatgtgcctaggagaaggctcaggagcctaaataaagcttgaccaagcagagaatctttgtcaccagctgtggtgagagtgaggcccagagtgggtcagggcttacctgctcaggttgtgcaattgggaggggtccatcaggagcccggagtcttcccactgggggctgagtctgggccctcagggcacatataggtagatgctgtcagacccgacaccccatgcagtgcagactgggatgctggtgcctgtggcacagactggtcagacccaccccaggctagacattccttgcagggagagctgaggctgctgacaccaggaacagacaaacaaggtcatcaccaggtaatgagcttgttacccacatcaggcaaggccattgctgggtaatgagttggcctcctgcagagccacctgcgctgggatggttcccagagatctggctagccagtgccacaggaggccggggcacagttccagggcctagtgggcaaggcaggggtattcagggacaaggtgcacctgagtccccacaggaagccccagaccctgcagtaagacctggaacaagtcattctcctctctaagctctcaaagaagaggtcagctcaggggtctgggaggcaaggtctcctagagtagactaagctggccgctgccatgctaacacacaccctcccagccagccgctggtcctgacagatgaggaaactgaggctaggtgttttcatgaggcctctgaacccagaacccagtacccagtgtcctgagcaaagcccaagccagacctgccagcttatgtgtacagaggccccactatgcagcctgcactcctggggcctaaaaggaccatcacctccccttctaagaggctgggcacaggggctgggtcccagccaggccacccttcctcctcctccaaaggcccagcagcagctgctcccagagcaagcagcacagtcgcagcaaaggctggacaagtgtcctgtgctctgtggtctgagcagagggccaggggccgtgacccacatggcccctccaggagcagctccaagatgagccttcctgtccccaccagtgtgtccgggacctcagggtggatcagccgcacctgccggctgctcctgttccttgctcttcctggggctccccaccacctttgggaggcagctccaagaccctgctgcctcccttgcttaccctcaggcccctgctgggtgtgccccctccccacacagacccctgagccagcttcgaggactctgcctgcatctccacgtccactctgatgactgtgaagctacagtcacactctccgcctccacccccgccctgccgggtccctgcagcagctctcagaggcccccacagcccctcccacacacagagctcgcctggccctgccgtctgagcgctcccctggctcccaaccgcccttgggctctgggacataaaacctccagccaaggtggctgccaagttttatttaatagccatagagcacaaaagggatgacaattaagtcacacggagagactgccccatcgggacccctggccaagctaagcagaggagccctggggtttcctctgaccccccactgtgaatgcattactgacgggcaaggtggccagttgcccacccagcctgcacgtctgcatgcacagagctacagcctgggcccagggacagccccgggagccggtggcttcccacaggcacagccagcctccccacccccaccatgcctggcccccggcccagggcacactgaggggaacaggaggggaaggagcaggccctgcactggagcctcagtcagctcctctgtgccaggggcagctggagctggctgaatttgaggaacttcccggaggaactggagagcagacctgtgtgcgcgccccgctctgccacgttccctgagggacacactgctttgaccagcccccaccccatctcctctccgccagtccccggtgtccaccccagccccgctaccgatgaagctcaagccagggtccccatcacctgcttcacggccatccctgcacttgagctcaggggctcagggttgtgctgacacgcctgcctgtccacccctcaccgacacctctgcagtcctcctcagggcccaacaggacccccaggaccccgctcccattctgcccttgctcctgccaacctgtcttctctatgcccatgactttggaaccctctgccacaagtgccagcccccacatctgtagcccctgcaggaacaagccctaatctggactcattgcaatggctcagcttctcttccaacctgtccataaacctccaggcagagatcacaaaactaacagctctttctgcaaatctggactctctcctgcaccttcttcaccgtccaggcctccctgtcatccgtcctggggacctcagagatctcttcatttcacaggtgaagacttggctcagagagggcagagcccctgggtcacacagcccgtctccagtagggctggggaaaagaacccagggcgctcttgttggcagtgttttaatgactggggggagggagagaatggctaatgaggctctagggatcagcacagccagctgctggaggtcccagaggacgggtgactcagcaggaatgggggagtctgaggggttgacagagtgcccaattctcacctcctcctgcaccttccagagagacgggctgcagggagtgattgagtggatgaacatgactagagggacccagtcttctcctcagcagctgcttgaggacagtattagcggtcccctcaatcccccccccaacacatgcacacatgcactgacctgcaggggccagatcccggtggacccggggacacagcttccaggggctgtcttgccatgtcccttcccagatctgcctggattcatgccaggccaccctccacaatttgctgagggaggccccagagtccagggcacccagagtgctaactagcccctgggggtacagggagaacagcatgctgtgtgggggatactactctctgcccatacctagggccctgtggcggccacaggcagcactgcttatgcagaggcactggggtgagaaggagtagggtgcagtagtgagggctccacagagggtggaagggctgcaggggaaggcagaccagcagggatgccatgagggcctcagatgccaggctgcagaggtggacgggctggccagctcctctccccagcctcctactgtaaaatgggagaggatcccagccctgctgattcatccactcactccatggcaagacagccactgacagctctgtcctggggcccacccgggcctggcctctgtgcaggctagcactcagtatgcttagtgccacactcggcccaggagaaatgacccagccctgggctcagagaccccacagtgggtggatggaaaacagtcatttaaatacaactgtgaagggtgctgtggaggaggggctcgaggtccccagtgtgggatggggtggtcatggaacgtttccctatctaagtgggaaaagtgagagccaccaggaaaatggcgggggtggggggggagaggaattatgcaaagacccagaaggatgaagaagactgttggattagaggaggttaaagacacagacaggcttggacatggtggctcatgcctgtaatcccagcactttgggaggccaagacaggaggatcacttgaggccaggagttcaagaccaacctgggaaacacagtgagaccctatctctacaaaaaaaaaaaaaattaaaaaaaattagccgggcatggtggtgcacagttgtagtcccatctactcaggagactgaggtgggaggatcgcttgagcccaggaggtggaggctgcagtgagctatgattgcaccactgcactccagcctgggcaacacagcaagatcctgtttgtaaaaacaaaacaaaacaaaacaaaaaacccagcttgagatggccagggatttccagaggccctaggcagaccgccttggagagtaagggagaccctgaagagctcccatggaagggccagcagcctggggctggagatgccacctggatggattcctccagctgtgtggactaggggacagggtgaggagataatggcctggactacatggaaggacgtcgccctgagccattgaaaagggctgtggggtccatgaccactcctggctttcccttgactatgatggagacagtagcttccagtgtaaaatgtgagctcagttcctgactcgtgtctagcgggtggtgcctggtctttggctggcgatgctccatgtcacctatgcccagaaactgggccatgccctttgtgaggacctgcccacaacgtcgtcgttcccgcagggtcccctgggaaccgggctgcccgagacccggccctgccggggttccctgcgccccagaccggaacccccagggctttggtcgttcccacagccgtcccgcgggccccctccacggtgcgtcgcctgggccccagcggtcgctaggctgcagcctggggctcccggccatcccgggcgctggcggcggtggaggcagcagggcggatggcggagcccggccgcccgtgggcccaggcgcgtagtgcgtacagagccagcgaggtgctgcggcgcggcacgggccgccggcgggatccggggccgcaatccaatgggccgggccaggaagacgcccgagccccgggccggatggctcgcctgcgcggccagctccgggccgaagcggcttcgcggtccgaggtgccgcggctgctgaagctggtggagcgtgcgggggccggggcggccgggcgcgggcgagaggaccggcgcgcacagccgcgggctccgtgtgctcggtatgcggggagccccgcggcggggccacctacccggcgggggtcctggaggtgagcgagcggcggctgcaggagggcctggcggcagtgcgcgaggagctgggcgccgggattgaggcgctgcgcgcggagcttcgagcggagctggatgccctgcgcgcgctgctgccgccgccgccgtccccgcctgcccgccgcgagccccgcgccgtcccccgcgccgcgccccgcggcccgaccctgccgcggacgctcggcaccgtgagcgccctggtcgccgcctccaggcccgcagacgacgccccggacggcccagcagaatgcggagcgcaccgagccccggccaggaagaaccacaagaagatgccagtgccgcctggggccccgcaaggtggcggggactgagggcggccgcacaagggcagcctaggcgaggtgcggaaggcgtcgcgctggctactctggtacccccaggacggggcaagtgagcagatcggtccccctcgtggagcgtggctctgagtcaaaagggtgcccgggtgccgccagttagggctccggtactggaaggagggggtgggccacgtgcgtctagggagtgcagctggcagccggggtccttgccagagactgagtccggctagagaacagggtggagcccctttggaccttagagctgggcctttgggccttgggtctgggtgggcctttgggccttgggtctgggtcagcctttgggccagggctgggtcagcctccagggaacagccgagactcctcttccttggggtgactgcaggttctttttcttgcaaggtctcagtgaggaggcagggtctccacgcactggaatagtgtcaaaccacacacaagagcacagaacccagggacacagggcggctgagacactcagctggtgatggtcctcaggatggtgtcaaccagtatgtaatcacattccacagggcaccaactggacagaggcctccggtcagcctcactctgactgcaaccccctctcactggacagcatcacctggacacagagcctcacctagtctgtgtcccatggacacaactttgctttggacagtgacaccaagaatactcacccctttacttagccagaccacaggcagccacctggacacaaacatctctccagagtcagcctccacacagactccacagcagaactcccagggaggcactggggcatggcttcagagcaccaggcagcgctccgcggtgcctagcacccgctcagccagggcagcctgcagcggagcttggagccagcagcttctcatctcttggcctcgggaaatgtagctggagtcatcatttagcagagcacggtgtccctgggttggccacccagcttagttttaaaataaaataatgtaatcttggcctaatggtggaatttctgactgctagatgttctccttccatctgaccaggggattcagacacaatgtataggatgagggtgggggcccttctccctctgagaggaacctggagaggcccgggttctgctgaggtaggagagggtcactcagagggctcccacggaacagacaggcacactgaggcctcagtgggattagggcaggaaatgcccctcttgcaatgggggaccacgccgggtcacgcacccaccccctccaggctacattaggctaaggtcactctgtgcattatttcattatttcacatggagggtcgcccacggttgacagaaccacaggctgagccccaggcccatcagagcgcagtgcacaactgctagggtgggggaagagcagggggctgctgcggggaccgaggctctcggagaggccaagactgcgtgccccttaagaggctgctgtgggccgggcacggtggctcaagcctgtaatcccagcactttgggagtccgaggcaggcggatcaggaggtcaggagatcgagaccatcctggccaacacggtgaaaccccgtctctactaaaaatacaaaaaattagccgggcctggtggcgggcacctgtagtcccagctattcaggaggctgcggcaggagaatggcatgaacctgggaggcagagcttgcagtgagctgagattccaccactgcactccagcctgggcgacagagtgagcctccgtctcaaaaaaaaaaaaaaaaaaaagaggctgctgggggcggaagttacccgtgagcggtatggggtgaaagtgggagggtccagcctggggcagggtgtagaacagggtcatctgagggtgcagggcaaagagatcaaaacggggtgggagaggggcagcgcctgcgggaggagccaggcaaggcccggggaggggtgtggggggcgaggggggacggtggctccacctgcacccaccggatgggtatggggtcctcgaagacggtccagagcaccgtgggctcgcagtcaggcggggtcagcgacccagcgaagcgacagtagctcgaggtgttgggccgcatcgacgccagcgggaaggtggacatcagattcactgagagccccgggcggcagagggagggggattggaaccagcctccctgtgccctgctggtgccatccccagcaaaccccccgcccctgagccggaaaacgacccggtggctcctcacctggctcaggcaccttcctcaagcccgacactatggcgcagaagttggtgttgctacagtcctgctcctgggaggggctccaagtgcgaggggttctgagtgagggagtctctgaagagggaactcagctggggtactctaagcaggaggctcccagtggcaggaggcatctggcatctgggaaatggggtggagggttctcgccgccactggccctgccgattcaggcattcccaccgccccatcctcccacagatcctatagaccctagagatccccccacggactccacaggcctggcctgtccacttccaggatccccatggaccccttttttggaaacatacatagaatcacagccctgccttcaccgccagcagcacctccagcagcagggcctgcactcgagcccatcaccgtggcgtggtgcctcctccatgctctggtactttgtgttactgtggaccacgtgcatctggggggaggcacagatgtgggagatacccagctgccctcaccttgctctctctcacctccgtgggagcactccggccaccccaccttgttcccgagtctacctccatagcctggcgctgcctgtccaggctgtgctccgagtctgctcgcctcgggcccccccaccgccggcagttgaagtgcagctgcagtgcgcggtagacaggcaacagcagcccagcctcccaaatctccaggtggttctgaggatcagtgtccattcagagtagcaatgaaggggaggaggcacacgacaccctctctacctcaccacctgtccatcttgtgccattagggcacagggtatgagcagaggcccttcctcaggccaggtttctccccagtgcggccccattgcctccatggaatggaacccatggtgtccatggctcctgctggtcagcagagcagagctccacagactgcaggggaaacccttcccccccccacacccagcatggcatggaagagggcagagggcagccctcctggtgtggggctctaagcccagctgtgtgtggtcagggatcctggccctgccagagaccctgactcctggtcctcaggggccatggctggttgtgatttgtaaggtgggacctggcacctacacagagggtgcatctggactgctgtgtgaggatgctcctttcctctgaagctagcccctgtggagggtttttggccctgtaggttgtctcagctcccgtgtgtagggggtcctggtccctgtgtacacgcaggagctctcatgccctgtgtggggctcctgcctctgcctaggaggggtcctgaccacagggtgctgacttgtgtggctgtcattctccagggtccaagggcctggaggtgctgagtcatagcctcggaagatgaagggccctagggtagagttccgccggaccctgtgaaagtcaatgttgatgagggactggcctgggcccccacaggcagggggccagcttcttccagtgggtggggactgctggaacaaggactggggcctttggggtggggggggggtcagggaggcagcctgggggtgcagcagagagtggcccccatacacccagaggatagcccagcctcaggaaacctagctccctgcttcccccacacctgaacaggtcacagcaccccccttctcttgtaccctgcatctgacctatccatctagtctcccagttggctgccccatggtgagatgaaggtggaagggtctccggcacacagttgcacacccacactgggacctctatcacctgcacacacttgggctggccacagtaacgggcacaccagccttgactgactcgggaccggcaatcacagcaggcccagactcacacacagggggacagtcacgcacttgcacctgatgcccagtcagtctactggggcagacgactacagacagaaacctgcaaaggccacagagtgcagggtgcagactgtctcttggccactcttgcaccactggcacatgctctggtggtcccaggacacagactgatctgacacagcctcacatgacactctgtcctcaccatacttgaggtcctgggagtcatagcaccaggcacctatagagacagtgggcaggaggctgagctgagaggccagtcatctgggccctctccaagccccatcccatcagctggggtccaagaatgaagtaggtcaggggtttaggccaggggaggccagtgaagaaccttctctcctgtcacccctacctcagtattttctctccccagtccctccccactcccagtggcaagacctaaggggtggtggagcatggcaagagggtagattggaggccagacaggaagagtcctggtgctcactctcagagtctgcgccacaccagctgcaccgcaaggcgagcatgatgccaggggcgtgcgtggctcagtggcagccgcagctaggaaggactagaaagtggctagaccacgcagccaggatgctggcctggctactacatatttattcattagctagctgggctaggggcgtggctactgaggagaggatgggaggggtcggtgcccaggcagggccaccaggaagagcgcgagcgctccaaactcacccaggtgtgctctggtcccagggctgcactgatgccagcaacaatcgctgaggttaatcctgcaggggaggggtgacctattattatccccacttacagtccaggaaacagaggctggggaccagaatgacacaccaaagccaccagcaagaaaggtcaaatagtgagggcaccttggaccccagtgcccatgactttcggggcaaggatgggaggaaggtgtaggatgtctcttgccccactgtgggcccggaactgccaccccatcccaagaccacagcctccctcctacccaggcccccctgcggatccaggccaagacggagccctgcaggaggtcagaggaggggacttctttgcaccctgcgcctctttccaatcgccagagggcagggccctacccacattggggatgggaagacagcccctacccagaggcagggctcggggctctgtccagagtgctgacagtgacctgtgtgctcgggactcaacaccaccactccactcctgccccagcagatgggataaaaaatgaggggccacatcctcgaggctcccatccctgccaagggacttaccagttcctttcctaaccctgactcctctcgtgtccggccgcaggacgtccccccagtatacacatctggagtgcccccagagcagggcatgcaatcacacttcctgggcccactaccctctgagacctagagatggcactgctggacatgagtgaagaggccccagaggacctaggctactttgtaacattaggtggcttggactggagggaggggctgtttccagccacccggatgatgaggggagcttagaggaaatggcgctgacggccaggttccaagccctgccctaccaccccgtcccatgctagctcccagatggtgtcaagcagccttgcctttatgtggatcctgtgcacgtcagcaacacctgccaaggcagcagccgatgccccaagcagggctgggtgctgcaggatagctgtaggcagctcagggctgctgctctccctgcacactccacctaggggctccaggctcagctctgcctggtcctcagggggtttgatggacgcctgcaagggctgcaaaccctaggtgcattctgctgaaaggtgggtacccagcctcttccaccttagcctgtggcagccgtgggggccacaccaaggactaaccatgcctcttccggaacacaagtttatttggcatttggatgaaatgattctcacagcatcttaagaaaagttagtgtcaacccaaccaaaaactaaaaacccttaatgaaaacataaaaaaacaggcatcaagacaatgtacagtatcaaatcccacctccgcatggcaggtcagagggcacctgggctctgagaaaccgtggcaagctggtcctagaggaggaggacccctggagcacaaggttcagcaagggtgaccccgggacttgctggtcagactggggactgcagcaggccttgcaaagggggcattctggatggtggtgcaagaacagatgagcgagtccagctctcctcatgctcccaagggcctcctggagccacagtggcagcggtgttccaggcagccctgccatgtggaccttctgcctggcccaacgtgccagtggcctgagtgcttgtggaggcccatggggaaggggccacccagcaaccccggccagcccaaggcccaccctctgcagcctgcatggtccactttaccccgtttcctcactgccccctacgtgtctgaccggcccctaatgttcctctggtccccaaaggaagcgtcccagtcccacacatctcgtgccagccaccctgtcccgcacacacagttctgaggcctggcaggaatcctctgagctctcaggctcaggcccgtgggggactctgctgcgtggtcctcgggccctcactggccacctggcacccataatgcacatgcctgctgctctggaacctggctgccctgccccagtgcatgtgggatccacggcatgcttcctgcttcgtcctctgcagccagtaggggactcctgtggccaggacttccttgttaagtagcagcccttctccaaggggagcacaagcctgcccgcacacagcctccagcatcatgctccagcaggccaagctcagggacaggcaattcagtaacaaaactcacagctctggacagttctggcacaaaggtcaagtctgtctgtgggcaactcaagattctcattccacatgggatggaaaaaatgggtctccagccacagtgtgagaatgtgtcaagaagtggactgtgcatggagtccatccccgagcagcaccacagaactgcatgcttcagacaggcctcccaggtgctgccccgctggtctggaaagactgagcgagacagcactgcctcagcacagcccaggatgcatcgatgaccctggaagagtgggcccccagtgacccgtgaagttccatgtgccaccctcacctgcagacgcttggccacatacacacacagagacacaaacatacaaaggaaagatccagacattcaacgtagaaaagatatggatgtgctaaaaatcgcacagaacccgcttaatctccaaacctcagaaatgttaaaggccctgtgtcaggcaacaaaaccactgcccaggagcaggcaacagggtccgtcaggcaaaagggtgccaggaagggcccccagcccctgcgctgctgaggaggggccgggaggtgtgcatgcggccgctgggcactgagctgcagtagtggcggtgatgtaaggagtggactttaaggagatagatgcagcccaggatggtggtttcagccacccctcctgcaatgaagcaaccctttatggcacaaatggggccgggggcaggcccaggggcaattcaacaggaggcaagagcccagggctccagagtggagagacaggaggcagctcagtccccagaccccagcagagcatctggggcctcggccccactccagagcttcttcctgagggagccatgcacagcaatgctgggagagggactgatggggtggggtcaggcctcctgccacagagctgggctgcagagcccagatggaaagacacagtgaagagctcaacctccttccaagctctccttctcagggcttcaggttccagagccccaggggagctcccagccaggggcagggtcaccttgatattcacaactgggcttgtgggggccatcttcagtgcaaccgttgtgacaaagtcaagaggctgcctccctgaagcagacccactgcctacgccacactgacggtccagaggccccctcctgagggcggccagcaaggggcactgtggcagctcccactgtgcctgtcccagactgggtcagcaggtctctctggacagcacactgcaccaagtaagcccaccaaaaacgcatcaggtgtggccatggcccacagtaccttcttcattccctgcctctaacatgtgcggtctgaatgaattttgtcactcttctgccatttataaaggagaagacagtgatccaaagctatgcatgtttctgaagccctcaaggaagctcggtgcaggccatcacttcttttggcagaaggcgggctgtggtctctatgtacacacgcgagcccgccagtgacgtgcggcagtgcgtggcgtccaggctgggacaggggcctttcaagtctccccagggaccggtgttttctacaacagacaggtgctcccagaccgttggggtacaggccaggccgtctacaccacagtattgagggagctgcggctgtggcggccaccccctggcagtgcctctgcagctggggtgctcccgctctgggcagggtcagggggcacgagcagggcgctgctgctgtcggcagagtcttccaggtctgccagagaggcccccgcagtgggcagaggctgctccaggcgccggagtaatgcaccttcactcccaccatccccaggggctggcaggctgacctccacaggctcaaaagcatcatcgtctgcaggaagagacagaggggtgtcagaggcaggtacgggcctggcacaggggatgcaggggagctaggcaaaaccaggagacactcctcctgcctgaaggcccccctgaagctgggtggtgagcaggacctgggtggctcccccgggcctcagattttgaaggaggagcctgccccacatgacacctgttgtacctactgccccctgtggctgggaacctggtatatgcaaggtgcagggcccatctcacaaaggcagacacgggcctgtcccaccatcggtgtgaggtaggggagacacactgaccagcagtcactagaacagaggggcccaaagggaaaccgtctcagactcagtaaggtgaagacccggctcagcaagaaggcaggggcatttgtcatcagggaggcactgggcccaggtgggtggaagaacattcagggctgcagctggaatgtggcaaccggagtgtgggcaacagggctgcagtgagcggcctggaaaaccacacaggtgtttgcaggaagctctgatccaaggcaggctgtgtggtaggcagtcgactcgctttgttttgcccgatctttattacttgctttttttttcttttaagagacaggatcttaaaagattgcacactggtgtgcagtgacgtgaccatggctcatgacagccttgaattctgggctcaggtgatcctccattctcagcctgcccagtaactgggactacagctgtgcccactatgcacggctagttctgaattttttgtggagaaggaggtctcacaggctggtctcgaaccaacctgggcaacatagtgagacccctcctcccgcctcagcctcccagagtgctggattacaggtgtgagccactgcgcctgggctgcctgcttgtcattaccataggctgtctctgaaagctaacagcacaaggccccggtgatgcacctccctcccggccagcccctcacagcccccaccctgctctgcagcctggcccacacaggtgtctgggatctgctgccacccaccaccatcccttgcaggaagctggtcctaccctggaagactgtgacaatctgtgtcatgagggcaggggtcaaatgcaagtcttttctgcacccccagatcatgcaagagctgtggcagctgactaaacaaacgaacaggactgagacctttaggcacagcagccccagcctcacaatgcccattctgccgagatgggcaggcatgcaaggagccagccactttggggtggcactgcctaccaaatatactacaggtttgtgtgtgttagggggcctaatgcacagggagatgggatgggacacctgcactgctcaacagagacagagacaggccaggggtcaggggcctgccactccttagctacacagccttgaggaatggcgcccactctcagatgggtggtaggctccaactatgggccagtagcacagaagccacgctttcctcccacctcacagagctgcctcctgacacgacaggaggggctgtcaccatggtgtctctagctcatgtgtctacagacaagtgattggctcctgggtctgggccagccctgtcttcacaaccaccactgtcgggctccccaggtctctagagctgggctgagggccctgagggctgcccagatgacaggtgctcacagaaggcagggaggtaggagggaggggtcccaggccttctcagagctctctgcacagattgccaagggcggccaggcagggagatcaggaccccttctgcacgggcagccccaggagaagccttaaaggaaaaaccaaagacaaagccggaaagaagtgaggtccctaggcctctgcagctgggcaagagtgctgggctcagccccacgtgccaggttacttgacaaggtgttccctctccctggggagtcaggcacctgcagggtcatagaacacactgtccgggtggatggaggcctcgtagggcggcggagggtcgtcgggctggccgatgtccgggtacttgtatgccgtgtagggaggtggagggtcgtggaaatggaaagtcccaccctctccgtcgtcagaaagatgcagcggcgtgaggcccgtgccaaacccgtctgggccgtaatcaaagccagggatcctgcggccgaggttgaagtggtgcactgggccatcaaaagtgtgcaacgggaacagagacaagtcactgggggcaggctgcctggctcctgagccccccacccccaggctgggcctgccgtccctgagtgcacacacctgtgccccgctgcctacccctcggccacattcggcatccccatgagacccctggtgtgctccgtggcatgtctcaccctcaccacaccaacctgtccctctgggctgacacttctgtcagacccagcctctggctgaccacacccctccagctggaagggtgatccgggcctctgaccctcagaggcctccgagttctgcccaccctgtggctcaatgggaataaggagggtcttggcaagaactttcctggcccacaggtgaggacacagaccccacaacatgtggccttcaaacctgcctctgcccctctctgtccagggctggggagctcatggagacatggggtgacctggggtggggatggggaccagggttgtggccctcagagggcacttacagtttgctccaatcagggactcgatgcgctcccggcgccgctggcgcagccggtggaccatgaagagcagcagtgacaggatgaggaaggaggagatgcagctgacgaccaggcgcatcccgctggccatggagtcaaacagactgttgccatctgagggggaggggaggaaatggccgctctgagaagggggccaccctcgtgctacgctggggatgctgtcgtcctcctgcccaggcgggctgtgtggacaaggcacacagtgtctccctgcacccaaccatctttaggatacatgtgaaataaggccgctcaaaatcaagaacatggtgacagcacagaagcagaagagcgaatcccaggtcaggaggagcatctcaccatggccccaggctgctgtgtgccaacacccctctgaccatcaccggagcaaactaggatttcctgtcctaggactagcactcctaggaggctgcgctcatgtgctgtgtaccccaggtgtggctggggagcggccctcctgcagaggtgcacatccttttccaggggccagggctgcacacaggcctcccacgtccgtccaacagcagccttccttttgtctgaggcctgggctcttgggaggaaggtgctcagttgcccagcaagaatgagccagggggcggtgagggacagccctttcctggtaggaggccagggttggccaggtaggcaggggtctcatggatgacagttgctggcagtttggagtgggggtgacgcccctgcggagcatggctcgggcggctgccgtagggaggacaggctgcaagggagtagcatagggcatcaggaagccaggaggaggacctgccgcagcagagaagggaatgacagaggcctggaccgggtagtgacagactgggagaagtgacagtataaggtacacttgggactcggattgccacaactccctgatggactgtgtaggggaacagtgagcccctgtgggcagccgcacggtcaactcaggtatcatttcacaaatgtgcctctgctgtggttgggcgtgaagcctgtcactccaatccttaacaagccatggcagagaaaatgcgcatcccctgacgcacccagccctggcatacacgtgcagatgacacctggacacaacactgggtctcacaggctccccactgagatgctctcccggctcagccacacccacacattgggtacacacgcaccaagcgcaggtgtaggagggctgggtggacccgactccacctctttgctgggtgagtaggcaggaggggccatgaagcttgaagctgagtcccagccaggctagacgccaaggagcactgagtctaagctgctgcgccttcctctgctcttcttcaaccatttcacgcttttcgtgaccaccacttggctgggatgctactagtattcagcaggtggaggccggggtgctgttcaacatcctccaggacagcccccaacacacagtatctggtccaaatgtcaacaccgccaagagggacacaccctgccctggtgcagtgcacactggggacaggggctcgatatgagctgcccatggggaggcagagatgacatgagtggtagcaggcatgaaaggagaatctaccagccacacatctataacatggctggcagttccatgcactcctgacttgggtaaactggcaactcacagaagtcacagaataatggaaccaggaagtggtcccagaagtagcttcctccacagaccaagagtgaaggccagggaggcttcaaaacgaggagtgacccatcagctcctggaagcaggaggaccccacaccagcagggaccctgctaagctaggaatggccactcccacctctgcaacaatctcggcaggcaggacccctactgcctgccccaaggagacacttcacaacccccgtgtgagtggctgggttcccagagccctcaagccattcctgctagcccagtacactccatgcccacacagatggcagcgccagctcctgtcctcctcccacggggccaggaagcatctccaaaagctgcattttttgctgacgacacatgaagtgaatatgtgagaaggatacatcctctcaccaattagctgcttttcctgatgcctctgaccctcctccagtctcaagggcactgtcatcagtgggagaaagcctagtggcccagggactggtgacgtgcctgttcattggaggccagttcagagatcccaggggagctcctaagaaagcagcccctttgcaatgactaactcttaatccgttctaaaataaacccaaggacacggtcaaggtcccaactgtccctccaaggtggggaccggaaataatcatctctcagaaccaagccacttgtagtcaagcacaaagaagagagcctgccccagaagccagaggccagcccaggggccccagaggccccttgatagggctgatctctccatggagttctgggctgtgcagttggggttgtcttttgtctctcagctatcctgcagctcccagagagaggatccagcctgtgcaagaagagctccagtgacaaggagctcaccatttcattgagcttggttaagtggtaacagtttcaaaatctccatcagagacaccatggggagcagaaggtcagcagggatcagaagctgagaccaggaacccaatgtgggctctgtgcctggcagctgcaccagccaaacacctcaccatgcctctgggaacctcatcgtatcagggctgcccgacagcagcagagcaagcaggggcagagggcggcatgagtttcagctgctctgcaccttggccagcacttgatgctatcagtttcattactttagcctttcgagcaggggtggtaccccacgtggatttagtttgtttccctaatggccaatactgagcatcgtttcagctgcctgactgtcatcctatatcttctttgataaagtttaataatttacatcttcttctaaagccatttttcaatagcattgttttgttttcttattattgagtttttatgtattctgaatacagacctttgatctgtgttttgcaaatacttgttttgattcagtcaggggcttattttttcatttccttaacagtgtgttccaaagaacagaagttttcaattttgatgaagccaaatttgtctgttttttttaaggatcatgctaaaaatgttgcctaacccatggtcacaaagatttctctcctatgttttctcctagaagctttataattcaaggttttacagttgtgtctatgaccattttgagtaaattttacatacagtaggagggacagtgtaaggttcgtattttttggcatatggatgtcctgctgtcccagcaccagtggttgaaagactatcctttctccactgaactgctcttgcacctttgtcaaagattaggctggtctgaaggtagtgagtcatctcgattgattgttcacagtcagtaacagatcaaactccttgttgtactcttttcccgttctcacgactgcacttgactcgtcttaaacaaacaaaaacagagagatcacctgattatacgtagtgtgggactatttctggactgttgtgttccactgatctatgtgtctgccccttcatcgataccacactgttgtgattactatggctgtacagtaactcatacattaggtggcatggatcctccaactttgttctttgtaaaaactactttggctattttaattattttgcctttccaccaacttttatctacctttttatttaagagacagggtcttgctatgttagccaggttggtcttgaactcctggcctcaagcaatcctcttgcctcagactcccaaagtactacaattacaggcatgagccgctgaacccagccctattttatttttactttttgagatggagtctcgctctgtcacccaggctggagtacagtggcgtgatctcagctcactgtaacctttacctcccaggttgaagtgattctcctgcctcagcctcctgagtagctggtattataggcataagccaccatacccaactaattttttgtattttttgtagagatggggcttcaccatgttggccatactggtcacaaactcctgatctcaagtgatccaccctccccagcctcccaaagtgctgggattacaggtgcgagacaccatgcctcgctccacctgatttttagaattagcttgtcaatacctacaaaaatgtctgctagaattttggttgggattatactgaatctataatttgggaagagctaacctcctaatgatattgagacacctgatccatgaacatggtatctttccttttatttaagcctttttgtcatcatggttttacagtttgcagcaaacagaatgtgcacatattttatattatttataattgggtatttcattttttttggtgctattattaatggcacttttctcaaaattttcaattttcaactgttacagatagattatataaatatgatgaatttttgttacgttgaccttatatctggagaccttgcttaaacacacttattagttctaataactttcctgtagattccctaggattttctatgcaatcatgtgatctgcaaagggagatggtttcatttcttcccctctggcctggatggtttttcatttcttcttgccttctggcactggctttgacctcaagcacaatgatgacagggtggcaagagtagacactcttagcttgttggaggggacattctgatgcttaacacatgacatcctattcccagagtctccagttttggtgatagtgtctcggttcttgagcactttccagaagaaggccctaggagagtcaggagcccatggaagcatggccacagggcaggcagagcagggcccagctaagtcgctctggccgtgcaggagagagggctgcagctgctctgggcccacccagatgcactaagggccctgctctgctaagaagtccttggggctgggcaggctctttaggccatacatgcccacaaatgggtcatccttgtacacatctgggcattcttacaaagcttggacagagtggcaaggcagcactggtagactcctgagaaatggaaccaggagtccaggtagcatggcttgtgaacagagtttgactcttgtagccagtcactaagctgggggtttaaagttatgtggccgggcacagggaacttgataagcactcaaccagtgcttctcatggccctaaacagacatgcaccctatacgaggagaaactgccctgcagaatggggtccaagcatcaccctctagctctgggtcctctggtgggcttggctgcaaatgtagccttgtgctcaccacagtcaactgcacatgtctgatggtacatgccacagtgcccactttcacccagcctcaggcacagcctctggaggacagctttgtcctcccacccagcagccccccagtgtggagggacactgacaacattccactcaggggcagctttcactgttgtggcccagcctctagctgcagcctctcctccacagggcccctagagacagagatggccatcacaccctgcccaagctgctcttctacaggggccacaagtccaggggcttccaaaagtccccatcatttcattcctactgtggcacccaagaaagaaagaaactcatacttttgatttacatttctcttgagatctgaattcacacagagctgcagctacaccggtgtgcagaatgacaaagcatgcccgtggagtgtgaggggtgttaacatctcagagagcagtggcccacctgctcctctctttttgcaagtggaagggagaggatcaccctgagatcagattccctgtagtgtctaccttaaagcccccgcctggtggtgaggagtctgatctcgaaactgagaataatacttcatctttttctcgaagattctaaggtaaaaatggatgactgtaagcaatgacaactgtcactaccctccatatcatcatactagagaacaggaagagctccaatgtggacataaattagaagtctaggctggacgcggtggctcatgcctgtaatcccagcactttgggaagctgaggtgggtggatcactcgaggccaggagttgaagacctggtctggacaacatggcgaaaccccgtctctactaaaaatacaaaaactagccaggcatggtggcatgcgcctgtagttccagctactggtgaggctgaggcaggagaacggcttaaaccctggaggcgtaagtttgaagacaagtttgaagctgtcagtggtgacttgtgaacaaacagccacacttgagttcaagttcatttgtgaatgctgcctgtcaccccagaatgggaaggaggcagctggaggggtcgtgtcagacacgcccactagagtagtggcatcaaagtctctgagacatctctgtgacaaacgctgccattgctgctgcgcgatgctccataaactctcctgagtcctcaccactgaggaagcaaagggacgcccagcctccagccccaaatagggaggctgacttgggacgtcctatcaagagtctcacctgggtccagacacatgaacttgcagcactctttggggtccttgcggtactgttggcagccctggggcctctcacagagagcagccacacacatctcaggctcccctccatggcaggtgcagctcaggcatgggtcgtcccccttaggggtgaagtagaacccttcatccaccacgttgtccttgatgtcaacacatgtttgacctgcaatgagcatacattgtgtacagatgtatacaatgccaaaaaaggtagcctccccgtgtgggccacactgccaaaaaaggtagcctccccgtgtgggcctgtgaatgctacctgttaccttagaatgggaaggaggcagctggagggggcatgtgagacatgcccactagagtaatggcatcaaagcctctaagacagctctgtgagcaaacactgccatcactgctgcaccacttgacatgagctgaccttccccacctgggcctggggaacgaacaaggcaactgaagacttggccagattgtgctgagagtcttcccagggctggaatgccatggatctctggcccatggcacagggagtggctgtccaagagcagtcactacaacactgttagaacaaagtacatctagccagggcaaatggaggccggagagccaggatggagcacaatgccagactccagggtcactgcagaagtgtttgcctggaagttgctgaagtagattacttatgagattttctcaattctaagatgcagctgctatgagtattaaccatttcaaaatcagaatgtgtgtaaggaagctgccagttctgcttgggaaggcagtccactggacctgaggcacactctgcacagagctgacctaggatgagagtaagaggaatggccatggctaaaaacccagagtcttcaactggtaggcagacgttgcaaatgcctggaggagagacaaggaatgaaggagcctccaagagagccaccctcagtgaaaggcaaagagacatgagaaggtagcttcttacagtctccaaatggggtaaggatgtctagaaaaaagactcttccgaaatttcacaatcacaggtctatgcctcacttaagattgtagtcagctgggcgcggtggctcacacctgtaatcccagcactttgggaggccgaggcaggcagattgcctgaggtcaggagttcaagaccagcctggccaacatggcaaaaccctgtctccactaaaaatacaaaaattagccaagcgtggtggcatgtgcctgtaatcccagctactcaggaggctgaggcatgagaatctcttgaaccccagaggtgtaggttgcagtgagcagagattgtgccactgcactccagcctgggcgacagcatgagactctgtctcaaaaaaaaaaaaaaaaaaagattgggatcaaatctaggtcacccatgtggtcaggaactcccagggcaagatactcacatacaattattccctggctaaaatagagaaaaaagaatgaacagaaatgaacagagctcccagagaaatgtgaaacaccattaagtacaccaacatatgtgaaacaggagtaacaaatggagaggagagagagaaagaggcaaaaaaaaattagtcgaagaactaacagctgcaaactactcaaattcattgaaaaacaataacctatacatccaggaagctcaacaaattccacattcctaggataaatgcaaaggagccacaaactgacacatcagagtgaaaatgctgaaagtgaaagacaaggcgaaaatacgaaaagcagcaaatgggacgtgacttgttacttctaagggaaccccaataagacaaacaactgacttctcagcagaaacaacagaggctggggcagtgggataactgctcacagaaaaccatcaaccaagatccatatccagcaaagatatcttctgaaaaatgaaagtaaaataaactttcccagacaaacaacaagtgagagaagttgtttgcagatccaccttataagaaacactaaaggaagtttttcaggccaaaagtatgcaatccccagatagtaatttgaatacaaataagaaactgaagagcaacagtaaaggcaatcgtgattataaattatagcctacatgcatagttttcctcctttattctcttagctgatttaaaaagcaattgtataaaataatatgtatggaatgtagtattgggtctatgacatacaaaaatataacacacttagatttgccaagaatggcacaaaggtggtgtgtgggagcaaagctatactggactaaagaacttcacctaagtctcacatcttattaaaacactcattcgaaacatgtcctagacttaaatgtaaaacggaaaatgattaaaattttaggaaaaaaacacagaagaaatgtaaggctaggcaaagagtacttggacttgacaccaaaagaataatccataaaaggaagctggtttcagtggctcgcacctgtaatcccagcactttgtgaggccgaggtaggtggatcacctgaggtcaggagtttgagaccagcctggccaacactgtgaaaccctgtctctactaaaaatagaaaaattagccaggcgtggtggctcatgttggtaatcccagctacttgggaaggtgaggcacaagaatcacttgaacccaggaggtggaggttgcagtgagccaagattgcaccacttcactccagcctgggcaacagagtgaaattctgtcacaaaaaaaaaaaaaaaaaaaaaaaaatccacgaaaggagagagaaataactaggacttcattaaaattaagaacttttgttctttgggtaaacttatactgccaggaaaaaacagcaacaacaaaacttttgttcctgaaagctcacctgaagaggatgaaggcaagctacagactagaaaaaatatttgcaaaccacatatctgacaaaggactggtatctagaatacataaagaactctcaaaactccacagtttaaaaaagaacaaaacagatcattagttcacacctgtaatctcaatacaggaggatcacttgagcctaggagttgcgtttgaagccagcctaggcaacatagtgagatcctatctctatagaaaataaaaaacttagccaggcatgacggtgcacacctacagttccagctactcaggagactgaagtgggaggactgcctgagcccgggagctggaggttacagtgaactatgattgcaccactgcgtttgagcctgggtgacagagcaagaccctttctcaaaacaaaacgaacaaacgatgcaaagagaaaacggaagaataatgtgaacaacagagaatatacagatggcaaataagcacatgaaacatgaagaggttttaacatcagtagcctcagggaaatgcaaattgaaaccataaggagccacaggtctacatacatatctgcatacctaacagaagggctaagatgaaaaatagtgaaaacagtaagcgctggggaggatatggagaaattaaatcactcctacgttgaatcactcctacgttgatagtgggactataaaatagtacagccactctggaaaacaatttgcttgtttctttaaaaactaaacctgcaactacgatacaatcaagcaactgtaatcctgggcatctatcacacagaagtgaaaacacatttgcagccaggcgtggtggctcatgcctgtaatcccagcactttgggaggccgatgcaggtggatcatctgagactgggagttcaagaccagcctggtcaacatggtgaaacccatctctactaaaaagacaaaaattagctgggcgtagtggcacatgcctgtaatcccagctactcgggaggctgagacatgcgaatcgcttgaacccaagaggcggaagctgcagtgagccaagactgtgccactgcactccagcctgggcaacagagaaagactctgtctcacacacacacacacacacacacacaaaagaaaaaaagaaaaaagaaaacacgtttgcacaaaaacctgtatgcggatgttcacggcagttttcattgtaatagccaaagactggaaacagcccagatgtccttcaacacttgaggcctatagtttgagaccagcttgggcaacatagcgaaatcccgcctctacaaaaaaaaaaaaaatacaaaaataagttgggcacagtggcatgcacctgtggtcccagttactcgggaggctgaggtgggaggttcacctgagcctgggaggttgaggctgcagtgagcagtgatcacaccactgtactctagggtgacagagaccttgtcgccaaaaagaaaaaaaaaaggaacaaatcattaataaaagtaacaatttggatgactctccagggaattatgagtgaaaaaagccaaccccaaaaggttgcaactatatgattccatttatagaacatttctgcctcatgatgatacctgacaaaggccagaccacatatgaccaaaggcctctgacctaccacttctgtagcaaccagtctagggcagtcaggatctggccagtggccaccagcttctctattttgagtccatacttccaactggaaacccaccagggaaagtcaaatatgttccccaaaccaatcacctccactgccctgcttctagtcaggctgcctctaatcagagcatacctggagcctttagggccctggtgaaaagccactgtgctggacccaactccagctgcaggagggtcagaagcacttgtgaaggctccaccctggatcctcagggcactgggcctgcttaaggctcagatacagttagaacatcagaccctactatcagcatgctaacaagccttgagtcacacagtggactactgctaggcgggctgcaaaagacagactctagagatgtagcccaaagggatgacctcaagtagagggtggagcagacattaagaaaaaccctctggcaaaccagcctccacccagaacaacaatgctgctaaatacgaaagcctgaggtgcactgagggcaactacagtgccaacaaaccccaagcccagcccaactctcgcccagatcaacgccctgcactgtactaaagacctccccacaagaaaggcctagtggaagtaaaggcatagccactgcaagcacaaaactactgaactcagtctctattgtcccacacaagatgtcagagttccaatgaaaagcctagaaaaaagtaccatgctccagagacaaaacaatcaaaaaaccagactcaaatatgacacagatgaaggaacttccccacagggaatttaaaataactacgattaatttgttaaaggctccagtggaaaagctggacaatatacaaggttagatgggaaattcagatgagagatggaatctataagaatcaaatggaaatcctataaataaaaaaacagacaaaatcaatgaaacagatgaagaataccttcaatgggctcataagcagacttgacatagccaaggaaagaattagtaaacctgaggacaggtcaacagaaattactcaaactgaaggactaaaagaatccaagagacatgatgactagatgcaatgcatgattctggacaatgaaaaaaatagctataaaggatattattggaacgactgataaaactggaataatggattgtggattactgtatggtactgtatccatgctaagtgttctgattttgatccatatagtgtgggtacataagaaagtgtccttgttcttaggaaatacacactgaagtataaaacgcttaattaaggtccacagtatcttcagtttactcccaaatgattcagaagaaacatgtagagaaagtgaatgataaagcaaatgcagtaaaactgaaatactgtaactggtgagtctgtgtaaatggtgtatgaaaggaagttccttgtattattctgccttttccataagcttgaaattatacctaaattaacaagttacagaagtctccctcgcctgacccagatggtcctataaggtggttctatcaaacactcaaagacaagtttatctccaacttggacaaatggatttagagaacagtaaaataaaatgtttgccaactcattttagaaaactaatatagtataatacagaaatgagtcaatgtagtcccagctacttgggaggctgaggcaggaggctcacttgagcctaggagttcaagactgtactgtgctatgatcgtgcctgtgattagccactgcattcttgcctgggcaacacagtgatgccccaccttaaaaaaaaaaaaaagagagagtcaaggagagtatagaaaaaaatgtaacaggccaacctcacttcttaaaagagtttcaggccaggcacggtggctcacacctataatcccagcactttgggaggctgaggcaggtggatcacttgaggtcaggagttcaagaccagcgttcaagaccagcctgaccaacatggtgaaacgccatctctactaaaaatacaaaaattagccaggcgtggtggcacatgtctgtaatcccagctactcaggaggctgagacaagagaactgcctgaacccgggaggcagaggttacagtgagctgaaatcacgtcactgcactccagcctgggtgacggggcaagactctgtctcaaaaaacaacaaagagtttcaaaaattctaaatatcagcaaaccaaatccaccaatataatatattatatatatataaaccatgaggatggtttaacataagaaaatccatttatatgaaataatgactgaacagactgaagaaaaactacataaccccaataaaatccactaaaagcatttaataaaaatcagtacacttttgtaacacaaatattcccagcaacctaggaataggtacttctttgacttcatacaggtacattctaaaatcctatagaaggcattctgtagaatattgatacattaaaatagcattctaagttgagaagacaagaatgctcactaccaccatttctaatcatcactgtcctggagactgtagcaagaagagttgactgggcaacatagtgaaaccacatctctaataaatgtaaataaataaataaatgtcaaagatttgaaagaagaaacaaacccatctaaatagaaaatcaacaaaatccacaaactaagagaaccaataaaggagtttagaaaacatatcctaaaattcacatagaaaagggtcaaaaataggcaacataacaggcaagaacaaggcagaggaagtcgtaacaccagcagtcaagatttatcatgaagctctctctgttgccagccacctgggaggagctgccgccccggccgcacatctgcaatggatggtcgcgaggaatcatccggcctgatcaaggggaataagcagacccacagcactgagcctgagaacttaaaggctgcagctccttccactacaacgagctgattcactgcaggactgtgggtgtggacccggcagctgatggcaaaggtgtggtggtggtcatggagtggagatccggccagcagaagccagccacctcctatgaggggaccaccgtcgggtggacacggtggctcacacctgtaatcccaccactttgggagggcgaggtgggcggatcacgaggtcaggagatcgacaccatcctaacactgtgaaacccgcctctactaaaaacacaaaaaattagccgggcgtggtggcaggcacctgtagtcccagctactcaggaagctgaggcaggagaatcgcttcaacctgggaggcggagcttgcagtgagccgagatcacgccactgcactccagcctgggcaacagagcgagactctgtcccaaaaaaaaaaagaaaaagaggaccaccgtcaacaagaacgcctgcaccatgctcggcaacatcacacacatgatccgcaagaacaaagcctctccccaacctgcgcacagctgccatcccagagccagcgccatcctgcgaagccagaagcctgtgatggtgaagaggaaggggacctgccccaccaagagctcctgagacccctgtcccccaaaagcaatagagttagctggctttaataaaaaaaaaaaaacacacacaccatagactggcaaggtaaacagagaagcagagaagcagagagaaggatggcagaaatggggggtggggaggtgacaaacagccttagatgctccagagatgccaagtccttgggtcctcattcccatttactctcttaacaacactgcaacagggaggacagggatgattgtctcttccgtgggaaaagaagctgggctctaagatgcttccgtgggctctaagatgctgaccagctgccctggtcacagagctgcaaatgggccccaagaacaaggtgtgagctggtaaggggcgtccaccgcaacactgcaaatcaggttctgcctccgaaaccttgaactcagggtccaacaaagtgacacaagggcccagacattccccaagaacgccagctcaagggggcttacttcttttacacagaaatgaagacttctcgtagcagctctcggcgtgccagctgtggaggtcgtggtgccgcagggtggggaaatggaagcactgaagctgggcacagaacacgttgtcgttctcagacatggccgaggcaaagatggggtctgggggcaggaacacctctgaagagcctgttggggagacaaaaggtggggctggacaacatcacatcagaggacaagctgtgcagtcctcaaggggaccatggcgtcagacaggatcatcaaccacagggcctggaccgccaagtactggtggtcactgtggccaggtgttcactcgggactccccaacctcctgggagtcaccccaggtgctgggcctagcgggagccactccttggagcctgcaagcacacaggccacaaaccctgggtagcagtaagtgccagcctgagcaccagaagagggtgctggatcacggttagtgggtggcatttaaagttagagcaacagcataataacaaagtaatggattgtggcacactggattaaaatgcaaacaggggaatgggcaagggaaacaggcagggaagctctcccttaggacagcacactcagataaacagaagacttacaaagtccacccaacacccaggagaaaggcgccgtcaggcagcattggcactggccggcactgccagcagctggctgcagggaacacttaggaagcactggctcccggggacctctctcagctcaagggaaactgtcacccactcagctcctgcctaagccaggcacaaggcagtcagaaaccgtgtacccctgccgcagagagcgtgagggttggggactgctaacctccaagcctctcttttgcaaggttccaggtgggctctggccatgcccagggcatggcacagccagccctaggccccactctctcccctgcacggcccttccagtctgggctgccaagattccttgaggcttacccgaccaggatcaatggaaacacaaagcaacctttccaagaagcagaataatgaaggcacacctggtgctctccccctcctaagacagcagcagtgcagctcaccccatttataagcctccagcattctcacctgcgtcttttggagctctgtttatacccagcacgaaacatggggctctgcctcaaaaaagccagtgagtctggaggcaggcctatgctgtgggcctgtggacacatggtgccctgccatgggcaggaggacagctctcaggaagctctgagacctgcaagacctgtgccaggccagcaggcagccacagcaacagctgtgcccccttcccagggacatacaggcccagcatctcgcctgcctcatctgcatctatcagacccacagcagagcaggaaaggggcccactgtctggagtcacctccccataccacctggagggctggtctccactgctgacagtgggtgccaccaccatcacgctgtgcaccaccccacctttcctccaggcccccgagcccctgcacaccctcctcatctcccacagatgccttctcacctaagtagagcccctccccttttaaacactgttttcttcactatttgccttcttgtcccgtggcaagaaaaccaaacaggttccttccaatctttaacaaacaaaaaatcttcagcgctgaagctagttgccagctaagagctcctgcccacaactacagtacatgacagcagactgagaccaaggacacaaatgacctctccgggcagagtcctgggacccagcatttgcccacgaaagctgcctggaccggggcacagcaagtcagagtgagtcaggcaaccagcaaaacagggttcgtgtggcactctaggccagggcccagagagccacacagtgctccctcctggcagcaagctgcatgggcacctgtgtagcgcccctgcccaggggagctgctggtggctctgcatccaggtgctgaatgggggctggtcatgcgggcactgcatgcctacccgaggtgcagccttgcagagcgggcaggtgttcgtctttggagcatccctggaagaggtcacagtggcagccatgaacaaggcagcctgtggggctggagaagaggctggggagtggtaggtgatgagggtagtgaaggaaggggctgctggccttgatggaactgtgatttctatgagaaacgagagctgtgaacaagggagcagaggtgaaaaggacccccagcagctgtgtgaggagcggtggggctggggccaggagaccagacagaggccacgagcacaatcgggtgacggatgattgggtgttagatcccggtgggggctgcaagactggtgccaggtgatgagatcctggacatattccaaaggtgtgagaggagcctggaggcttcccgatactgcactggggatgactcctgcagattttcctccagggcctcccacttcctcctggacacccccttacctcaaacatcccgctcttcctgaaggaccctcatcctagagaaaggccctgtgagcagagctgccctggctaccagagtgactgggagcagttcctcgtgcagagccctcctctcaagcctccctccaagacactactcctcaccccctgccaccccagcagatccagtcctcacctcgacagggtggcggcaagtttccaggtgcccctcccatatgtccacacatgaggtgtgcgcaggactctgacgggagccttgggctgggccgtcaccagccaccggaggacaccctgctccccagactgatacacgagggcatctgaacctgattacctctgccaccacatcctctcccacatgtgcgagcagccactgccacctccatgtccaccgctgctcgccgagcctggagaaccctccccggcccccgagtcccccattgttcgagtggtggggagaccttcactcacttttctgagccctcaaagaacctccccttcctgtctcgccacctccacagccacagaatgagcctccactcgggcccaccaggggctgtccagatgctcccgaatgccccaccacggtggcagctgccccactcagggtctgtctcccctccaagaactgtggcctgaccccagctgaccccatcctagaccaatggtcagctcacccagagggcagggtctctacaatgcaccttccagtggctgctaggccagcctggcccctccctcactgctgactgaggcttctaaacgctaggtcccacaggctggcccaggaccacagccctgactgctggcctcagcgggcaacaccatacaatccctcaggtacagcaccagagaaagaagaagacggagaccataaaggactgggcacaagattttgggggagaaaagaaggcttctactaagtcacacacctcctgacctcagccaacctgcaatgtgcgtgctgagacaccacgggggacaaatgagggccaggcactgagtaatcttaaatgagcaagtgacacaacatgtggacacatgaaacacacgctgttttcacttttatattttaaggtaaatatcaagtatgactcaccagacagaagctacactgctggtgctgacgggaaggccctgggagcagcacgtggggcggtgtggatgattctccctacacaaggatctgtactttttcaacctttctgcacaaatgttacagaaatcctggcctcatgtcttctggcagcagcagcggcagttctgtctccagggcacatcatgacctggtgctgtcaaacctgcagggtcttggcccccaggcggggctcacaggctggtgtgggcctgggggagcgcctggagagcgctccaccaaggcgcacaggaaccctgcggaaacgagctcccaacttcaaatgtgtgtgcagggtaccgacacatgggcatagtaagcgtctatgtaccatggtatcactcacaccccaatctggaacatattatacaacacagaaaagatggacaacatgtagatgaaagaaacatttttcaacatcttaatgtgaggcccttccaccatcattagctgatattctcaggtacaatattttcttagggaagggttcagaatgagtaacaaatgacttacatccatttcccatggttttttgggtatttttgggggggccaacacctcagaccccaatgacccctctgctttgcaccatgtccccaggcaggagaaaggctggggtgggctgggctgggctagacgtgctcttgctagcttgttttatactcagtactgtcttcactctgcagcttgcttttggtacaggaatttttaaaacgattccactatggagagaggagtgcgtgcacccgagccacctcggtgctgaccgcaccctgctgcttggctcctctctgccctaccaccctgggagcccctcccctgcagactccaggatactggctcctaaaaccacacaaccacagtcctattgctgcacctaagaaaatgaatcttccacaagtccccactcatttcttgaattgtcctgtggaagattttataagcctcccaacctaggacaccataagggttcttgtgccacatttggttttatgtttctttaatctctttaagcccagaaccactcatgatgctgagctgcatcaagggccagttatcctgcagcagaagaattattgttattgttactatttgttttgtgaccactatttaaatccgctaacagagttcccgaatccatttaactgggcacaagcaggcagtggcacatggtcacctccgtggagctccgggatgctgtggggccccttgcacgttgagccacacaaatagggagctctatgccagctgcagctgccagcaccaacatacgtgttcaatctttttctaaattttaggttcactctcctgcctgaggctccaatggagtcactgagctgcacttggccattaaagcccacccaggacccttgccattctcacaccaagcatgaggcccccagtccccaactctgaatgtgctgtcatcccactcagaatcatgtcttctcttcaaccaccagtgtcaggaggacaagctaccaggataattatgctctatgaggcaaactttgactctggggcctggaaacccagaagccattgattagtcaatagcaatctaaacaatgcactcataaagccagggaatgcaaatgtggctggggctctcaggagggcactggtggtcatgagaacagggtggcatctgtcctgagcaggatcgggacagcaggtgtggccccagtctgctgggctctgcagcccccacctctgctcctgccctgtcccagcagccaggcatggccccgcctctgtggggccctcttttctccagggaagccggccacccaggccttgacccttttcaaccctgtccccaggcccatcactcctcatttatccttcttagagatacttaagacatcaacagcaggactgggatgtgtttacgaaaagaacccaaatcctagctcaagccacaggcacaaagtacagcccaacagacagggaaggggcagggcaagggagtgtgaccctggcggcagctggagaaggcactgctggagtatgtccaggaggagctcgccagtgccagggcaatgggacaggaagggcaagccaagtccgagcccagggaatgtaaaggaaacagcagccatgtttcctttacgtcgtcttggtatttccaagcagctccgcataaaatctttgcgcacacacacacatgcatgctcactctctctctctctctctctctctctctatctgcctgatagtttccttcaggtctggattctacgtctgacctttgtcctggcaagcttgtcctcccctccagcctgccaggggcacactctgcatgctcatttttatactccaaggtctttaacttcaaaaggaggcgggggacaatctagaaagctggccaaagtgagatgcaacagagggttccagagacagccaccgcccaatgcagggcctgatctgcaggctgcactggccccatgaccgcagccctccctgcaactggggctcacccactccctgcacagcacccctacgggccaggcagcactgggtaagagggaggaggggaggccccgaatcagggtgactctgcccagcttcaaacactcccacacaccagaagggctcacctttgaatgccacctcccagcgaccttccaaggagcggttccggccagtgataacatactgatagccaacccacaacctgcagggcacagagacagagacagagatctcagcggcaggagggatgcaaccatcaatgactgtgtgttttttgttttttgagacagagtctcgctctgtcaccaggatggagtgcagtggtgcgatctcggctcactgcaacttgacttcctggttcaagcaattctcctgcctcagcctcccgagtaggtgggattacaggcacaggccaccacgcccagctaatttttgtatttttttttttttttttagtagagacggggtttcaccatattggccaggatggtctcgatctcctgacctcatgacccacccgcctcggcttcccaaagtgctgggattgttttttaatagctatactgacctccacaacactgagcttctaacatgagacactcatgttagaatgcattaaaattcaaaacaagaaagttcacagggcaggaaaagttttatctcagggaactcttgccaagactgtttctatgagctaaaccggtaaagctttcacaatttaagcaagaacaatcttattcttggtagacatgaaaccccatgaatacaactcggtgactatgctaaaaccataggacagggcactccacaggggagattttcatggcatgtgaactgcatctcaataaagacataagtccctgcaaatatccactaccatgggggctgaaaacacttgcacggcttcccactcagagccagcccacctcaggcctgcagcctgctcctgagcatgcaggcctagcactgaaaggaccttgcactggcatctggctgaccgccataagctcctgcctagtccatgtcccttggcccagctttccagccccaagcctagagatgcccatcagcaggtctccccgcatggcaggagcccagggatggcacactctgccctatgctgtgcaaccacaaggctgtcctcagagatggggctgccctgccctccgggctataccctcttgcttctccactggactcacaggcctgtcctcatggggttagtacaacaacctgtgagctaagagttagtttcctccctttgtagctgcagaaggaaaaacaactccgtcttgtgatttgccaaactctcacagggcataactgtggagtcaaaacccagcttgggtcttgaagcgaaggcccccttgctttcttggggggaacccccacctacactgcacaccccttgcacaaggcccacgaagccccacaccaagcagttctccccacacaagccagcacccccagccccctgcctgcgctcagcaactgcacttgtacaaggagaggggtaccaatgaaaggggctgccccacagtcccacaaagtagcagcagagtccagcctgcccctgctcccaggaccctccacctatctcgatgcacactcctacccatggatctcctgggcttccagtgggcgaggctggtcttcccaacctgctgtctgccagctgtgctccaggagtttactgagtggtcagaggccatgtgctcagtagtcatcagactctgactccagcccctcaggtccccaatccaggactcacttgcgctggtccttccaaccaaagctccgctcgggctggtcccattcctgggccaggacaaagcgcagctcctggtcagtggagaaggtggcgagagagccattcaggcgctggcaggtctgcgcggcatcccagtagttctccccgctcaggtagacccggtagcagctggccgtgccttcgtagtggtgccaccctgtcgggcacttccctaggaaacataaaggacagaaggggagttgtcccccaagttaggatccagctccaaaatggaaattatatgtactccatcagggacaggcacaccttgtaaatcaccctagagaagtggggaaactgaggctcaagaggacaaggtctgcttctgaaaccacattgcagaaatgctcaagtttctctaaaacacagattcaatgatacaagtacattcggtgactcttcccatttctataagatcttttaatttattcactagtcaagaacggctgctgaattaagtcttgtaaagtggatttcattctctgggttaacaacacagcacaactcccatgcagttcactttgggccctgcttccaatgcccagctctcctggcctccgctgccagctagctcactcccctctctcccttttctacttacatgagcatttgcagtaggggctggccaaccctccactaaaacagcagctcaaaggataacagctgggagagccatgacactgtgtgacccgcccctgcctcccacagccgaaaaaaataaggtgtgggcgatgccacaggtggcaaagctaaggagccagccagcacttgagtatcaatgagtctggccagcgtcctctcacttcctccacccatcacttccgactcctacacccacacacgggaatgcctggtaatttacagctcaccttaggtaacaccagtgacctcttttatagaatctttaaccttcaaatgttgggtacctcatattagtacactggagaagagtgacaatttttagcaaagccagttgtaaaattaaaaatgccatttttaaagtgcagctatgtcttgtggcactagtaaaacttctagacacgtatccccatgtatttattatgtaagcatgtgtgtgtgtgacttcttcataaaggcacatagattacagaaaaagaggggcacccctagcccctaagcatggccacagctggacagcaccatctgctcaccgtgaagggtacacctgagtgtgcaaggaagctctttaggtgcagacaaggaatcagagggctggcaacagtggctcacgcctgtaattccagcactttgggaggccgaggtgggcagattgcttgagctcaggagcttgagaccagcctgggcaacatggcgaaaccccctatctaccgaaaatacaaagaattagccaggtgtggtggggcacacctgtagtcccagctacctgggaggctgaggttggaggatcacttgagctcaaaaaggcagagactgcctgcagtgagccaaaagtgcgccactgcactccagcctgggtgacagagtgagaccctgtctgaaaaaaaacaaacaaaaaacaaacaaacaaaaaaaaacaaaacaacaataaaaaatgtcaaggcatcagctctcgagaaggtgtgttgcacattcattgcgtgtttcctgggtgccacaccaatgcatgcagcctgaccacatgccccgcaggtggctctgcaccgtctccatgaagaggtgaggacactgaggcaggcagaggccaggcccctatctcaggcaaggtgagaggaagccctgtagggagggaagctggctgaggcatggagggaaggagacatcccaggatgggagccagctggctggggcatggagggaggaagcactcctgtgcactgactcatcttctttatgttctgaacttggtggagttgcttactacccaggcagaagtgctgcctgttcaaaactgaacagacaggcaaggggaaggaagaacatggagctgagcatcaggaccccctggggctgcactgtgaactgccccttccctacaggtggcctctcagcctcagtgtcttcacacaccaagcctgtgcaccacacttgcactgtggggacccgttcgggctgtgggcacaggccggagacaaagtgcatcaccaggacatgtccagccctgcttcagccgcaccaacatgcgtgaccacctggaaacacctggccccactctggccacccagggttggtgggggttctgccagaagcagacctggtcacctctgaggtgctccccagtgctgaaagtctgggggctgaggagtaacacaagcagacaggcccaaggcagggcagcaggcccatccagtatcagtcctgcctggtccacagccgctgctcagcgtacttgggtacctcgcgcctgagagggtctgctcagggccatttcagtggtggcttttcctcccctcaaccttccttgatgatctcatgcccctttaaaatttcaatgtcataggtaatttattaaataactaatcaccttaaaaatttttcttaaaatggctggacacagtggctcatgcctgtaatcctagcactttgggaggctgaggtgggtggatcacctcaggtcaggagttcgagaccagcctggtcaaggtggtgaaacccggtctctactaaaaatacaaaaattagccgggcgtgatggcacgtgcctgtaatcccagctactcgggaggctaagacaggagaatcacttaacctggaaggcagaggtttcagtaagctgagattatgccactgcactccagcctgggtgacaagcgtgagactccgtctctaaataaataaataaataaataaataaataaataaataaggagtcgagccttcccattttattgctgtatctaaactcagagctggtttcctcatttataaaagggaataatacaactttggaatttccaagggccagtgccttctggccctgaaaagcagtcactttgtgagaacaagcagcctggcctcagagccggttgacttcctagggccttgagtcacataccaccactccagcgctgggtgactgcgggtgggtcatcatgcagcctcattcattcccctcactggcctccaagggctgctttgagaaacccctcacgcagcacagtagtgctggaaaggcaggggtcatgtcaggcttgcactccccagtgtcccagtcagggcaggtctgcaacttactgctgaagcgaacgggctgcgccacgttcaccgcgtggaagtgcgaagggtcgcctcctctggcccgcccctgccgcggatccacagcctccttcccatgatgaggacgcacctccccggtcacttctgaaagcaaaaggagatgtgtgctgtgagtcctgcctgtgcagtcgcagtctccctggccagcatggttcagaccactcagggctgcaaggccggagggggggcctgtagcacagagtccggcaatgcaggctttctttagagccctatgaaacactgccgctcgcatcaaatgggtcccgtgtgcttcttattaaaattatgccgtggcagtttttgttttttaagttactattgtgaaatggaggccctcttcattgcattttctaacaggtcattgctagcacagcaaagggtcctgcataaattaaaatccctcagcagttccagccccatggggatggcccatgaaagagttctctccagagcccaggctgcccctaccccttccttgagggccttctctcccagtatgaaggagacccacgtgtgcaaccttcctctgcagcccttgtcctggggcctgagctgcctatctgtccccctgcctgctggtcccccatggctgtgaaggcctccaggccaggacctcagtatgttcctgtctggctctttggtgcttggcacaggccctggtgtgcagcaggtctcagtgcatggctagaaggtgtcaacaggcagctgaagatgaggaaataactatagttttatacagcatgatctaatagtaatttgcacaccagtgcttccacccacacactctcttttgtcctccaacccccttgtgaaaaaggagaaccacactcctcccatctcacaaggtgaagggcagactcagagaaggggagtgacttacccaaggccatggtgcaggggagagggccctcatgggcccgctcacctcccactctgtacaggtgtaccctgatgtgtcatgaagggcatcgggtacaaggtcaggtcagatgggaaacaaacttggtctgcaaggctgcacacagacagacgcctgccagcaagtgcactctggctgcagatggcgagtggggcctcggctccccaagggaggtcacagggagggttaggaggcctcctgcaaagcctccttccctgaacctgaaccggcagtcagcgccacctgacgagcccctctccagcaggttggttctgctagtgtcatagactttgcaatggtttttatttaataaaaaatccacatgcttttttgctcatgataaagtaacaaacattcaatgtgaaatgcttgaaaaatacaaaagtttgaaaagacaataaacaacaaaggccatatttaactatgcgagcatctgccccctcaccaagtctcttttctacacaaatctttaagaatactgggatcacatcagacactccatttcacgacttgctttgtaagcttaagactataaacagctttctatatttttaaatgggcttaggaacatgacttttgatggctgcatagtattccacaaatggatttctttcatccccataatctctatggtttgaggttaggctgtttgcatttttttcattattctagaaaaggctgccttaaacaccttgtacacaagtgcgtatgtagtctcatttctgagactctggatactcactcagtactcaataagcatagttccatagctcctgtcaggcatgtgatggggatgggttgctattcgactgggaatcactaaaatataaaatatgctacctgtgtccgagacactttcaacagaaagtgaagacctcaaagggagaagcatcttcaaggcttgtgttttttggtagaggtgtctttggggtactttaccaccccaaaatacaacctaaggacctcagtgtgggacagtaactggcaccacgacaggcctgatgctgtaaacacgcagtacttggggaccatcagctctttaggactggtcccatgtcctaagccatgctacctgcagcacccgacactctgggtaggagactcgacccacagactcgctggtagctctgatgcagggatgcagccactaggatggggcatcagcacttggtggagaagggaagagccacctgagcttctgggcctgagactggaagctgagaaagaacagaggggctttctggcagatggagcagctttggcaaagggcaaaggcagacatatccgggataaacctgaggccaggcctgagtgtggctggagaatgtcactgaacttaaattcaacatctccctctgctcaaatgggcaagacctgtggctccactttgtatcctggcctcttccccaagccaagcacagtacctggtaaaattgctcacagaaagacaagatgaactgagggcagaggaaagggaagagaaagaagagataacagagggacagtgctgccaggtcacatgggcaccaaagaccaggttgttacatgttgactgagtgaagtcatctgccccctggggtgggagaccaggtgaaatatttcagaaacataaccagaaagccaaatggtgataaaggacaccactctgttgagcaggcttctctgggtttaggtggcaattgtgagccctttcttttttccatcatgcatctccatatccaaatgctcacattcatcccctcacccccacgtttattcaatgcccattctgggcccaccatggaaacctgccagcacagacacaggcctttgccagcaagaaggggaagggcttggctgtcaagatgatgctgatgtcagacagtgtcctgggggagagtctgggggccaggctggggaatgcgcatagcacaggacagaacccttacagacctctcaggcctgcctctgacagtagagaatgtccctcttcccgcggagggccagcctttggtaagctggggggcctcttccacctccaccagggccatggggcccgagcagccctgcctcacagcccagctggggacctggtgcaggggtcactgtagcacccagagccacatctgctccgactctgggctccatgacctgtgcagctcggagcacatgtgcccctcctgcctccagcaccactagagtgccacgctgctgcttccccagcacaggaacacactggagagcaagttcaacaaggaaacagaatcagggagaatacctagaataccactccacagactatttattcacaaattacttttcgtcacaaaaagggaaagaaatattcacaatagtgatcaaacttaacatcaccaataatgagacaaaatgaccttgggcctcgtgatttgataatttatgacttacatagtattgctacctaaaaaaaaaaagtctcacctgaagctaatcctgaagaaagagacaagtccaaattgaacgccattctacagaactgacctggactcttcaaatatggcaatgtcatgaaagacgcccaaagccccctgcaaaagagggctgggaatacttctagattaaagaacaaagcaatacggcaataacatacttacattaatccttgaataaatcttgaattaaaaggggaaagaaacctgtaaaggatgttctggggataatgaaaagaatctgaatatggattacacagaatagtactacagtaaatttcttgcatgtgaaaaggcttctgtagaggattgttcttattttttgatcatagtatttaggggtagaatatcataatatctgtaacctctcaaagggttcagaagaaaaacacaaagagcaactgcggcaggtgaacccgggtaaaggtgcggcaggacactatcagctggtgaacccgggtaaaggctgcaggagtgtttattgcactatgattatgagttttttatagatctgaaattattcatattaaaaggtgggcgcagggacaaggcaggtggacacacccagattcctcccacaactcaagcagtaaacaaatcaagagttaactggtaagaagataaaacaggtggtgtctgggttaggggacaccagttcagctgaaaatcagggttctttactcagggaagagaggacagattccccatcgccatttttcttccactaagctctcagaaccccaggctccaggcagataggaaatggtcctttatggaaaaaatctgaccaggtcaagaagaaagtccccaacaggaggagattcccaacgaaacatatccagctggttcaccctccagggaagcccacgtgcacagaacttcaagtccctcagccacatacagcagatagggaaggaccaccaaacctctgaggcagagacccaaaccacagaggaaaatagcacagaagaaacaagtacagagacaaaaagttaaaaccaaaaacaggccattaacatcctcaaagtgagaggttctactgtactcatgaaacaagaaaagggtgctattaagaaggagcatggaccgggcacggtgcctcacgcctgtaatcccagcactttgggaggcccgaggtgggcagatcacaaggtaaagagatcaagaccatcctggccaacatggtgaaaccccgtctctaataaaaatgcaaaaaattagctgggcgtggtggcacacacctgtagtcccaactactcgggaggctgaagcaggagaatcacttgaacccgggaggcagaggttgcagtgagtggagatcgcaccactgcattccagcctggcaacagagcaagactctgtctaaaaaataaataaataaaatttttttttaaaaaaaaggaaaatgcagacaacactatccatcattacttgcctctgaaaatgatcttgtacaaatgaacaggaggccaggtgcagtggctcacacctgtaatcccaacactttgggaggctgaggcaggaggattgcttgaggccaggagttggagaccagcctgggcaacacagcaagaccctgtctctatgaaaaataaaaataaaaataattagctgggcatagtggcatatgcctatagtcccagctactcaggaggatgacacaagaggactgtttgagcctagctgtttgaggctacaatgagctatgaccacactagtgcactccagcctgagtgacagtgagacctgtcacacacacaaaaaaaaactgaatacatgacagcaaacatgaaaactcataaaagatttggcagaagttatagaaacctactaaaagtaaaataatcaaagagatggaaaactgcagaggagaaaacgaaaactgggaatcaatccaagagctccaattcccaataataaagagttccagaaaaagggaacagagaagaaaacagaatagaacagagaacaggaaagtgacccctttccctaagctgtaaggcatgagtctaagatgaaaagacccactgaggaggcagtgcaatggttcaaaagatacgcaaaatttccaggaagaaaacaagttatgttcaaagaatcaaaaattatgtcaccagcaacactggtgttggagtaaaaatggagtaagcttaaccttcaaaattatgggaaaaacttatttctagcttatgattctaaaaccagccaaacttatgtgcaaaggtaaaataaggacacttcagacatgcaaacaaggaaacacaaacctttgtctcctatgttccttttccacataagtggggcagtactcgactaaaatgaaggaataaaacaaaacaggaaagatataaaaaccaaacaccagaggttccaacgcaaggagacacaggtgagagtgactgattctcccacactgatggtgaacggggaagctggcccagcagcactgacaggtgaggaccaccaggggcgtctgggaaaggaggggccaaagaactctgactgatagagatctgtaactgaggggacatcaggaaagagacttctaggtacttaaaaagaaaagatatatatgaatctacaggattcacaccaaattggaaaacggcttggcaatttcttaaaaaattaaacatggctcggcacggtggctcacgtctgtaatcccagaactttgggagaccgaggcaggcgatcgcttaaggtcaagagttcgagactagcctggccaacatggtgaaaccctgtctctactaaaaaatacaaaaattagctgggtgtggtggcatgcacctgtaatcccggctactcaggaggctgaggcagaagaatcgattgagcctaggaggttgcagtgagccgagatcgcgccactccactccagcctgggccacagagcaagatgaaaaaaaaaaaaaaaaagtgaaaacacaatgttgtgccaacaaaaaggaaacggagtgctcctgcatggcccagctaggagcagcactgaaagcaggcaagacctcacagagcacagggcccagactcacccaccaggcttagggaagaatcagcagagaatgcctaaaaccacggaatttaaagacacacagataaataccaaatgaaacagctaaaacaatgtttgccttgaaaattagaggggttcatagggtttgctattaaaaaaaagacttacagaatcatttgaatattcaaattgtatgcataagtaacttgaataaagataaaactaaaaatttgaagtagacaatcaaaatcagttcctctacagatctgggatgccccgccccaccttttttttacatcggagctgccgctgaggcatctactgctctgattcctgatccttttattgtgacccaggtttcccgctacaggggttgatgtcctctgcattaccaacgtgctgcagctgcacaaggaggtaattgatacaggcctttttaaaattattgtgccagtcccttccaatccaaggatacaatctttcatttctgggaaattttcttatataacttctttgctaattccctcctcccccatctcctctattttcttttaaggaatttgtattaatcagatattggattttctgaactcatttttaaccacttaagagtgtacagttgggctgggtgcagtggctcacgcctgtaatcccagcactttgggaggctgaggcaggcagatcacaaggtcaggagatcgagaccatcctggctaacacagtgaaaccccatctctactaaaaatacaaaaaattagtcgggcatggtgaaaattagccgggcgtggtggtggacgcctgtagtcccagctacttgggaggctgaggcaggacaatggcgtgaacccgggaggcagagcttgcagtgagccgagatcgtgccactgcactccagcctgggccacagagcaagactctgtctcaaaaaaaaaaaaagagtgtacagttaagtggcattattaagtaccttcacattagttccataacaaccatcaccaccatccatctccagaacttttcatcttaccaaacaaactccgtatccattaaacattacctcccaatttttctctcctcccagcccctggcaaccacaattctacttcctgtatctatgcatttgagtatcttgatagcacatctaaatggaaacatacagtatttgttattttgtgacaggcttatttcactgagcatatcctcaaagtccatccatgctgtagcatgtgtcagaattccttcctttttaaggtaaaccatattccactggatggatagactaccttgttgttgatccattcatctgtgatggacacttgggttgcttccaccttttggctactatgagtaatgctgctatgaacttgggtgtacaaatctctcttcaagtctctgcttccaattctttggagtcgaactgctaagttgtatgataattctacttttattttttgagacagagtcttgctctgtcgcccaagctggagtgcagtggcatgatctcagctcactgcaacctccgtctcccaggctcaagcaactctcctgcctcagtctccccagtagctgaaattaacaggcgtgcgccatgacgcccagctaatttttgtatttttattttatttattttttaaagttcactttattttttgggggggaaggagtcttgtcctgtcacccagactggagtgcagtggcatgatctcagctcactgcaactttcgcctcctgggttcaagtgattctcctgcctcagcctcccaagtagctgggattacaggcatgcatcaccatactcggctaatttttttttatatttttggtagagacggggtttcaccatgttggccaggctgctctagaactcctgacctcaagtgatccgcccgcctcggcctcccaaagtgctgggattacaggcgtgagccaccgcgcccggcaggtaattctacttttaatttgggtggcactgtcatactgttttagtagctgcaccagttcccattcctaacaacaccgcagagggattccactttttctaaatcctcgtcaacacttgtcatttcctgttcaacagcaaacatctaatggctgtgagctatttcactgctgttttgatttgcatttctctaatcattaatgtgcttatcagtcatttgtttatcttctttggagaaatgtctactcaagtcctttgcacattttttttttttttttttttttttgagatggagtctcgctctctctcccagtctggagtgcagtggtgtgatctcggctcactgcaagctccacctccaggattcatgccattctcctgcctcagcctcccgagtagctggaactaaggcgcccgccaccacacctggctaattttttgtgttttttagtagagacggggtttcaccgtgttagccaggatggtctcgatctcctgaccttgtgatccgccggcctcccaaagtgctgtgattacaggcgtgagccgccgcacccagtcctttgcacattttttaaccaggatatttattattattgagctgtgggaattctttttatattttaaatattaacccttaccagatatgagtttcaaatgttttccattctgtaggctgccttttcactctgttgagtgcttcttttaattaatagaagttttaaattttgacgtagcttaatttatctattgtttcttttgttgcctgtgatttaagtgtcttatgtaagaaatcattgccaaatccagtgtcacgaagactttattatgtttttctaagaattttatagtttaaggtcttaaatttaagcctgatccattttgggttaagttttgtatatcattagctaagggtctaactttattcttttgatttgtatgtccagttttcctagcaccattcattctgaaaagacactttttccctcactgaatggtaatggcatccttgtggaaaataatttgaccactgtatgcaaggacttattgctaaggctctgtattctattccattggtctatatgtctgtctttataccaatactacaatgtttggattactgcagctttgtaataaggtttaaagtcaggaattatgaggatttcatatttcttcttctttttcaagactgttctggctctttggagtctgctgagattctatgaacattaggataaatttttctacttcagcaaaaaaaacttgttggcattttaatagggattgaatctgtagattgctttaggtaatagtcacatcttacgttttacagtccatgagcatggaacatctctcaatttatttttgtcttttttttttttttgagacagtgtctcactctgtcacccaggctggagtgcagtggtgcgatctcagcttactgcaatcttcacgttctgggttcaagcaattctcctgcctcagcctcctgagtagctgggactacaggtgcacctcaccacacccagctaagttttgtatttttcaccaagacaaggttttgccatgttggccaggctggtcctgaactcctgacctcaagtgatccacccgccttggcctcccaaaatgctgggattacaggtgtgagctaccacacccagtgtcttctttaatttcttttaacattttgtagttgtcagtgttttcagtctttcatgtgtacttaagaatattctttagtacagacagacccccaacttatgatagtttgactaaaaaatttttcgactttacaataggtttaagacataaatctgttataagttgaggaatatctgtattttattctttgtactattactgtaaatggaattattttcttaatttcctcttcagatagctgagttagtgtacataaatataaatacaactgattttgtgttttgactttgtgccctgcaattttgctgaattcatttattagttctaaccatgtttctgtgaaatctttaaggtttttatatataaaatcatgtcgtcacacatacaaacagggataactttacttctccctttccaattttgatggctttctcttcttgattaattactgtgggcaattaacttcaatactatggtgaataagtggtgaaagcagacatccttgtcttgtctctgatcttagaggaaaagctttcagtctttgaccactgactgattttagtttgctgagacatccttgcattacatttggtccaagccttttgacagactgctaaacttggttaacttggttttgctagtattttgttgaggattttgtatcaatattcacaaaggatattggtctgtaattttctagtagtattactgtctggctttggtatcagggcatgttagagtcacagaatgaattcacttgagaaggactgatgttaattcttctttaaacgtttggagaattcatcagtgaagccatgtggttcaggacttttctttgttgagaggtttttgattactgattcaatctccttattaattatagtcctattcagattttctatttcctcatgattcagtcttggcaggttgtatgtttctaggaatgtgtccgcttcatttaggttaagcaatttgttaatgtacaattcttaacagtattctcttataatcctggcatcaagtaatcctcccaccttgaactcccaaagcactgagatgacagatatgagcccagcccaaaatccaaaactcttgagtgccaacgttgtactcaaaggaaatgctcactggagtgttcaactggtaagtataatgtaaatattccaaaatcagaaaaaaatccaaaatccaaaacacttctggtcccaaacatttcagttaagggatactcaatctgtattttgaatgtggctttttcttgattaggcattttcttagctgggctaagaaacctctgactgttttccagagcttctataaagttattccatctagtccctagttgcttattaatgttttctatggtggaacgagaacctggagcttcctggactgccattttaccaatgtcagaatacatttttttaagttttattacatgaataaagtaactgctaattgagggattactgtgtgctacattcttgtctaatccctttatatgtagcatgtaatgtaatcctcacaacaaccccaagtgacaggcactattattttctccattttatggatgcaatttgcccaaaggatcacagccagtaagtggtgaaagcaggggagcagccccagtccctggctcaagcccccacatttaaccacgatatgacatacagcagagctggctgcctcaggccactttgctgtggcccttctggtctggtgtgctttgttcagactctggcgaatatccacagtggatgttttcttctagatctggtcagcactggttgtctttcatcataagaggaaggtgacccagctagccagaggctctagtgagcctagtgggctagacgcttgtcagggaccacggtgggagagctagtctttcagttggaaaccttccattatgttgacacttttctacctcttgtatgaagtgccagtgtctctagaaaagactcctccaatctcctgtctgggaaaacacctggctgctgacatctggagagcagggcagaagacaggcctgagcatcctacttattacctacttgtcactacagagaatttctcttaattcctctattttcaacctccacgactcccctctgttgtacctggtgtcacttattttgcagactttaagtgctgtctaatagaaacacaatgcaaaccacatttcaacaagtagaaacaaacatgaaattaattttaatactttatctaacccaatatattcaaaatactattactgcaacatggaaacaatataaagaagtattcatgggatgttttacattctttttttgtactaggtctttcctatttggtgtgtattttacacctgctgcacatcttccttcaaaacagccacatgtgactcatggctactacactggacagtgttggtctagaaaatcaactcctgcggggcacagtggctcatgcctgtaatcccagcactttgggaggctgggggcaggattgctagagccccggagttcaagaccagcctcagcaacagggcgagacctcgtctctacaaaaaatttaaaaattagctgggcatggtggtacacgcctgtagtctcagctactcaggaggctgaggtgggaggatcgcttgagtccaggggtttgaggttgcattcagctgtggtttcaccactgtactccaatgggcaacagagcaagactctgtctcaaaaaaaagaaatgaaaccccacatcttatggtagcagaaagagtcacccagtgatggaaagtgaagaagggaatgcgagtgccaagagaattccaccaatccctatcccactcccatgcctatgcctgatgcctgccacccttggcactcagagccttcaagcgctgagcctttctgggaggctgctgggcaaactgcttatttcttgttgttctcactcaagcaggcccatggttgcagctgctctgctacaccaggtcagtttaactctcccattggcttttctttggaaaggaaaaaagctgtataatatgtgaaacatttcaaagaatgtatgtagcacacatgtaagattcataagcctaataatatagttgtgagcgacctccccacaccccatttaggaaatcaagcattattttgcttctcccagtcttatatccctctgtctctccaccaggaactagaattttgtgtatcactgcgcttatttttttcttttagtttaccacatgtgtatgtatctataagtaatataacgatctgttttgcttctctatattgtgccatatgtcgtttttagcaacttgcttttagctgacgttctgttttcaagattcatccatgttgctgcataaacctaacattcacttactgttgctggtgtataacattccatcatgtgagcacagacatttgggttgtttccaagacatgtatcaatggcaaaaattaagatgtctgacaaaaccaagagttggagaggatgtggatggcttggaattttatctgctcctttacacccactctggaaaaactgtacaaacaattctgcaaggatttttccagagtttccctaaatagaaatcctggatcacaggaaataagaatgttcagctttgcaagataatgtctctattccagagtgggtgtaaagaagcacataaaatttccacactatccatatcttctccaacattttaatttttgccagtctaagcatctgtaaagtggtatctcactgtatgtagtcttagaatactaacgaggttaaatttaaatgtctttttctatgtttaatcaccatctacgaaatgctttataggagttctttatatacactgaattagaatccttatcctttacaggctgtaagtgttgcaaatatcttctctctactctagcttgtcttttcacagtctttactggtgttttttggggttttttttgtttttttttttttgaaacagggtctcactctgatgtccagtggtgtaatctcggctcactgcagccttgacctcagggacccaggtgaatcttcccaccttagcctactgagaagctgggactacaagtgtgtaccaccacatctggctaattatttctttttttttttttttttttttttcatagagacaggatttcaccacgttgccctggctggtctggaactcttgggctctggcaatctgcccaccttggtctcccaaagtgctgggattcctggcataagcacctggcctattggtgtctttcaataaacgagagatcttaattttaatctagcaaattcagtcatttttattttagagtgaatattttatgtgattaagaaaaaggtggccagaggctaggtatggtggctcatgcacctgtaatcccagcactttgggaagccgaggcaggcagatcgcctgagatcaggggttcgagcccagcccggccaacatggcaaaaccccgtctctactaaaaatacaaaaattagacgagcgtggtggcagatgcctgtaatcccagctactcgggaggctgaggcaggagaatcacttgaacccaggaggtggaggttgcagtgagctgagatcgcaccactgcactccagcctccagcctgggtgacagagcgaaactccatctccaaaaaaaaacagaaaaaaaaagaaagaaagaaagaaaagaaaaaggtggctgggcgcagtggctcatgcccccgtaatccaggcactctgggaagccgaagcaggcagactgcttaaactcgtgagttagagaccagcctgggcaacgtggcgaaacaccgattctacgaaaacatgcaattagccgggcatggtggtgcacgcttgtagtcctagctactccggagactgaggtaggaggatggcttgagcccaggaggcggaggttgcagtgatacaagaacgtgtcactgcactccagcctgggtgacagagccagaccttgtctcaaaaaaaaaaaaaaagaaaaagaaaaaggcacacttccctatcaaggtcttaaagatagtctcctataatttatccaaaactgaatttcctgtatgttgtgagttagggatccaactgcatccttctccgactgtcacagcactgtgtttgaagagtctgccctttgcacagcgatatgtaattccacctctggaattcaagcttcttaggtctgtttctgacagcttctgtctcactggccaatttggatttccctgagccaattttgaagtaaatcttgatacgggcaaggcaagtgctccctcctcattcctcttcttcacaacgacctctcaatactacgacttaattcttctcaacattttagaatcgacttatcgcatttcacataaaactcacggagctttaaagatgcactgaatccacagaacaatatgagtttttaaaagattcggtcttcctaggcaagaacattctgccactatttacttgtcttctttaatgtctcttaataaaactgcaaatttttctccctcaaaaattttacacatcttttgttaattctcgtttatatcaaagatggttcccctctccctctccctctcccccctccccctccccctctccctctccccacggtctccctctccctctctttccacggtctccctctgatgccgagctgaagctggactgtactgctgccatctcggctcactgcaacctccctgcctgattctcctgcctcagcctgccgagtgcctgcgattgcaggcgcgcgccgccatgcctgactggttttcatattttttttggtggagacggggttttgctgtgttggccgggctagtctccagctcctaaccttgagtgatccgccagcctcggcctcccgaggtgccgggattgcagacggagtctcgttcactcagtgctcaatgttgcccaggccgaagtgcagtggcgtgatctcggctcgctacaacctccacctcccagccgcctgccttggcctcccaaagtgccgagattgcagcctctgcccggccaccaccccgtctgggaagtgaggagtgtctctgcctggccgcccgtcatctgggatgtgaggagcccctctgaccggccgcccagtctgggaagtgaggagcgcctcttccctgtcgccatcccatctaggaagtgaggagtgtctctgcccggccgcccatcatctgagatatggggagcgcctctgccccgccgccccgtctgggatgtgaagagcacctctgcccggccacgaccccgtctgggaggtgaggagcgtctccgccgggccaccccgtctgagaagtgaggagcccctccgcccggcagccgccccgtctgagaagtgaggggcccctttgcccgggagccgccccgtctgagaagtgaggagcccctccgcccggcagccgccccgtctgagaagtgaggagcccctccgcccggcagccaccccgtctgagaagtgaggagcccctccgcccggcagccgccccgtctgggaagtgaggagcgtctccgcccggcagccaccccatccgggagggaggtgggggtcagcccccgcccggccagctgccccgtccgggagggaggtggggggtcagcccccgcccggccagccgccccgtccgggagggaggtggggggtcagcccccgcccggccagccgccccgtccgggaaggaggtgggggggcgcctccgcccggccagccgccccgtccgggaggtggggggcgcctctgcccagccgccccttctgggaagtgaggagcccctctgcccggccaccaccccatctgggaggtgtacccaacagctcattgagaacgggccatgatgacaatggtggttttgtggaatagaaaagggggaaacgtggggaaaagattgagaaatcggatggttgctgtgtctgtgcagaaagaagtagacatgggagacttttcattttgttctgtactaagaaaaattctcctgccttggaaaaaaaaaaaaaaacaaagatggttccactgggaaaacagaaaccatgctaagggatttctaacacgaagggtttaatacagaaaataggtgctttcaaaacaactggcaaggctatatagtgtgagcaaaagtaaagtgggctaactccccatctaattcccacagtcattgtcaagagtcaggaagctactactgccatctataggttaggaaactgcaaaaatctgctgccaatactgcagctgctctgcagccctgagacagctggccagtgggggaaggcagaagccactgcaaaaagtcacctcaaaaatctaagcccatgcacacccccaacatacactatggcctgaggaagaaaggttccacctcccttccacttgccacatttcccaagacacatgtcatagggcaaatgacacacagaagcctgctgccaggtggttctgagtgctactgctccagcattccagcctctgaaacccacggacaagcccagaagggagtgagtgggaaggtactgaatgcccaggctgtacctagcatgtcatttccctcttttcaaaaacatgcagaaattactgatctactgttacatctttcccctttttttgtccctttggttttacattttttatactcctttttagcaggcttttagcagggcaatgaagtaaccccataaggtaactccagaagtcctgaagtctagttcaaaagcaacttgactgagaatggcccagggcttccctaggggttactgaaactctcctcatacaaaggaaggtcacagcttttgagcaagggtggttattagctaactctctacttcccccacaaacacaaagagtttccttttttgagaggggaggaggttgggggaagggagagtgtcaatgaggacttgactctatatctatgattttttaaaaatttcttttaaaataaactagaaaaaaaatcacaagatttagcagtcattaattcaaggaagtaagaaaatacgtattacacattctttgtacatttttatgacttaatttgctcagaatctcaactttaagaacaattagaaatcaacctgcttggccgggcacagtgactcacgcctgtaatcccagcactttgggaggccgaggagagcggatcacaaggtcaggagatcgagacgatcctgactagcacggtgaaaccctgtctctactaaaaatacaaaaaaaattagccgggtgtggtagcaggcgcctgtaatcccagctactcaggaggctgaggcaggagaatggcatgaacccgggaggcagagcttgcagtgagcccagatggcgccactgcactccagcctgggcaacaaagcgagactccatctcaaataaaaaaaaaagaaatcaatctgctcaccctccagactgtgacacagcactatacaaggacaatcataggaccgtgagtcaaggagaagcagggtgagccttgtcagggcagtggcctcctcagcccacccagaacactcctaggccctaccaagcctcagggggcttgcacacacgggtcctcattgtcatgccttcactgctcagccctggtgcaggccaccactcgtaactttcggcttctatgagagattttatttttctgtctagggaaaacatatggcaaccaatgtaacttcaagccaatactcaagtgcaaagttgatgcctgctccatgccaggccatgtggtcaagagaaataaaacctactccttgccttcaacaagtcttcagagcgtggaaagatgaacaaggtggcaactatgagtgtggataccactatgttcagcgtgtgtaacaggacagttattacaaacaactacaaaagcaaagccaaatggcactttgagaacaacaaataaactctgcttccatttgaaagcaaaccaagaatcatctggttctctcttcaggaattctccaagaggctggatataaggtctcactctatgagtcagacaaggggaggctcccactcataaccacatggtcgtccccaggctgaccaaccagggaacttcagcagcccaagcactgggaagcccactgggaatccactttctctgggctttgaccccaaagacccaccagagaggctcccagacaaaggactgtcccagaggctcctgaccgggccaacaccatccaaaccctcatttggaaaggcaaacacctctaccagagacacgcataatctgatgaagaatgggctccagagatgatcaggaggggccccctctaaacagcattcttttctttttttttgaaacagaatctcactctgtcgcccaggctggagcgcactggcatgatctcagctcactgcaacctctacctcctggattcaagtgattctcctgcctcagctgggattacaggtgctcgccaccacgcccagctaatttttgtatttttagtagagatgagatttcacgatgtcagccagactggtctgaaactcctgaccttaagtgatcctgcctgcctcggcctccaaaagtgttgggattataaggcatgagccactgcacctggcttttttttttttttttttgcctttgagacagagtcttgttctgcagcccaggataaagtgcagtggcacaatcttgactcactgcaatctcctcctcccaggttcaagcaattcttgtgcctcagcctcctgagtagctgggattataggtgtgcagcaccacacctggccaatttttgtatttttattagaaacggggtttcactatgttggccaagctgatctcaaactcctggcctaaagcgatccacccacctcagcctcccaaagtgttgggttacaggtgtgagccttcgcaccctgcctaaacagcattctttacaggcaaatacaatctgaccagaccatctctgcttcttattttggaaccccccctcaaagaactaccacaagttcaaatgtcacctaatcccctacctaataccctggttggaatgaattggttttccttcagtactaagcctataggaattacagcacacctttcatgtcctaggccaagtcccactaaggaaggagaaaggtctctgccccctgggaactcatggtctggatggaaaaatcaagcctgggcaccaggaatggtgagaattaccaatggttctgatgctataagagagggacgaatgggggactggaagaagccaatctataaaatgagggaccacagacattctcccactggggtaacatctgagctacaccttgaaggatggtaaggcttgtctatgcagaaacagaacaagagaattccaggaaaacataaaggaagcacacatctacaagattattaatggggtgggcacaagaaacagcccagctgagccactgaaggggaagtagtgataaatcaggttggcaaagcagacctaaaccagcttgtgaaggagtctgcatgtctggccaaagcatttaagcctgtgattctcaagctggggtaagacacactttccccttagtggctttatcagcaccacctagtcttaaaaacgaattcatggatacatgtatatgtatgtctcacacattcacacacacatgcacaagtactcactacacctcccacccaaccaaagttgagaacaacggatccagtgaacattgttattcatggggtgccctgtattccttgagggtgctgaggcagaaaccaggtgaagaacctggttctccgatttagcctttttgtggcctttccatacatctttaggagactacataatggccaggagagaacctgtgagtgcaaagttccaggtgaatgagtgagcaggaggggagggcgtgccaaggccagtctaaaagagcacattcaggatcaagaggcacccacatccagagccaggatggggataaggtcagagaggtggccaaggtgccacccctcaggaggggttcacactcaagatcatccaagtccagggagtgcagcgcctccttaagtggagcctcctgggcatctcacgggcctccccacagccctgccatcttgcaagttctgggatctgcctaggttgggcacttattttttaaaaagacagaaagacagagagagaggaaggggtcggctcaaactaactttccaatgtgttaagacagcacacacctccacccctcacaagaggcacagtcacccagctacaacaaagagacaaggtggtgtgtaccccgcctactcaacacactcacctggacagttggcttcgtcgctctcatcctcgcaagtcgcccagccgtcacactgccaggggagggggatgcactggatggtgccgctgcgacacgcaaactgcccagggttgcaccgcagctctgtgggaccaaagggtgagaggccattgaggaagtggcagtaggccagcaaaccatagcccatgggctggatcaatctcttcccatttgtttgtttgtttgtttttgagacagagtctcattctgtcacccaggctggagtgccagtggtgcagtctcagctcactgcaaccttcaccttccgtgttcaagcaattcttgtccctcagcctcctgagtagctggaattacaagcatgtgtcatcatgcctagctaatttttatatttttagtagagacggggttttgccatgttggccaggctggtcttgaactcctggcctcaagtgatctgcctgcctcggcctcccgaagtgccaggattacaggcatgtaccactgtgcctggcccccatctgtttttaaaatcaggttttatcagaacacagccacaaatatgtattgtctatggctgctttcaagctacagcagccgagctgagtagctgcagaaaagactatatggcctgcaaagctgaaaacatttaatgcctggccctttacgaacctattacctagagataaaaactgtaacacttaagatgaaaagtacgctgcagaacattaacaggttagattttgtagtagaaaagattagtgacttgaagatataataatagaaacactctgaactaaaacacagaatgaaaaaataccaggaaaaaatgtgcaaatcatcagtaagctgtggaacaacctcacacaccctaatacatgggggaacagacacaacatctgaagaaacaatggggaaaatttcccaatttgatgaaaactataaacccacaaatccaggtagctcaatgaaccacaagcaccagaaatacaaacaatacaattccaagtcacattggaattgatttgcttaaaatcagcgataaaatcctaaaagcaggcagaaaaagaagacatgcacagaaaaacaaagatctagatgacagcagatttctcattagaaacgatacagcctagaagacagtgatgtgacatgttaaagttctgaaagaaaaagctgttgacctacaattatttaaagcaaacacacagatactgtattgtgcagtttatagcatacacagaagtaaaattttgacaatagtagcaccaaaggtgggaagagagaaacagaagcacactgttttaaggctctcaaactacaggtaaagtggtccatcacttgaaggtagtctatgataagttaatgatgaacccgactaaaataacacaagagttgtggcaagtaagccaacatagaagagaataaaaaataatccaaaagaaggaaaaaaaaaagacaaacagatggtacaaatgaaaacaaagggtaatatggtagattttaattaaacttgcctaatcaataaatacgcagaacgatctaaacactccaactgaaaggcagaatttgtcatgtagggaaaaaatcaagatacaactacatattacctaaaacaaactcactttatataggcataaataagagaaaataaaagaataaaaaagatataccatgttaacactaatcaaaggatagctggaagggcaggtacatggctcattcctgtcatctccataatcccagcattttgggaggctgatgcagaaggatcacttgagcccaggagttcaggaccagcctgagcaacatggcaaaatgccatctctctaaaaatacaaaaaattagccgggtattgggacaaacgcctatagtcccagctactcgagaggctgaggtgggaggatcacctgagcctggaaagttaaggctgcagtgagctataatcgtgctactgcactacagcctgggcaacaggagtgagactctgtctcaaaaaaaggctagctggagtgtattaatatcacacaaagtagacttcagtgcaaatattaccaggaataaagaaggtcatttaataatgataaagggattgattcaagaggacataatcctaaatgtttatgtatctattaaaatttacaaaagaaacttcaaaattcatgaaacagaaactactgtaactgctaatagacgaatccacaattaaagtcagagcttttaataaccctcttgatagaccaagcagatagaaaaccagcaagggctgggcgtggtggctcatgcctgtaatcccagcattctgggaggctgaggcaggcagatcacttgaggtcaggagttcgagaccagcctggccaacatggtgaatggacaggagttcgagaccagcctggccaacatggtgaatactaaaatacaaaaattagttgggtgtggtgatgcacgcctgtaatcccagcaacgtgggaggctgaggcaggagaatcgcttgaacctgaaaaaaaaggaaattacaaaagaagagcaaatgaaacccagcagtaagaaataataaagatgagagtggacattactgaaattgaaaacagaaaaatagagaaaataagaaaaacaaaagttgtttttttgagatcagtaatattaataaacctctagacagtctgatcagcaaaaaaaaataaagaatacaaaataccaggccaggcatggtggctcacacctgtaatcccaacactttgggagatgatccagcagatcatctgaggtcaggagttcgagaccagcctggccaacatggcgaaaccctgtctactaaaaatacaaaaattagccaggtgtggtggcacatgcctgtggtcccagctactcaggaggctaaggcaggagaatcgcttgaacctgggaggcagaggttacaggaagccaagattacacaactgcactgcagcctgggcgacagaacgagactccatcttaaaaaaaaaaaaatactactatcagaagagagatgtcatcactgtggattccagagaaagtataaaggctaacagaggagtgaagaataaggtaatagtatgaaaaactttatgtcaataaatctgacaatttggatgaaatacacaaattctttgaaagatgaaatgcaaagttcactccaaaataaataaacaatctgaacagccctaaaaggaattgaatttttagttaaaaatcttcaaaggaaactccaggcacaaatagcttcaatggaaaattcctccaaatatttaaggaagaattgatgtcaattctatacaaactctactgtaagttcaggtatttaaaaattaccattaacaatagtatcaaaaaataagaaatacttaggtataaatctaacaaaagatgtgaagtcctgtacactgaaaaattttcaacattgctgagaaaaaacattttttaaagacctaggtgcaaaggcagctccctgaagaaagaacaggcctttcaacagaatggtactgcgaaacacggaagaaagaaaaatgaagaggaggaggaggaggaaagaaaggaagaaggaaggaaggagttcatctacaaaatgaagttaaaaaaaggaggaggaagaggaggaagaaagaagagaagaaggaggaggaggaggaagaaagaggaacaaagaacaactactttgatccattccttgaaccgcataaaaaattcagaatagccaggcccagtggctcatgcctgtaatcccagcactttcggagcctgaggcgggtagatcacctgaggtcgggagctccgaaccagcctgaccaacaaggtgaaaccctgtctctactaaaaatacaaaattagccaggcatggtggtgcatgcctgtaatcccagctactcgggaggctgaggcaggagaatcgcttgaatctgggaggcggaggttgtggtgagccgagatagtgccattgcactccagcctgggcaacaagagtgaaactccacctcgaaaaaaaaaaaaaaaaatcaaaatcgatcataggcctacaggtgaagcctaaaactataaaactcaagagaagaaaacacaagaagaaaatcttcgcacccttggtttaagcaaatacctttaatatatctaccaaaaacacaatctataaaaaaaattgataaattggacttcatcaaaattgagaacttttgtttttcaaaagacatgttaagataatgcatagacaaaccacacacagagagaaaacatttgcaaatcatgtatctgataaagggcttgcttgtaaccagaatatataaagcatgctcaaatttcaataagaaaacaacccaattttttaaatgggcatgggccaagtgcaatggcttatacctgtaatcccaacactttaggaggccaaggtgggagcaacacttgagcccaggagttcaaaaccagcctgtgcaacataacaagacctcatctctacattacaaaaaaaaaacaaaaaaattagctgggcttggtgacacatgcctgtagtcccagctactcaggaggctgaggcaagaggactgcctaagcctaggagttggaggctgtggtgaactaggattgcaatgctgcactccagcttaggcaacagcaagacctccccaactctaaaaaaaaataataaataaaataggcaaaagatcttaatggtcacttaaccaaggaagatatatacagatggctagcaagcacatgaaaagatgctcaacgtctagtcattaaggaaatgcaaattaaagcatgaaaaggtggggcacggcggcccatgcctgtgatcccaacactttgggaggctgaggtgggtggatcacctgaggttaagagtttgagaccagcctggccaacatgatgaaaccccatctctaccaaaaacgcaaaaattagatgggtgcggtggcgggcgcctgtaatcccagctattcaggaggctgaggcagaattgcttgaacccaggagacagaggttgcagtgagccaagattgcaccactgcactccagtctgggcgacagaatgagactccgtctcaacaaacaaaaacaaaaacaaaaaaccatgaagagaaaccacttactagaatggctaaaatgaaaaagaatgaccataccaagtggtggcaagtgtgtgaagcaactggaactctcccagtgaaaatgtaaatggtacaacttctttggaaaacaatttgacagtttctttaaaaactgaatgtatacctaccatataatctgaccattccattcctaggtatttaaccaagagaaatgaaagcatatgtccacacaaagacttgttcatagtacttttatttgtaatatccaaaagctggaaacaaacagtgtctatcaagaagcaaattggtaagttgtgtacagccatacaatggaatactactcagcaataaaaaggaataagctattaacacattccgcagcatggatgaatctcaaaataattatattgagtgaagaagccagtatgtactcaaaagaatacctactgtatgacaacatttatataaaaatctaaaaaatgcacttgcagctatcaagacagaaagggatgggggtgggagggattacaaaggagcacgagaaaatgtttggggtgacgatacgctgtgtttgttatcttgactgtggtgacggtttcacagatttatacatatatgaaaactcaaatttggccgtgtgcagaggctcacgcctataatcccagcactttgggaggctgaggtgaatggatcacctgaggtcgggagttcgagaccagcctgaccaacatggaaaaaccccatctctactaaaaatacaaaattagccaggcgtggtggtgcatgcctataatcccagctattcaggaggctgaggcaggagaatcgcttgaacttgggaggcagaggttgcagtgagtcgaaatcacgccactgctcttcagcctaggcaacaagagcaaaattctgtctcaaaaaaacaaaaaacttggccaggcgcggtggctcacacctgtaatcccagcactttgggagaccgaggcaggcaaatcatgaagtcaggagatgaagaccatcctggctaacacggtgaaaccccgtctctactgaaaatacaaaaaattagccgggcgtggtggcgggcgcctgtagtcccagctactcgggaggctgaggcagaagaatggcgtgaacccaggaagcagagctggcagtgagcccagatcgcgccactgccctccagcctgggcaacagcgcaagactccgtctcaaaaaaaaaaaaaaaaacaactcaaattttacactttatgtatcatttattataagtcaattatacctcaataaggctttttttaactatcatgaaatagatttctgtttaaaaaatcaggaaacaattttgagatcaaaagatactgaccacaaggctaaaaatccaggcaccctgtgttctaggactagatatgcctggaactgaagaactaaattgaatcatggcccacctaacgtgcttgcttctctggaaaagacagccttggcctaccagatctcacccccgccatccatacaggagctaggtccttttcataattataaatccagggcttgccccatgactggtactgaagcactatttgatgagtaaatcagcaattgggacatgctcttctggcctaatgtctgtcttcctcagccacaattaaccattagaccaagaacctggaaccctccattcctcctcagtgtattctaggtcttcagttttattaaaaatttctaacttcttattattttgccataaaaatggaacatgaatggaactggaggacattatgttaagtgaaataagccaggcacagaaagacaaacttcacatgttctcattcatatgtgggagcttaaaaaaagttaaactcatggagctagagagtggagtagtggttaccagaggctgggaaaggcagaggtgagaaaaagaggttggttaataggtacaaaaacacagttaactatagttaataatggtttattctatacttcaaaataactaaatgagtagaatcagaatgttcctaacacaagaaaagttacaaatgcttgaagtgacagataccccaattaccatgatttgatcattacacattctatgcttgtatcaaaatatcatatataccccacacatgtaactactgtgtccataaagttaacaaaaaatttttttaaagactaatgcaggaaaaaggaaaaaaaaagccttctaatttcccaaactatactgagaaagagttcattcactgaatagagatttagcaacagaacattcttttttattttttagagatggggtcttactatgttgcccaggccagagtgcagtggtggctattcacaggcacaatcatggtgcctcaaagtcaaatgactctcccacctcagactacaggcctgagctaccccgcccagcagaatattttaacagtgtccattctattaaaaaaaaaaacaaaaaaaaaaaacaccctatggtgttgttcaaagtaaattcatagctcatgtcacagccctccaaatctacgccctaacatatcataccctaggcccagaaaaacttcaatgcactaccttaaattatttttggaaatagttgagtaagaagtaataagtaacaacactgggggttttctttctccatacccctatatcctccaaaagcaaacgtcagccaagtcttctctggcaaacaaggccccttcccccatgcaccacatccaccttgccttgccttggctgcttctaagtagtacttgtcactcctggcttcctatatatcagtatatagtaaacctatatatatatatacatatatagatatgtaagtgaaacagccaggtgcagtggctcacgcctgtaatcccagcactttgggaagccgaggcgggtggatcacaaggtcaggagttcaagaccagcctggccaagatgttgaaacctcgtctctactaaaaacacaaaaattagccaggtgtggtgcgggtgcctgtaatcccagctactctggaggctgaggcagagaactgctcgaatccgggaggcggaagctgcagtaagctgagattgcaccactgcactccagcctgggcgacagagcaaggctctgtctcgaaaaaaaaagtaaagcttcctgagggcacaggtcatgtctgcactgttcactcctgtgttcccagggcatagccgaccacacttagtgtccataactcaaacacacttgaagaatacttcttctctccatactctatgcatgtctgggaaaggctccaaaggcccaaacagccttcctctttgagaagtgcccatctggccactccatgagtgccacctgccctgccccaggctgggccaatgagaagagtctgtaaggtgatgggagtgggaagatccaggctagccagactgagacagtcacttgaagttctgtgcaccctgaggcagaaagaggtaagggctaagaccagaagggctgagaaaggggagcaacacccttcacagtcccatgaccccaaggatggctgtgcttcctccctgggctcagggaaaagttcctcctacagctactccttacaaccagacagctctggctaaaatagcccccacacggattttctgtccttttctttctttctccagacttttaaaaaaaaaatagttatcaaaagaggaaaaataagctatcagcagaatgactgtcttgctacatcctgaacacagctgggctccccactgctgggccttagtccatggcatcccctctccccaggtctcaagacacaccactctccaggaacccctccccaaactcccctaactgagtcggccttcttggcctagccctgttttcctaagcagcccttctctgttcttttcttcacaccctgagtagggtcagcacacttttccttcaagggccagatgataagtatttccaggtggccagcttcacaggccaccctctctctgccacagctgctcaaccctgctgccgtggagctaaagcagctgcagataatatgggaatgcgtgggcataggcatgtccaataaagctttagcgaaaaacaaaaaaaaacagtggccagttgcaggtatagtttgccaaaccctgttctcgagtatacatatagggacattttacatacatgtaaatgttttgttttttgagacagggtctcgctctgtcacccaggctggaatgcagcggcatgaccacagattactgcagcgtagacaccctgggctccagtgatcctcttgccccagactcccaagtagctgggactacaggcacataccaccatactcagctaattttttattttttatttttagtaaagacaaggtcttgctatgttgcccaggctggtctcgaactcctgagctcaagcaatcttctcaccttatgctctcaaagttttgggattacaggcatgagccactgtgtctggctgagggacacatctttattgctgccccatactccatgtcaccaacaccccacacatggaggcatgcactaaatgcctaatgaactgcacagctcaaaatcttcccatattctgctagcagacaatgaagtgtcagaagttctccaatagggaaggtttttctcccttcttgatccatctgtcaagccgggtctattctggaagcaactgaagatgtggatcactcattaacactggcacctactctgtgccaggcagttctccaggtgacagggctgtggtaatgaacaaagaaagtcaattccaggacatgacagagcttgcatccagcacagcacaccagatggtgactccaacaggtcaaactggcattgctttagctggacatcaacactgcgtttccactgactacgcgtggtgactcacgcctgttaccccaacactttgggaggccaaggcaggtagattacttaagcccaggagttcgagaccagcctggccaacatggtgaaatcccagctctactaaaaatacaaaacataagccagatgtggtggtgtgcatgcctgtagtcccagctactcaggaggctgaggtgggagaatcacctcagcctgagaagtcaagactgcagtgagtcacgatcacaccactgtactccaacctgtctcaaaaaaacaaaacaccaccaccaacaaaaaattgcctgtcctttctcaatatcctccacagtctctctgtaaagcagtaagtgcaacttctgccacatacaaagttgcttaaaaacagtcacccttggccaggcgtggtggctcacgcctgtaatcccagcactttgggaggccaaggcacgtggatcacaaggtcaggagttcaagaccagcctggccaagatggtgaaaccttgactctactaaaaatacaaaaaaattagctgggcatggtggcacatgtctgtaatcccagctactctggaggctgaggcagagaatttcttaaacccaggaggcagaggttgcagtgagccgagattgtaccactgcactccagcctggacgacagagcaagattctgtctttaaaaaaaaaaaagtcacccttgacccagtatggtggctcatgcctataatcccagcactttgggaggccaaggtaggaggatcacttgaggctaggagtttgagaccagcctggacaaggcgaaaccctgtccctactaaaatacaaacattagctggacgtggtggcacacacctgtaatcccagctactcggaaggctgagacacaagaatcgcttgaaccggggaggcgaggttgcagtgagccaagatcacgctactgcactccagcctgtacaacagaacaagactctgtctcaaaaaaaagaaaaagaaagtcaccccttttcactgatggctttacaaggtcctgtcccaggccttctggtgatgactgtcaccttgctgtagcatggcagaggcaggccagctcctcttagccaatggattgttgacactttatgaaacaatccatgcccacaacataccagccacagtaccaacataaggacagccccatcctggctaacatggtgaaaccccgtctctactaaaaacacaaaaaaattagccggacgtggtggtgggtgcctgtggtcccagctactcgggaggctgaggcaggagaatcgcttgaatccgggagacggaggttgcagtgagccaagatcgtgccactgcactccagcctgggcgacagagcgagactccgtttaaaaaaaaaaaaaaacctgccacatcagcagttcctagacttcttcattctaagacaccttaatacacttaaaattattgaagaccccaaagagcttttatttatgtgggttatatctgtcaatatttactgtatcagaaattaaaactgagaaatttggccagacatagtggttcacgtctgtaaccccagcactttgggaggccaaggtggtcggaacacttgaggtcaggagttcaagaccagcctggccaacatgatgaaaccctgtatctaccaaaaaatacaaaaatcagccgggcgtggtggcacgctcctgtagtcccagctactcgggaggctgaagtgggagaaccacttgaacctcggaggtggatggtcctttgcagtgagccgagactgcgccattgtactccagcctgggcatcacagcgaaaccctgtctcaaaaaaaacacttgagaattttttgaacacaagaatctgaagcacctgctcaaaggttttaaccttttaatagaattatcaaatgctcacgattccactcataggcatgtactcaagagaattaaaagcagagactcaaacagatgctggcacaccactgttcccaacagcattattcatactagccaagaggcagagacaacccaagtggccatgacagatgggaggataaataaatgtggtatagctctacaaaagaatattattccaccataaaaacaggaggcatgtagtaccccatgggcaaccaagtaatggtgtattgtgtcgcttcaaaagtaaatgtggggcctggcatggtggctcatgcctgtaatcccagcactttgggaggccgaggtgggcggatcacctgaggtcaagagttcaagaccaccctggccaacacggtgaaaccccgtctctaccaaaagtacaaaagttagctgggcgtggtggcgcacacctgtagttccaactacttgggaggctgaggcacaagaatcacttgaaccagggagatggaggttgcagtgagccaaggtcacgccattgcactccagcctgggcaacaggagcaaaactgttaaaaaaaaaaaaaaaaaaagtgaatgtgggccaggcatggtggctcaccacactcgtcagtaatcctagaactttgggaggccgaggcaggtggattacttgaggccaggagctcaaggtcagcctagccaacatagtgaaactccgtgtctactaaaaatacaaaaattagctgggtatggtggcacacgcctgtaatcccagctacttgggaggctgaggcacaagaattgtttgaacctgggaagcagaggttgcagtgagccgagatcgcatcactatactccagcctgggtgaaagagtgagacaaaaaataaaaaacaaaagtgaatgtgatcagccatcagccataaaaaggaagaaaattctgacacatgctacaacatgaatgaacctggacaacattatgctaagtgaaagaagacagacacaaaagaggcaaatagtatatgatttcactcataagaagtacctacagtagtcaatttaataaggatggaaagtagaatggtggttgccaaggactaggggtgaggagaatagggagtattgtctaatgggtatagtttctgtttggattgacaaaaaagttctggaagtgggtaatggtgctcgttccataacattctgcatgttcttagcactgctgaattaaccgtacacttaaaaatggttaaaatggggccgggcgtggtggctcacgcctgtaatcccagcactttgggaggctgaggtgggtggatcatgaggtcaggcgatcaagaccatcctggctaacacggtgaaatcccatctctactaaaaatacaaaaaattagccgggcatggtggcgggcacctgtagtcccagctactcaggaggctgaggcaggagaatggcgtgaacctgggaggtggagcttgcagtgagccaagactgcaccactgtactccagcctgggtgacagagcgagactccgtctcaaaaaaaaaaaggttaaaatggggctgggcatggtggctaatgcctgtaatcgcagaactttgggaggctgagacaggaagatcgcttgaagccaggagtttgagaccaccccagacaacatagtgagacctcatctccacaaaaaatagaaaaatttgccagacacggtggcatgcacctatggtcctagctactccggaggctgagataggaggatcacttgagcccaggaggtcagggctgcagtgagttatgatttgattgcaccactgcactctagccttgacaacagagtgagaccctgtctctaaaaaagataatatggtaaattttatgttacatatatcttaccacaatttaaaaaagaaatgaaatactaacacatgctataacatggatgaactgcgaaaacataatgctaagtgaaagaagccagacacaaaggacaacatattgtatgattccattagtatgaaatatctagaatgggcaaatctatacagacagaaattgccaaaggctgtgggcaggggaattggggagttactgtttaaaaagtatagagttaccgtttgggatgataaaaaaaaaaaaaagttctggaaatgggtagtggtgctggctgcacaacattctgaatgttcttaatgccactgaattgtgtacttaaaactggtaaattgtatgtgtattttaccacaataaaaaaagttcttttttttttttttttttttttttttttttttgagccggagtctcgctctgtcacccaggctggagtgcagtggcaagatctcggcttactgcaagctccgcctcccgggttcatgcccttctcctgcctcagcctcccgagtagctgagattaggcgcgcaccatcacgcccggctaattttttgtatttttagtggagacagggtttcactgtgttagccaggatggtcttgatctcctgacctcgtgatccacctgcctcggcctcctaaagtgttgggattacaggcgtgagccaccgtgcccggccaaaaaaattcttaaaaaaaaaaaaaaaaaaaaaaaaggccaggtgcggtggctcatgcctataatcccagcactttgagaagccaaggtgggagggtcacttgagtccaagaattcaagaccagcctgggcaacatagccagaccctgactctacaaataaaataaaataaaaattttattttttattttattatgaggtgagagtacctcttgaacccaggagttcaaggttacagtgagctatgacccagccactgcaatccatcctgggcaacacagtgaggcactgttctttcaaaagagagagagaaaaaaagagagaatcccaagcatacatcccattagctgtcagagcaatgatgtcatcacatatcaaatagtgtctggaaatgctaccttatgcttgtgaggatgagagaaaggcaaatgacacctcagtattatcatgaaaacagttttgacctcacggagcccctagaagggtcagggaacccccagagacccctgggcacacttggagagctactgctttgggctatgcaacgcccaggaattagtggattcatgccctgtagaaacccacgagtctctgcaatacaaattctttctctagattcaatttctcctttgtcagcaagccttagccttgtttcaaggctgtctcaaactgagctgtctcaaattactgtgtgaaatttagtatgctgcataaattgtttagaattgatttctcttcaacatttgcccacaaagaacaagagggagacagagtactagcagaagcacacatgtccacagttacatcactaagaaaatcaaaacatttccagcaaagaaatgcaggagaaattccagcccatctgctcgcactactcacagcccactaagataggtctccaccagagcagtctgagacccatcagacacagactcccacacccggggtaggggacacccatgccctgctggagtgcccagaacagaaggttccagcatccctggcaggcctgctcacacctggcagtaaagccttactgcacattctgtcttggaaagagctggcagctgcttcccagtggggctttcccacaggtcatttcaccttccatacaagttgctactaggaaagggagatttgtccagcacacttcaaagcagcagcagcagcagaggggagaaggtttggaagccaagggctggctgggctattgtaacaggcgaccacgcatctccaggagaccagaggtgtggatgctgggttctgccctgggccagccatctcttctccagatgccctcaagaagggacagagggccgggcacggtggctcatgcctgtaatcccagcactttgagaggctaaggcgggtggatcaccggaggccaggaattcaagaccagcctggacagcatggcaaagccccatctctactaaaaatacaaaaattagctgggcgtggtggcgcacacctgtagtctcagctacttgggaggctgaggtggggagaattgcttgaacctgggaggcagaggttgcagtgagccaagatcatacaactgcactccagcctgggtgacagcatgagactccatctcaaaaactaaaaaaatagggaggacagagaccactgttgatagcacaactaaaagacaaaacagagggcatattgctcggtgaccttctaaatggaggggtcacctctgtcctgaggcaagagtgaataataagggccttgaatggggcctcagagatggccagcatctgagccaccaggggccatgggcaggcctctggcaagcacccattctgaacaggtgctgcccagtggggaagggagcgatgcacgctctggaaggcacactgtactccggggccccagagggacttcgggaccagatagcttcatgggatgtgctataactccagaaagggacgcggctggcgatggaggagtgcatcatcagaacaccaacctgcgtcagacagagagcagacctgggagggcagagctaggaagtgaggaaaggcaggacctggcattccaaacagtgcacagaccatcccagaaccaactgtgatcacatcacaaactccctgccttctctacagtgctcaaatgccatctgcccttttatggagtccaagggccacctctaaccttcccgcaaagccccacatccaggttcttgggggtcccggctcaccagtccctgcagctctcccctgaagcccgtctagccccttccccatcgctgccactgccccgtagcaccagcaggccagcacacaacctccccacccctgtagcttcctggaaccacgcagggagactggcttggaaagacgccccagagatccgttgcgagacaaacagcaggcttcagctcctggcccgtgcaaccctgctcagcctcgccaggctgcttcctccatctgtaaagcatggaggtgaccatcctgccctgcctatccctcctgacttccacggaggtgatgaggcccaaaagagaaaattactccaacaatgctcagctgctgaagtttcacatatgccacccttaggaacaatcctgggaggtcctctgcagagataaatgctctgagagggacccacaagggcaaagagaggatgggaggcaggaaccatggccaggggttctgtgcagtttgacctgccactgcgtctcagcagcagggggcagtgaagactgctgatacctggaggcctgagcatcctctgtactggcagccaccaggctacagcaccaacgatgccagcatctgaacctcaagccacaaggagcccagaggccagccggctcctcacccatgagggcccagagttcaaacgggaacaagacatgtgtggctcatggaaaatgatgagattggaagtttcattagcaaaatgtgaaggaaggcccgaagctgttctatgtattgaaacccccaactagtccagccagctagcttctcagaggggctgacccgcctactcagtgtcccacatcaagttggcagcagcagaatgggcatcagaggtcaggctgtgggctctttgacccaaatccccatccctgaagccagcagagcccctgggtggggctctgcattctgactccctagaggaccaggtccaaactttccagttctgagccatttccttcaccgagacagcagtcagcagagcctctgggggctcactgcacaaagcccagggataccagagccccaccaccagtctggtgcagagccaaggatgtaccaacatattgtactttttttccctaccagtggccagttactagaacaaaatattttacacctgcaaacactcctgctgtggttttgaaatatgcctgcaacttctttgatatggctccctaaatggcagtagctccccaaacacataaccaccaaacccatttccaaacagcccccggggcaagtggaatctctgagtgaaggctccaccctcagtcactcctcccctggaccctggagctcctgactccccatcaccaccactggagacaggtggccagctctcctgcaacagtggagagggagtagggttgccaagcgctaggggagtgccagccactttctcccacagcccaaggggtcacaacactgacactggggaacaccacacaagaacaaagggacaaggcctatgcttcagcatttatttctcataaataacaagcattttctacctccaggagaagaagtgatcaccacctgctaccatctatctgtagatgctgtccaaccaaaacactggctcagctgctctgccctgtggcttctccttaggcagatgtttgggaaagaaggccctgtttaaaataagttatcctagaaaagaagggaaggtcctaagaaaaaggaagggatcatataagatgaaagaagagaaaggcaggtccaccaagcatacctattccatgagtgacactttcaagaaaagaacagcaacttgcaatcagtccttatttcatgggggttcgggcaggaggggctacatacttgggaataagaccagggcaggagggtgggacagaactggagcgagagctatctcgcatctgatgtaaacatcagccagcagtttcatccaacactcgcaccacatttcgatcatagccacaggatagcgcagccaatttctctaagagaaagaacagctgtagtcaaatcagattcctgaatgctcattttgcatgtgccaggcagtatatcaagtgcttagaatacattattatgaatccttaagacaactcatttgctccttccatgaacaccgccgtgtacctcctaggggccaggtgttgtacaggacacaagtgagaagagcaggaggagaaccataaggtgtctgcccccacgaagctcagattttactagggaaggagaagaacttcgtaaccttggggtaggcaaggatttattagacaaaaacagaaagcatgaccataacaagaaaaaatgataaatcagacttctttaaaattaaaaaagtctttgatcaaaagcttagtaaagatacacagaccacactgagcacagtagctctcacttgtaatcccaacactttggaaagctgagacaggaggatcacttgagcccaggagttggagaccagcttgggcaacacagggatccagtctctacaaaaattaaaataaaaatattagccacatatgatggtgaacacctgtggtcccagctactcggtgagggtgaggtggcaggatcacttgagccagggaggtcaaggctgcagtgagctgtgatcccaccactgtactccagcctgggcaacagagaatttatctaaaaaaaaaaaaaaaaaaaaaaaaaaaaaaaaaaagatgcacaggccaacagaacagaatagaatacagatctcagaaatagacctacacaaatgtagtcaatggattctgacaaaggtacaaagacaattcaatggagaaggtataacctttcaacaaatggtactagacagttggactccacatatcagaaaatgaacctcacactttgggaggcggaggtgggaggattgcttgagcccaggagctcaagaccagcctgagcaacaaagtgagatctcatctttacaaaaaaaaaaaaaaatcaaaaaattagctgggtgtggtggcatgcatttgtagtgccaactacatgggaggctgaggcaggaggatcacttgaacccaggaggtcaaggtttcagggagttacgattacaccactgcacctcagcctggatgacagagcgaaactgtctcaaaaggaaaagaaaaaaaaaacctccttaatcatcagggaaatgtaagccaaaaccacaataggctatcacctcacccattaggatagccactgtcaaaaacaaacaaacaaacaagtgttggcaatgatgtgaagaaatcagaactcatgtacatcgttggtaggaatgtaaaatggtacagtcactatggaagacagcatggagtttccttaaaaaattaaaaatagaattaccatatgatccagcaattccaattccacttctgggtacatacccaaaattaattgaaggcaaggtctcaaagatatattcatatacctatgctcacagaagtactactcacaataactaagaggtggaagcgacccaggtgtacactaaataaacaaaatgcagtatatgcatacagtggaatacaactcagccttaaaaagaagttctgacacatgctacaacatggatgaaccttgaggtaaaataagccaaacataaaaagacaaatactgcatgattctacttatatggagtatctaaagcagtcaaactcttagaaacaggaagtaggacggtggttgccaggctggagagagagataaaagggaggggtagttactcaataggtactgagtttcagttttgcaagatgaaaacattctagagatctgttgcataacaaggtacatactctggcactactgaacactgaatgaactgaacactgaattgagtggttatgatggcatattttacgttattaaaaaaaaactgcggtagcagtggagccgcctaaccctgaaaagcacatataaaatacggagggatttaaagtcctaaggataatattacaactgaatgaagtaactcctgcaagaaagcaagactagaaatctgacgcatctaaaaggagactgagcctacagcccagccatgggcaggcagttctgcccagttcctcccttgtctaacagagtgggtccaaactttagtgtgatcaccacagggagttacactcacaaaaagcacatgtcctatcatatggggtctttaaagaacattcaaaggaaacatttgcagtctgaaagcttcatttcctgctcttatttcaaaacctaagttgaacacaagatttaacacacgaaaaactctatccaaaaaacggggttacagttaaggttaatggagctattacatgccaagtgctgatgagggtgcctgatgctcagaaatggggatggggtggcagtgataagacagcatcagctaagaaccaaggcagggactgcaggaacaggctgcggggaagtgtcagcttcctgggggcatttgtgtggacacagcaggggtgggccctgaggagtcagggctgcggcacctggagcctgctgaagctatgggaagaagacaagaaaagcagggtgggtgggaaggttcacattgaaaaggcgggaggagagcattaggacaaatacctaatgcatgcggggcttaaaacctagatgacaggttgttaggtgcagcaaaccaccatggcacatgtatgcctatgtaacaaacctgcatgttctgcacatgcatcctggaacttaaagtaaaataaaattaaattaaaaaaaaaaagaaaaggcagaaggagaaagacaaggagtagatggaaaaagagccagagacttctcttgaagctgtgcaatatcacagcatgaactctatgctgcccatgtttcaaatacccactccatgactttaaaagctgtgtgactttggctaagtcacttagtctcccaagctctgtttctctatctgtaaaatgaggttaatatgagtaaacctacttcctataaaaagacatcacatctcatgctgcaattataaagcagaaatatgcaacagcattaagctaaaatttcatttaacttttttgtgggttctaagcattttagatctattttttctgttaagtagtatgttttatattcagttatacacatttttttccttttaaaataccttttcctcatcttttactttcatgaatgtttgttaagaagtaatacatccacacggttgaaaacccacaaagtccgtccatacaaaagaaggtgacactctaataagcctcccaagcttctggaaacacacaggtagatttgattgcaatcactgtgtggtgagatcacagagggtggtcaccagctggcctgaattgatcacccaagcccaaagagacatcacagcatcagtgtccacacaagatgctggtgcagtcagaactgtgaacactagcgatgcccaactcagtgaaaaggtgcccggttcttaggcaggaggccccaggtggtggcgctccacttagctccctctgccatacagctctttcatcagcttttggaatcatggtgcaggaggcaaagcatgtggctcaggatagcagtcctgagtttcctgttcttgcttctacttaaaagctaagtgatgccaccaagcaagctaattaacctctctgggtcttagcatcctaatctccaaaacagacctaccacctgcctcactgatcacccctccacaatgagtcttgtcaggtaaagggtgtgtagaactatacccaaactcccaggccaacctcagcccctgcttcagacagctcccccataccactgcatacccaaagactatcagagcacgaacccaagctatcggatggagaggaaacacaaagggtgatggctggtggaatgagaccctgttaaaccaacaagctcacaatgtcagcacttgggcccaaatagcccttgaacatctaaactcttttttgtttttattttttatttatttatttttttttgtctccaggaagaaactgaaacttaaaaagtgatttaccaagagttttgacaaaagtacatcaacgaaggctcaggactgtcagaaatgaaaaataattatttttaaaatatctatttattggctgagcatgatggctcatgcctataatcccagcactttcagagatgcaggcgggtggatcacctgaggtcaggagttcaagaccagcctggccatcatggcgaaaccccatctccactaaaaatacaaaaattatctgggcgtggtggcacgcacctgtagtcccagctactggggaggctgaggcaggagaatcgcttgaacccgggaggcagaggttacagtgagccgaggtcgcaccactgcactccagcctaggtgacacagcaagactccatcttttaaaaaaaaaaaaaaaaaacctaggaaaataataaaaccgttcaaaattgagatgcttccttaccaattagtgtaatgaaagaggggcttgttataaatactgaggttacagtaaataccactctcaatattatttaataaacatggtttcaaatcaaaacaggttttttttttggttttggtttttgaggcaggtcttgctctgttgcctaggctggagtgcagaggcatgatctcagctcaccataacctctgctcactgggctcaaacgatcctcccacctcagtcccctccaagtagctgggactacaggcgtgtgccatcatgcccagctaatttttgtagtttttgcagagatgccatattgcccaggctggtttagaacttctgggctcaagcaatccacccacctcagcctcccaaagtgctggaatttcaggtgtgaaccacccggccctgcctcaacacagttttgaacctaactgtgtaacaatcacatggaagagagaagagaattaatccaagtagcttttgaacccaagaaccttgagtatacaccatcaatctgaaaacacaaagagctaaaaaaaattaaattaaattaaattctacttaataggtctgctgttactagtggtgcgaatgcagtacttctgaaactattctgggtgcagtgtaagactaagcaaatgagtaaacctactgatgctgttgggagccagggttctcactgtagaaaaagagagaaacaaacatgcaacagagaaagcaagcaagaacctggaacgctggattagaactaaagaaacagtatgggccaggcacagtggctcacggctgtaataccagcactttgggaggtggaggtaggcagatcatgaggtcaagagatcgagaccatcctggccaacatggtgaaaccccatctttactaaaaatacaaaaattagccaggtgtggtggcgcatgcctgtagttccagctacttgggaggctgaggcagaagaatcgcttgaacccgggaggcggaggttgcagtgagccgagatcaccccactgcactccagcctggcaacagagcgagactccgtctcaaaaaaataaaaataaaaaaaaaaaaataacagtatgaacttacacaggcacagacacatgcacgtatgcacacacctcttgggctagactgaaaagatggagtcgcagcatactctagtagctagcaataaacacatctaccaccaaaatcctgctttctaaataccatctcccaccaaaaggaaccagcgctctgtgggaaaatgccccattccagtgtggggcaggtaaggtacaagatgtgcctggtaaaaaggaatttcaagttgatggaaacatgtcagaaggcgacacgctcccatcctgaaaaggccaggtgaaggggtttccacttgccaagtcaacctactgttatgtaggtttgaaatatttccaaagtaaaaagatttctaaaaaagaatgagttaggccaggcacagtggctcatgcctgtaatctcagcactttgggaggccaaggcagacggatcacctgaggttgggagtttgagaccagcccagccaacatggcaaaatcccatctctactaaaaatacaaaaattagccgggcatggtggcagacgcctgtcatcccagctacttgggaggttgaggcagcataatcacttgaacccaggaagtggaggttgcagtgagctgagattgcaccactgcactccagcctgggcaacaaaagcaagattccatttgaggaaaaaaaaaaaaaaaaaaaaaaagaacgagttaagacaatcttgccccgacccattcccacctttcctctccatcttttgttaccaaaggaaaaaaaaaaaaaagaatgaagttatatatgcactgatctacaaagatctcaaaataagttaaatacaaaaattaaataaaaaatataattccatttatgtaaaatattctatgtatgaatgttagcaaatgtgaagaaatatcaactttattttttctagattgtccagacaagatcttctacacccttgggctctctccatgccccatggcttaccatgctggtctagcaggcatccttcgcaaatagggtagatggggaaatccgaagagctgctcccactgtcaggagtggccaagaaacctccaagaactgcagcaaaggcctgccatggcccccaacaagcctctaactcttccaggtcctcttattctaagaccatagacagagttctgtaggtaaactaatctacctggaggccctaagaagcagccagtggcaccggagagacctctgcatcagcagacctagtttcaatggagcatctggcccggtcctgtggtcagtctcctgctgatcatccctgtgttgaccttctgggtccctctgctgtgactcctgcccctcatccagtgccctggccagccacaaacaatcctctccacaactatgaactcctaaggaaggtttcccagaaaatgagacttcccaggcaaggaagagggcagggtctacctgggggacccttagtccaccatacccaccagaatactgtcctcagtactgtcctgtccaacagtagcagccaacagctgaaggatgacagactaaccaaggaagacaagctaaccaaactgatagctgtctgccattttgccagaggtcagccagaagtcagcctacagggagggacctgtaggggacaagggcactaagaacaatgaccagctcagagtgactgaagcaacagctaccgcaggcagaggaggaggagaaggccaagaggcaagcatgtgcagcccatgcagcccatgcacccagccagctcttgaccagaaacaagccctgcactgtgcaaacaacccagggaaggtccagccacatcctcacacagggcagtccagttctcaaagccaggtgccagcaagtccatcagagaggcagctccctcagcaccggcttgctggggtccctccctctgggagcccctcaaccctccaccccaggctgggcagctggtgagcttcagtgaggatccacattaatgagaagccacacttgctctcacctctcagctcagctcccatcacagaagcaagctcctaccagggtggggcccaggccagctggctccacagccatgtcccctacccccggatcccatcctcccaaggcatttttgcaggactgccacaaggctctcatcctcctcgccacccccaccagaggcagctgcaaggcctgctggctaaagtagctgttgctctttatgtcaaaatataaataggcatttgtgcatttgttcaataactgatttctgagtgcccagtctgtgcctgaccaggcccaggtgacagagcatgaatgtgacaaagagcaaaacgtgtatgaacaatcccagccctgtccaaagcaccatggctgtttcgggggctctcagcaagtcatacgcagtccctctgatcccatcataacagcaaagagcactctctgtgtggcagacactcctcagagccactgtactctgccacctcctgagggagctctctcccgaccaataagccctgtgcacaaaccacctcacatttcacatttcagttcagggttcctgaactctatctgtgattaacactaacattttgcctgatgaagagtttgctttatgtcagacactttttagaattttatacttacccattttaatcctcacaacatctctataaagctctgttacgatgtccatgttccaaatgaggaaactgaagagtgagcagtagaacagattgagcctaggcagtgtggctctagagcccatgctcttaagccaccatacccaactgcctgccatgggccaggatgagaaggcttgatctaatcccagctgctacttttacagacagctcatttgaggcaaaaccagacctgagcttccccatctcccaggaggatgcccagaaggtccagggcatctgggtccacaggctattcaccctccaacctagacttgccctgccaagcccgccatgtccacactgacaggacacacagcttggaatggcaggatgagatggactggctttgactaaacttcccaggacaactggtaaatcatgtcagaaacacaaatacaggtgttacacagctatcacataataaccatacccaagcccatgcatcactctgctcaatgaactgttggcccaaaactggtctctcgggattaccgagcccactctgcagactggcagtgaaagaaaggaaagaggacggtcatcaaaacctcagcacccaaacataacagcacataagagaaaatctaatagcataccaaggaaaagacatctaatcagtcaagagctatctacggggtccttaaatgttgtcactgatgcattccacttagagtcaagaaactactaaatgccaatcgggtcgtccttatgccaacaaccaagagaggcagaggaactccctgcctgtcaaaggctcaggtccagcaggagagagtcaataactagatcacctgccatcagtgttgagaggatgcatgcactactagatcacctgtcatcactgctgagaggacatgcacacaaccggatcacctgccactactgctaagaggaaacatgcataatgagatcacctcccatcacctcccatcactgctaagaggacacctgcacaaccagatcacctcccaccatggctaagaggacacgtgcacagctagatcacctgcccttactgctaagaggacacacacagatcactcacctcccattactgctaagaggatctgtgcgtaacaagattacctgccgtcactgctagaaggacacctgcacaaacaaatcaccggccaccgctgctaagaggatataatcactcagtactctgggaagtgggaaggaaggggtggggaaagtgcccacaagctagcttgggaagtggagcagcgaaggcgcagcctaacacagcacaaatcttccacaacagcagtcttcattcctaaacccagaaccgccaactaaaacaataaccctgacatgcagtgatgccagcttgcctccacctgggccaacctgggctttaactacagggcttcctgcacccatgagaccttcccacgtgacacagggcttggcacatagcaggtgttagtgagaacgatggggtggggttaagtgggagcagcctctactctctgcaatggttaacatgtacaaggataaacggccatggcgcatacaacttattctcaaatggttcagaaaaaagcaatgtgtgtgagtacacagatatgcacatacacatggaagatgagggataaggcaaataaggtaaaatgccaacagtagggaagcctcagcaaaggatatgcaggtgttctctgcactcactttactcttgcaacttttccgggagtttgaaattatttccaaataaaagttttctttttgtcaagaaaaaaaaggaaaattcattagctagtgaaggtagaaagtatattacatcactttccaactaaaaaaaatgaacctgttaacccaaaagccaaatctaccagtggacaaactctacaaagtgtcacagtactggctacagaggaaagcactccaaactcaggaggatttggcaaggctaggtgcaagctcacctctccagctacttctgaacctcggtcacttttccttgtgatgaaaatatgcactctctccctatgcaccaaacccctgtgctacttcacatgaaagaaaactctggactccagccggggagaggtggctcacacctgcaatcccgtaactttgggaggccaaagcaggtggatcacttgagcccaggagtttgagaccagcctacatggccaacatggtgaaaccccgtctctactaaaaatacaaaattatcccagcatggtggcgtgcgccgtaatcaaagttactctggaggctgacacaggagaattacttgaacccaggaggtggaggttacagtgagctgagatcccgcaactgcactccagcctgggtgacagacagaaactccatcgcaaacaaaaaaaaaaaaaaaaaaaaaaaacaactctggactccagagccaaggtgctgtgttcacttctcagctccctgagatgtgatcagctcagcacagctgcctactgaaagcaaaagagaaagaaccctgagctagcagccagctccacctgggtctgaacccacgctctgctgctcaccagctgtgtgaccttagacaagtcacttgcctctcccagctagctgtaccaacaatagaaggaagacgaccttctagtcctctaccttaccaaggggcctagctgagcacaggccctgtacaggaccaacaaccagcaggaagggaccagggtgcaccagcattcagaaggcaattttttctcagctatgtatggtgggttcaacctggatagagctgtggctcatgatataattttgtttcacaattaaagctagaaagaaaaacagttttagaatcagcagtcgatgctgccttctctacacagatggagaaagggccaatgagacagtatcacaatcagtggtccccaaatccccccaccatctcgctgtcagttacctcagcagtagtctccaaccgttcttcctcatcacacccccagtgatcataacacacatcatcagtggtcacatggccaaacacagaagggatttggcagagggtgagtggttctgtccctcagactggagtatccacatggaaaaagattctgcaccctcacctagaggaccctgggacctaacaggggacagaggcagtctgtggctccacctggggttaaggaagctgttcagagcataatatgaggtactcctgtggctgggctggagacacacagttggagtgcacagaccccagtcacgggtgcatgatggggggaaggccagactcctacgatgaaatctcatctcagccttagcttcatgagtgctctggatttcagcttccccatctttaaatgaggctaaaaacagcatctagcagggacctcttgagagttaacatatgttagtgcttagaacagtgtccggcacatgacacatcttaaatcaagttcaaatgtgcacttaaaaaaaaattgctgggcatggtacctcaggcctgtaattccagcactttgggaggccaaggcaggtggctcaccagaggtcaggagttccagaccagcccggccaacatggcaaaaccccatctctactaaaaatacaaaaattagccgagcgtggaggcgtatgcctgtaatcccagctactcgggaggctgaggcaggagaatcgcttgaaccaaggaggtggaggttgcagtgggccaagatcacgctactgcactccagcctgagcaacagagcaggactctgtctcaaaaaaaaaaaaaaaaaaaaaattggtgaaaggtcaagtacagcaagcacttgctgccccataactccatgaaaggccttccaccctgccctgtaccagagaggaagcccaggtggcttggcatcatcttcagggaccccaccaggcaggagtcagaaaacaccctcctgagaagtgggctctgactgataccttcctcatactcaagtatgcttttaaggccggaatccccacagaaagaacgcagactaagaccagagaagccccagcctcttgcaagcaccagccaggcagatccctgcagcactctcaggaaggacacatggtgaatgtgtgaagaggcacacacgggcatacaaggaacacatcaggcccagaggcctgccctccctgcccagccaaagccaggaagccagctgcagctcccgggttctgcagggcaactcaagacgcctccaggggtagctgcaatgttctcatctggagagtcatggaatcgaaagaataagtttgctccctctaccagatccaccccacccatgccctactccgacctcagtgtgaggtctcctgtgacgccctcactgcttcacaggtacaaaaagatggccacctccacccacctctgggaccccacactccagggtattcaacacacaggagtgtgacaagtgacttacacctggcctctgttccacatcaggcactcctaaaaggaggggcttgttcttgtcacttggattccctagggatgggcagggggcaagcacccacaggcactttctcagttgctgctggccagttggcaggctatgtgaaaaggctggcaaggaaaaaggagtcggggacgtcagtcacctctatcacccaggcaggagatgctgggcctggaaccagaggcaccccaaagaagccaggcataatatggcctcacctgagcccggtgacctcatctgcaaaactgggactcaagaatcagaaaacggtgaccttctacctctctacacgtacatatatgttttctaaagaagttaatcacaagaatccacaaacccattggttctgacctccaagagcctatatgataccctcctccacaggtagcccttttcctggcttctgttcttaccaaggccaccccacaactagtcatcccgctgcccagagagcagccaaaagcagtgagcaactagctctacatggggagaccagagaagcatcactgaatctgtccaggttgagcaccggtcagggccttggccaccaggcaggcactagggaggaggcagacattccacatagatgacacaagcgcagagccaagaggtgcggtgtatctgggctgggagcctggctagggcacaggagagggccacacaccccgtgctcccacacccaggtcatcagagaagatggccctggcacttctgccttcatgggacctttcctccattaagaaatattaagagtcatgctttttcactgtattagtataaagatgactgtattaatatacatacgaaaacattttatttgacctaaaagttcattttttttctgctgactttaaaaaaaaataaaataacattcgaaggctactaaaagtaccgtgggcaagtgataccaggattcctgtgcctgatggatacatcggccctgcatttagggagtttgattttttggtgcagttcaaggggaggtacaccgaaataggtagaaaagggtctcctggttgccacggttctgattccccaccacagacttaagaacacactagctccgaggggagttccaaagcacggactcattcatcacatacacgcagcacggctaagggccccgcacagtggcgaggtctctgctcccgggacgctcgcgccggccacacaacgctaggctgactcctggtgcctcctctaggcccggtgggacctgaggacttccttagcgcaacgtctcactgaatgacagccacaaccaccgctgtccaggcgaggagtttccaggactgagaggctggcactaggccactgctgggaggacgtctgtgaaaccaggtgcccctgagagccactgtccccagcccgactccgacgctggactggcgagagggtgcgcccgtggcgtagctcctggccgccgccgctcccgggaagggcccagaggcaacatcctggacagcagagctgcacgaagtccgaggcgccgcgagcccaggtaagctccagcaggcgtccgcagagagtgccaggcggcccgcgagccaggccccgcccgcccctgccccaggcgcggcccctgcaggagggcgccgcgggtgaaaggaggtcccggggcgaccccggccccgctcgccgcccagcccccacaccgcccccatcgcgcggcgcacctggccgcagcggctcggtgacagtgagcacgagcaggaagagcagcaggaaggcgccgctgtctgccttgggcaccatttatcctccgttcatcgtccccggggcggctggaaggccggaccaggccggactgagggtcaggggaccgtgccaagcggagggtcaggcggagctgaacctgggcgaggcgcggagaggcggcgggaaagagcttcggctgggccgcgggctggcgcacactctcggctgcaacctcaggcaccgactccagctgcgcgcaagatggcggccgtcctgctcggctccgcgccgcgccgccccgccccgcctcccgcccgcgacgcaggcgcgggccaatgaccgtcaagatggggggcggggccagagccaaagccctccgaagagggtgaggcctaaggtcgcgacggcggagggcggggacctaagggcggggactgaggggcgggctctaagggaagggcgggaccatacggagtgaggcgtgccattggttaagcagagaggcagggccggggccggggcctgagcggcggggccaccgaagggagtagggtctctggacgccggttagggacggcgggcgcgggacggcaaggatggacatcgaaaggcgcggggcatggggcggggcgccgaggggtcgcgcgggtggggagcggagagaacgaagtgggaacctggctgggactccaagggtcttcacacctgcaagctcaggtcccgtgagcagcccaaaagtgcgccccaaaggggtctttttaaggccgaaccgctgtggaggagggagggcctgccggttctgagggtggggaaagaggaacaggaatggcctaagagagtgtcaggcaaagagagaccgggaaggccaggtcctggagactgcagcgaagccggctccctggaggacctgcctacacaatggctaggggaaggccacatgtgcaggaaagaaagctaggcagagaggaggctcagcgcccctgcgaacagtgctccaagtgccacttctcccgtcatcaccaacagggtgaaccttggagggcagtgtcggcgaagagtccaactctgtaaaatatttgaagacatttcttctgagccaatatgtgaccaatagcctgggacacagccccaggagatcctgacaagtgcccaagggggtagggccacagcttggttttatacattttagggagacaagacatcaatcagcacatgtaagatatacattggttcagtcggaaaaggcgggacaacttgaaagtggggggtggaggggggcttctaggtcatgcggattggcagttggttcaaagagtttatctaaagacctggaatcaataaaagggactgtctacattaaggggttgtggagaccaagtttcttaggcaaatgaagcctccaggtatcaggcttcacagagaaaagactgttaatgtttcttattaaaaagtgccagactctgccgggtgtggtggctcacgcctgtcatcccagcactttgggaggccaaggcgggcggatcacctgaggtcaggagttcaagatcagcctggccaacatggtgaaaccacatctctactaaaaatacaaaagttacccaggcgtggtggcacacgcctgtaatcccagctactcaggaggctgatggcaggagaatcgcttgaaccggggaggcagaggttgcagtgagccaagatcatgccactgcactccagcctgggcaacagagtaagactctgtctcaaaaaaaaaaaaaaaaaaaaggaaaaaaaaaaggaaaaataaataaaaggtgccagactctagttaattctctcaggagaaaagaccttgaaagggatagggattctctacagaatgtagattttccccacaaaaaacagctttgcagagcgacttcaaaatatgtgaaagaaacctgttttgcagtaaaatatgtgtttccttccgggcctgctgtcatgctggtatcttactgccacagagtctgttgtcagtcttcaagtctctgtgtcgatgttacactgcttagctgtgcctgaaacctgaagggaggagggataatgaggcctgactcccacttcctatcacggcctgaaatagtttttcaggttaagtttggaatgcccttggtggagaggaggggtccattcagatggctggggggttagagttttatttttggtttccaggagacagtagttggggtgtccccagcgggaaggagaaggaggctgtctggaaggaggagaaccaagaatgcacaaaggcctggcagtgggcagtcagcgttagggaagaaggtgaaggagcagagaaaagggggaagggccacggcaggtggggacccaacccaacatgagtgacaaccagcccgccctaccaagtcatcctgaggggcccagggttccacttggctcctgtgagaaaggggtgctcactccctctaggtggatgaggccaaagtcaaatccaaggctaggatagtcatgtgactcctactcccctagggcatagcccggaacaagtgctggacacagagcctggcacagcagaggggctccactgccagaaaaaacaatggccacactctccagtgctgcccctgctgcttgtactgtcctcagagcagccaccagtgctcagggtggcatccagtccccgcctttagcccccagccccagatctgccctgggagcccagccaggggcagaaaaaaaactagttcattgagtgccagggagccctgcccaaggacatggcgtgcaagatgttccaccaactctcctcagccattaaatactgccacgacctggacatcatgcaccagaacctcaagtgttagaaccttctcctcgacaaggacttcaacatcaagctgttctacttcaggttctccaagctctgcctgcgggatgacagtggccaacagagattaagcaagaacttctgcgggttggtggcatatgcagcccccgagctgctgcagggcatcccctaccagcccatggtgtatgacatctggagcctgggcatgatcctctacatcatggtctgcagctccatgccttacgactccaacatcaggaagatgctgcgtatccagaaggagcaccgcgtggacttcccacactccaagaacctgacagacgagtgcaaggacctcatctactgcatgctgcagcccgacgtcagccagcggctgcacatccatgacaccctcagccaatgctgggtgcagcccaaggcacagggactgccctctatggtcttcaacaaggagggggaaagctcccagggaactgaactcttgtggacccctgaacctggctctgccaagaggtctgccaccaagctggagcctggggaacagacacagcccgagggacagcctgagacaaaacctgaggggttggcaatgcaaatgtccaggcagtcggacatcctaggcttccccagcaagccgtcgaccagggagaaagaggaagggccccccagcagcctccagagatgcgcacctagtgagccgtttgtggcccagtgtgccagcggcgaatgagatggagctcacgccttcaggcccaagctctgaagaagtcaaggcacaaaccagagaaggaagacggtcccggatgagccgctgttttcatcaatttcttctctctccccttgaacttcataaccgacattgctaaaggagcaataaatcactatattaatgcagatgccaaagtgaatgtctttgcctcaactgactagtcctgggctcccctccactggtttcccactcagattgtgcaatgattcctcgtttgcttgggaaaacacatcccaacgtgcccagtccagaccatgacctcaggcccaggctggggctggggcttgggctggggctgggagagacctggaggggcaggggccagagctgaaaggtgagtgaggaagccgctgcctcagaagggacgcccccaagtgcggtgctggggtcgggaaagggcagggagaggacaggaccaagaagcatgccgaggtacccctgtagaggagcgcaggctttatctgcagttgggactgagggtctgggcagacctctccagccccacaaggctgccagtgggggttgtgggaggctgcagagggcaggtggccagcctctcagccactcctgagctccctaccctgctgggcaactcgttcattgtgctctgtccatcagaggccccctgtgtccagccagcacccagctttcaacagtgccggggtcgccgcaccctgtggtcattctctagcccgggagaaataggaggctctgctggatggcccagccacactccagcctgagcatgtcccacagtcttgtgtggtcttgaccacatcttgttgtccccgtcccagcctgtcccaagggacgacacccctgcattagaagttgacactggcaagtaggatacgacaggcaaccacaaaggacaagcgctttcagaattacctctcccatggcctctaagtggatggggccaaagtcaaacccaaggctaggactgtcatgcgactcccactcccccagggcggggcctgaagcaggtgctggacacagagaatgtcagagcagaggagctccactgccagcaacatcgatgatcactgtccacagtctacctatggtcacttctctacctcgggaagaccccaacctcagtccccttggagaagtagggtctagtgagagcctggactggccctccttgcgctcttccccaagtccacctgcctcctcatgttctcacagcccccttccacgtggtttaatttcaggcctccaccccaaccctcccaccacctccgacagtgtccagagccatcccccaccagcctggctcccactgcccagtggggaggaacctaccctggcctctggggtcctcctgtggcccagtgcatcctcccctggcctctgggcaccaggcctcaccactgcgcccccatcacacacacggcccataatcatacagggaactcgcccctgcagactctgtccagctctccaggctcagctgagaggctgaggcctccataaagccttctaggggttctcagcagcctgccactgtgtactctgccaacaggcctcaaggagccaccctatttttcccaccaagaaactcatggtggagagggagcccagagtgctgggatgggggcccgggtgggacatcctgagaaatggctcttggggcctcctcctcaattatccccacggacctgcgctggtcctcagggcagtggctggcaagcaggtctgggagcctcactgtagctcagccaggtaagcccgggtgggaggggctgcaggaggagttcctgctctgagctttacagctggaaacagctcagagggagtgggccacctgtctgagatcacactgcccagggcaggagtcccaggtgacgcctccacaggtggcctcgccatgccgggcgactcctgtaggtggctcagccctggctcagaccccttcaaggattctcaaaggtgctaggaccaggacctcaacagggccctccatggcctgtccgtgctcctgccaagccacatcccttcaaaccgtcacatgtaatagctatcctcatccctctccacctggctagttcctcagacctcagccttccccagcttcccaaagtccaatccccagttccctgtcctcacagcaccatggttctgatgcgtggcacagccaccatcgcgcacacacacttggtgtgattgagcctccctcgcctctgggctccaggacggcatgggtggtctagctcatcagtgtacctcggcatccagggcagaccctcagtgcttgggggacaaataggtaaaaaggtgtctactttataaaggataggaaggttcagagagaagtggatttctcagagtgtgcaggtaccttgctcacaggactgcaaccctaggagcaacgctggaggtctccaagtcgaatccaaagctctctgtcaaacataccaggagtgccggccctgtgtgtgcatcctggatgaagcggcccgctccatgcccgggcagttctgcctctgcaatgttgacacctgcctcttctggcatgtcccccaagaaccagagagaccctcaggaggtgaagaagtagaatgcacaaaaagagggagaaggcattggtagagtctgggaagaaggcagatatgcagccagggcacggtggctcatgcctgtaatcccagcactttgggaggccgaagcaggcagatcacttgaggccaggagttcgagaccaacctgggcaacatggtgaaatcccatctctcctaaaaatacaaaaattagctgggcgttgtggtgcttgcctgtaattccagctgctcgagaggctgaggcatgagaattgcttgaacctgggaggtggaggttgcagtgagccgacatggtgccagagcatgactccatcgaaaaggaaggggaggggaggggaggggaggggaggggaggggaggaagcagatatgcagagaagtgtcccagatagggcatttgggggagcaaaggaaagggtcagggggtggtaagtgggaggtctcatgctcctgggtcctggcctgcaaattttcatagccagccccttctaggacaaaaaggagtgaagtgttggtcatttcagccgtagaggctcccaggaaaaaggaaagcatcaaactaaagctattaaccaccgatgctataaagagcttcgggtgggactctgggaggctgtcactgctggaaggcagtcactgtaggcacgtcggcccaccctgcccatctgagcctctcagcttagcatcctgactttggctgccctgtttctgcaatcctccctagtgacctccaaacacagggtgctccctgtgtactccagatggagtgggtccacacagccatgccagggccaagatgtcacatctgtctgacatgtcctgcccctcttgtcaaccctgtggagtctgctgatccccagcaccccagctccaacatcacttcctctttgaaaccttccaggactaaaccccacctgggaacaggccttcctccctctcccctaaacactgaacacacagctcatctgtcccagctgctccctgtgaatccaggatgcctgtgatggatgacaaatgaacatcagtccaacgcacctgaggagacatgtacaggatgccacatttcccaaagcacaaatccacacaccagcactgaaacaggatgttcacactgcaggtgcaaaaggcagcccgagacgtaaatgctacccaatgtcagggttccaacaggcgactgctgctcactccacacaaaggcccaaactgatgtgattcagaaccccctcctcacccaggtgcctggtctttgcagtgcatggcctgggcgctctcagccccaggattccccagcaccaaggcccatccactcacagtctagcaaacaagactaagacctgaccttctctgtctcctgctgatcctgaggcccaccctggcccagcctcttctcatttggtcaaaggcactggcccccactctcacctcaaagccaattctactctttctgtctctctctctctgccactgaccatcttaaaacacaactgggacggccctcctcctgtcttgcacctgcaggggcaggctgccgcttagagaaaaagccgagactccttcacttccctcctacttccagtcactttcagaaaaagccctctcttctcccaggctctctgctgcctgggtgccttcctgccgcctctacccaagggaggccctgccccacccctcagacatgcagccacctgccctggaccctgggcacccagctggcatgcactgcagccccgacccacccatacacaggcccttgctcgctggagcagcagcgactcacctgcccggctctctaccctgaggggcctgccgcctctgctcccaaacacagagctgctttcgtctaccaggcttggcaccactgccagcctgactggtccagggcagtccctcccaggtaccactgttcccagaaccaagccaggtccagctgcattttcttgaggcccaataacgagaagcagacaaactaggaaagaagggagtttatcactgtaactggatacagggagaaggctggagataattccagcagaccaactcaaagtgctacaattttcttactgtttatataggttggggttatgtgcctacatgcagtacagcaatcacctaagtctactggtaactaattttgttccaaggagaaggtcagaggcaaaaaaaatgcttgctaagtccgattaaaaggggcccagtgccttcaaggcctgtctactgtggtaccggagtgattatttcgattgtatctcctttacagcttggtccagagagctgccttagactatccaattgatctattcaaacagctgcctgttcccttaacttgtcttcagattttgtcgacccgagatgggtcctggcactaggaatgtaaaaccgttcctattattttggcttgctccagcaaaagagaagcccatgcaaggctcctgctgaccatgtttcatttctagctttgatgtctgggcactgatttccctagatttaactatgtgctcaatggtaaggcagtgctgtggaaatctgtctgtgtaactggggtgctatgcaggcctgtctgggtgactgtcagggacaactgtcctaccacaccaaggacacagccctgggggtgcttttcttcatagccaaagaagctgcaggaaacccaccctagtgggacaaagaccaatgcagggtcagtccccacagccaggtgatgcaaacaggctggacgtgggccgcctcccctccagcttgacttgtgacagggaaaccaatgcagcagcagcagggccaccagagtcctgtcctggggacaggcttccttccagcgggcggggagtgggtgctcctgccagaccagcctggcttccacggttccagagaccctgttctccctcagcccagtccccgcccccactccttggctttatgagttcattggctgaagtcacccggagacaatgctgagtgttccacccctgagtcgaagcccagcccagggcagcccagccagacgcctccggtagtgtaaatgaggacaatgcctgctggcccacatgacggggggatgtagacggcagcggcgccagtcgctcctggcaccatggacgatgccacagtcctaaggaagaagggttacatcgtaggcatcaatcttggcaagggttcctacgcaaaagtcaaatctgcctactctgagcgcctcaagttcaatgtggctgtcaagatcatcgaccgcaagaaaacacctactgactttgtggagagattccttcctcgggagatggacatcctggcaactgtcaaccacggctccatcatcaagacttacgagatctttgagacctctgacggacggatctacatcatcatggagcttggcgtccagggcgacctcctcgagttcatcaagtgccagggagccctgcatgaggacgtggcacgcaagatgttccgacagctctcctccgccgtcaagtactgccacgacctggacatcgtccaccgggacctcaagtgcgagaaccttctcctcgacaaggacttcaacatcaagctgtctgactttggcttctccaagcgctgcctgcgggacagcaatgggcgcatcatcctcagcaagaccttctgcgggtcggcagcatatgcagcccccgaggtgctgcagagcatcccctaccagcccaaggtgtatgacatctggagcctgggcgtgatcctgtacatcatggtctgcggctccatgccctatgacgactccgacatcaggaagatgctgcgtatccagaaggagcaccgtgtggacttcccgcgctccaagaacctgacctgcgagtgcaaggacctcatctaccgcatgctgcagcccgacgtcagccagcggctccacatcgatgagatcctcagccactcgtggctgcagccccccaagcccaaagccacgtcttctgcctccttcaagagggagggggagggcaagtaccgcgctgagtgcaaactggacaccaagacaggcttgaggcccgaccaccggcccgaccacaagcttggagccaaaacccagcaccggctgctggtggtgcccgagaacgagaacaggatggaggacaggctggccgagacctccagggccaaagaccatcacatctccggagctgaggtggggaaagcaagcacctagcatgacaatggccccgttgtgtgtggtgggggtcggggttggggggcatggtgcagtcggccttcacgtaaactaagtaggcaggtaggatctgaagaaggcacaggtgcaagtaaaattcgtcaattaaaccactattttgattacgttccattagctttcttccacttagcagcaaagacgttccttactgaccaccaaataaaccacagggtgtgtgcaagcatcaagagtgcccagtgaggagtgtttttctctgggactcagccaaccgccccacctgacacacagtggtctccggcctaggagcacaggacagatgctcaggtacaggcagaatcacagtgtggcctggccttgtgggggacaagagggcctctgccagggtccacccaccaggcccacactgtctccctctgacctggccttgtccccaatgccctggggctggccagctccagtggtccacgactccccctggcttcctgcagttcagccccctctgacctacccccactccctcacaatccctcgctcagcatcctcctcttcctctatttcctggagtcatgtgagatttctgtcctcagccctcaagttccctgccctgtcctccaggggcagccccagctgagacctccccgtgtgccctccccacccagtggctcttcaagctgctcagcagcccttgatgatggcacactggccggtcttttgtgcttcctgctgggtcacccattgctcccaaagcatgcggcccacttgctggccaagtgctccaggtggtcagcacctagacatgctcctcccccctccctccccacttcctgggggctcccttgggataacgtgcaccctttcctaggggataaagcactgaaggccccacgtcccccaccccttaagagtcccagcctgatctgtccagcaacccactgttatctgggagctcctgttggtggaagtgaccaggtgaggccagggccagcagcataagatgggcagtgcctatagcagaggggtgagtgggatagtcccaccccatgagctggaagccaggtgctgggagaaggtgatagctgagatcacctgatatgcagcccccacacagtcctataaccagcgcacctcacagccggcaagcccagagtggaggctgcagacctgggcccagaaccgcaggggaacctaagggtacaacttccaagggctccgtttctccttcatatccccccagagaagcagaaagcactgcaggatgtgagctcaactcagaacacaggttccgagtgccgcagaaagcaacgccagtcacccggtgctcccacagccgccccacctgcagcttcctcacctggggggcccctcgcttcaagccccgcagtcctgagacgtgatgcaggccccagggcaaggctagggctcgtgtggggagcaagatggagaggcaaccccccagactgtacctaggtgttctttaatgacagttcaaggggccaattaaacagcaaacagcttggcaaggccctggggtgtggtgtgggcacgagtgccttgtgccagtctggccccagcacagcccctttctccagtgactcctggtatggtcaacagcttctggcccaggcctgggccccgagaaggctggagtcctctgctgggtgtacagctgccctgcaggctctgtgaagcgtctatgagcccagcccaggcctggctctaaaagaagtccgaagctttgcgccgggcagggagctgcagcaggttgtccgtgatggaggccgggtcctgtgtgagaggggtgcgtgtggcagagccaggcgccggtgtgcttgtgggggtctgcagcccactggccggggtcttgaggtgggtggagcgtgctggggatggtgtgtagctggcccgcagggcccggtctgtgtacttgctggccgtcctgctcacaaggcgctgtagggctggcgacatggctgggctcaggcctttgggggtgaggctggggtggaggaatgggtgagagaggcagggttaggtgggctgagagctgccggcagcagggcctcccttggctcccaggaagagcctgggcagagacacagtcactctgagctgaggaggatggtactgccagcatggcagcaaatgcgggggatccctgaggtcaaacagcagcgctcaggtcaaacctgaggtcaaacagcagcaccgcccttggctgtgggggctggggtgcacccccaggcctctgagagttggagtccccacccctctccaaggggaacgatgactctctccacagggctgatgaaagctcccagcaggaccacacgcctaaagatgcctcttagggacgggtcaaagaggacgtggaggaaagagaagatggagggggcctctcatcctgtccatgtgcggccatgctctggatagaggagctgccacagtacccactgcagaaccccgcggacctgccctggactctgccgcgtgggccatgcctccacacggtcagggcaggggccgaacaggagcaggccagagccaccctcgcacttccccaccagccaggcggcccctcacctggccagattctccgtcactctccgcaaggcttcctgcttcttggcccggttcttggcagcggcctcgttggccatcttcagacccagccgctccctgcggcctggctccaggatctacaaggtagcaggtgtgtgggtagctgcgccaggcctgccacacgccaggcagcccctcacacagaaagccactgtggtgggtgccagcctctctttgttgcctacaaaacccccacaacccatcacctcccactaaaagcccctggaaagccccaaaccccacctgacctgcccaaggcgcagcactcctcacctgtcttcgtgttcctcccaaaaccatgacctctgacaatctctcaggaaaaagcagtctgttttagtgtttccctgattatcagagtgaacatctctgtctttatcggcgctctgtatttcgggcgcttccccgtgtgcctgtggcctattttgctctcaaggggctcattttccttttctgctgctgttactcagaagacccttgccaagaccttgtgtcaagtcaactgtgctacgctgtgcacatgttttttcactcatttacatttgtttcatttataacattttctgctgtatttgttattttcatttgtgatttcttcctttgcttttatgtttagaaagtccctcctaacttaagattagactacaggctgggagtggtggctcacacctggaacctcagcactttgggaggccaaggtgggaggatcacttgagctcaggcattggagaccagcctgagcaaaatgacaagacctcatttctacacacacacacacaaaattagctgggcatggtggtgtatgctgttagtcccagctacacaggaggctgaggctggaaggtcatttgagcccaggagctcaatgttacaatcagctatgattgcaccactgttctccagcctgggcaacagagtgaaaccctatctgttaaaaaaaaaaaaaaaaaaaaaaaagaggcgaggcacagtggctcacgcctgtaatcccagcactttgggaggctgaggtgggtggatcacgaggtcaggagttcgaaaccagtctggccaaggagttcgagaccagtctggccaacatggtgaaaccccatctctactaaaaatacaaaaataagccgggcgtggtggcacgcgcctgtagtcccagttacttgggaggttgaggcaggagaatcacttgaacccaaaaatcaaactaaatattcgccactattttctagtcccagttacttgggaggttgaggcaggagaatcacttgaacccaaaaatcaaactaaatattcgccactattttcttctggttgttttatggttattgtttttacatgtaaccttttcacctttccacaatgtatgctgctacacatcctgaggacccagctcccttcatttctaaatactctgctattcagtgcaatctgagttgccatctttatcgggccccaaattctgacttggatcatggtttgtttcagaatttatctgtttactgttggcctggagactcgggaagcagtggcaggcatacctcagaagcacctcagcccttgccttgcgctctcacattggacagcacggcatcctcttcattatccctctcgcacgtttgccttggttatccttgtgtcccagacaatttagaaccaaggtaaccagaacctctccccatgttttgtctggacatgggttacctgtactaagtattctggggaaaggcccgcagtggtatggggaggcctgttgtatctgacccagcccacgaagagcctcccctggtctgtgccgggcctcacacactccaccctgaccactcctacaacaccaggcttgagccgtgtaatccagcgtgtcccaatcgtgttctgtaaccaggggccttctctacaagcacacagcctcgtcctatggccctcaggcctgcagagctcctcacgtgtctgtgaccatcctgcctcattcatgaacagcacccggcctccaggatccagagggcccaagccactccctgccttggtgtctcagcccttacacccccaaatccctctgtgacaggtccacccacccacacctgccttcagcaccctggcattcagaaaagccagcactctgcccgtcagcagctgggggccgatcccagtgctcagtcctgagccacaggcactcagggctccagaggtgtccaccccggtcgcacacagttcccccatcaccacaacccaccttaaaagctgggccgggtgtcctgtccacgtagggcgtttccgacccttcaactctcaagggtgtgttctcaacctccccccaggtcatcatcggggactcgttcacacctgcagacaaagagcccaaaaccacctcaggccagaggactccccaccaccctcccctccagtcacagcttgttcacccaatgtgcatcccagctaatacgaaggcaggcagctagccctctctccttccccaggactctggaaccctggcacctccatcctccgaaagggaaatgccaagctcccagcaggcccgaggcaggctcaaggccctacagccatgtgcttagcctacaagcctctgggaggtctcccccagccacgcaggaggagacactcaggccttccagggctcccaaacctcctagaaccccaggcaaacctgtggtgccttcacatgccctggcgtgtgacacagcaccagcacccaagagcacagaggccagagtgcagagggacacccacgcatgccacaagaccacctgagtttcacctccactgaggtgctgggcctccctccctgcagtgctaggtagacttagactcataagcactgtgcacacacccccacccactgacatcacagtaaggaccaggacaggacacgtcatcccaggatgtctcaggccaggtctgcctgagagtccagcccacccacggccccaagcagcctggacacctggcctctagggccttgtacagacaggagaccaggtccctgagttacacaaggtgtggggcaggccaggtagaggccaggagtggccagggccgactgagaagcccacctcccccagggagtcccagcagtagacccacttgccagtgggcacttttctcaccaggggcaggggaaggagtggcaacaaatccaaatccacccactcgaggggactcctgggggatcagctccttgccatcggggcccaccttgccctgtttgtgctggaacaagcagagaggctggcatcagggggaccgcagcccacgctcgacagctggccggtgggcaaacacgtgggaacatgctggaaacacttcctctcctcagggcaaggctggggctctggggttggcagccttcttggagaaagagagggagggcccctgccccaaccccccaaaagaccttgagggcctgtcaaagtgggtacccaagcaaggaaagccccctcctcccatccagggaggtgccagggcctccactcgagctgcgcctatcccagcaactccagaggatgctgacgccaggcccctgcagggggcaatgctgatgacaggcaatgctgatgacaggcaatgcttatgctctagtctcttcctgccttccccacttcaaccctgtgactgccacagtcaccatcagagagtatctactcgtcttgctcccagactcagaaagcctctgctctctgccaacccagggcctgtcccaccccagccaccccctggggctgggctccctctgcggctctctggcttccctgcccggtgtgtgggcgtgcagctgccagcctgggctcactcccagcagtcccttttctctcctgcccctgccatcaagggagctggcacagatctggacctacagaacgtgtgtgaccaaggcagtgttcaatggaagcccactggggccaaggaaagactcaggatcctgccgcacagggccccagatggttccactcactgagctctgccaagctcaaagagatgggagagatcatgcctgcccccaggcagccctgtccaacctggcccatgcggccctgctgacccgcctgctcacctgggcattgagggcggctgcctgctggagctggcacctgctcagggcttggctgaaggggtccctaaggaagcgcgtgttcttatgtaccacctgccggggcttcttaaacagctgctcctcgtcagggacacctggcagacgaagcaaaggtagcagcaggtgtcagaagggcagcagcctaaggagcatgaggagctcgcttctcggccaagtcactcccagatgaacaaaagcattgagcagaacgcaggccccagtgccgctggagagggtctcactcactgctgacctcacacagacctgtccacccttagacagaccagtacccatcagaagcccaaactgcaagggggcacggccatacacacctggaaggctgctccaaacacagccagacacacacagctctacccaacacctccccatttggctgcgaggcccgccacttaccctctggatagtacatgagggaattcttggccttgtacttccaggtctccacactggcctggctgctctcgatggcctggtgctctgctgacgggagttcgagattatctttctgcctctgcaatcacatggggaaaagtgatggtcagagatgcccctgggcattgtacccatggccctggggctccccaaccaccacagagggtgcctacgcctatgtgacaccccagaccccagagacaccttctcaaactcttcctcagcctggtagagccaagcgtggcgtgcccggcttctctccttggccacctccatgatctcctggaaggaggcattgtcctcactcgtgtagcggctcaggaagacatctaggctgggcagcggctccttctcctcctcctctccagcctctcctgcttaggggttgcgggaggaggaacacagcaccctttgcagtcaggaaagaggaggacacccaggcccaggaatcatagcccccaacatgcagggctggaatcctctcccctggtcctggcttctgcccatgaaagcccacactgccaaggactccccacgggggcagaatccacccaccctgactgcccagagagccctcaggtggtaccctacagattcagggccagctctgctcatgtgctggatgccaagggaattacgtggtctgattcagactggagaaagcaatacaggtgttagagcaagagctcgtgatcacaggcaggctcctcccccaccaaagtggtgccaggcctgtgggtgccaggcctccaaatccctggggctctccctcactccctaggatttccttaccttacccactcttctcttcctggtacctgtactacaggtgggtggtcatcgcctaatcatcctgacctgagagcgagccccaattccagggatctcatatgacttagtcctctggatggggcctcacaggtgctaagccacaaccccaaacacccccccctccgaccaaccctgccaccatggaaagtggtactcccactgaggtggtgccctggtgctgcgtgtggtggtgcaaacttcggtggggccacctggagagctctgccttcaagtctagtgacagtcctgaccacctgctacacgtgaggctatgcacaaggcacagtggctacaagctcaagacccacgggatgaggacaggggtcagaaactctattcatctcagagagataagaagtgaaaccctgaccatctctgagacctgcagaagtgactgcctttctgagcctcagtttcctcacctgtaaacatgatgatggttcctaccacttaggttctgaaaaggattcctatatttactggcatgtaggtgtacaggtattgaaaatctgcaaactggctaggcatgatggctcacacttgtaatcctagcacttcgggaggccaaggtgggaggatcacttgagctcagaagtttaaaaccagcctgggcaacataatgaaacctcatctctataggaaaaaaaaaaaaaaggagaagaaaaaaatctacaaattgccctgtgatgcacaagctacatttcaacagataatcaagcttcaaggacaacaaggactgtgttaatggccgaaaaagctggattgtaaagcaaaaagtatcatgtttgcatgtttgtgcaaacacacaacacatctgtgctactccagcacagtggagtctacaaactgataagaaagagtgtctcgtttgtctatacatgcactgacattctactactgatgaaaagagggcctgacaacgcagaagtcccatggcgtgcagaacacttgcattcaacaggactcggagtgccctttcctaaaccgactcccccatcaagtcacgatgttaccatatagagctgtgtgtcccagcaaacatgctgaagatgacaactctttcatctgttccatgtgtatctgtgcaaggcccacaacaccacatgtgctgttcccaacacggagcatacagatgaaagcaaaacaaagcttctgctcttgtgcaagggatgccaattagggaaagagaccataaacagaaatgcctttaaaacgttatgtcttggccaggcgcggtggctcacacctgtaataccagcactttggggggccgaggcagacagatcacctgaggtcaggagttcaagactagccgggacaacatggcaaaacctcgtctctactacaaaatacaaaaattagccaggagtggtggcaggcgcctgtaatcccagctatttgggaggctaaggcagggagaattgcttgaacctgggaggtggaggttgcagtgagccgggatcacaccattttactccagcctgggtgacagagcgagactctgtgtcaaaaaattaaaaataaaatgaaattaaataaaataaaatgtcttgtgatgaaaaaccaaagccaggctggaagccacagagcaccagtggtgttgtgacttcacactggcaggtcaagaaaagtttctctgaacaggtaacacctatgcagagatctacaggaagaaacacagtgagccatgcagttatctgggaagtgaccaacatgaaggaaacaaatggagaggccctgaggcatcttcaggatagtaacaaaaggggccttccaacatccatgaagcccacagggcagggctggaacacagcagaaaagccagcaagagctggtgagagtcccatttcacagaggcgagccatgtgtgggagctggacccagatgttctaccacctagaccaatgtcctttgacttcacaggctgctatttacgcaagacccctcaggaacaagatgtggcctgcagccctctggaccaccccctcagggcctcacaggctaagattcccaggcaatcctgaccatgtgacttaaagagggcaccctcactcaccatcctccaggcctcggccgcggggcctgggcttgttgcccaccactccagtgcctgcatgcacctcaggggtttcaaatgtggctggagtcacatctaggggaagagagggggataagaattagagtgagcctgaagcgacagttcagcaggctttcccctctccgccacccacagggtcctcatacagggtggcgggggctcccgggacatcttgcccaaggcagagccaaacttgatggcaatctggcgcatccgttccaagtctccattctcctcggcttccaggtactccttctgtgcctggagcttctccacatcaggaaagaaatccctttggatgaccgtctggaggccctgcaaggagagatcagaatgaaagtcagaggccaggcgcggtggctcacacctgtaatcccaacactttgggaggccaagggaggtggatcatgaggtcagaagttcaagaccagcctggccaacatggtgaaacccagtctctactagaaatacaaaaattagccgggcgtggtggcaggcacctgtaattccagctacgtgggaggctgaagcagaagaatcgcttaaactcgggaggcggaggttgcagtgagccaagatcacacccctgcactccagcctgggcgacagagcgagaccgtctcaaaaaaaaaaaaaaaaaagaaaaaagaaagtcggagctgcagtctgggtgctcctgcctcacaggtccactgctgtacatgctaaggaacttgctgaacctccttcaaattctacttccccaatgactggggctggattgagggagcttgagggcactttctagtggggttgagcatcccatatggtagccatgctgcaacctctaacattactaaacactcttctgaagtccgtgaaacccttctctctcgcccttgctaactggtcattctcattctccattgctggctccccacaagccagaccaatgtgggtgttgtcactttcattccacacatgactttctatttccaatctaaacctttctcctggcggggcatggtagctcacgcctgtaatcccagcactttgagaggccaaggcgggcggatcacctgaggtcaggagttcgagaccagcctggccaacatggtgaaaccccaccactactaaaaatacaaaaattagccgggcgtggtggcgggcacctgtagtcacagctactcggcaggctgaggcaggagaatggcttgaacccaggaggcagaggttggttacagtaagccgagatcgcgccactgcactccagcctggacgacgagcgagactccgtctcaaaaaataaaataaaaataaacctttttcctgagtaacttcagccagtcactaccacaagttgagattcccaagtctgcacctccagccagaccttgctcccgagctgcatatctgggcacccaaccgtccgttaaagccatccatctacatatcccaaaaggtgtcccgaattaaacaggtctaaaaccaaactgacttccgccaatccccgtttcagctcctccttctgtgtgcgtgtggtggggcgacgcaggtccactcactcgagatgctgtcacaactgcggtctctttccaggaaccccagcattcacacttgctgccaccgctctttagaaagccctctttgccaccatccttccagtttgtcaaactcctactcacactttaacagaaaatcttctttccctgacccccgtcccatacaaagagagccgctctctcttttccctgacaacactactacagcctcttccaccacagacgtcttcctctgccctgtttacttgactcgtgggaccgtccacacccggctcctccacttccacgaggagacggagtgtcaacacccgagagagggaacctgagaggagcttgaagcagaggatgggcccagaagtcgccggcgtccgcaccgaggtcgtacctcgatatactcttcctcgtccaggacccgctgcttgctcgtcgcagccccagcctctcccgcctcgcgcttcctcgggggcctggacgcggcgggaagcaacaaggacgacgctgatgcgcccggcgtctccatcgctatcccaggaaaaagctcgggcccagcaggcgcgtcacagggtggagggggcgggactgcaccatttgcgcaggcgcctccaatagttggccaatggaaaagctgtggctctagaaagccagcccgcgctccgttctgacgtcactataaatgctagactttattggaaatgtagtccttgtcctgccccgcgctattcatgcttgtcaatgctgtgaacacgagggggtgctgtggaggtggcggggaggatgctatagggcgtgttcttcacgcgagaaattctggctttgcagcgtccaaaggccttagaattctaatttcccacaaataagaactatgtatgcttcgagattattctacaaaaatacaaaccaggaaatttacttatataggagtttcaagctttatgcaagaaaagggccttaaaacaattttttttttgagacggagtttcggtcttgttgcccaggctggagtgcaatggcatgatctcggctcaccggagttcccgggttcaagggattctcctgcctcagcctcccgagtagctgggattacaggcatgggccaccacgcccggctaattttgcatttttagtagagacagggtttctctatgttggtcaggctggtctctggattacaggcgtgagccaccgcacccggccaaaacaatcttttttttttttttatagttatctaacaaaaggtgaaagaacaagacagtggttcgattaagaaatgtctaaagattattctgtaatcccagaactttgagaggccaagacaggcggatcacctgaggtcaggagttctagaccagcctggccaacaagatgaaaccccatctctactaaaaacacacaaaaaaattagctgggcatggtggtggacgcctgtaatcccagctactcggaaggctgaggctggagaattgcttgaacccaggaggcggaggttgcagtgagctgagattgcaccattgcactccagcctgggtaacaagagcaaaactctgtcaaaaaaaaaaaaaagattattgggcccccaaatgccagagtgggcttcccagaagagggatcattctcattcaagaccaggcacggtggctcacgcctgtaacctcagcactttgggagacccaggcaggtggatcacttgaagtcaggagattgagaccagcctggccaacatggtgaaaccccaactctactaaaaaaaaaaaaaaatacaaagtggtggtaggtgcctgtagtcccagctacttgggaggctgaggcaggaaaatcactcaaacccaggaggtggaaactgcagtgagcagagattgtgccactgcactacagcctgggtgacagagtgaaactctgtcaagaaaaaaaaaaattaatattcaagtgaaccagaaaattgcctcggcatttttaaggaatttcttcccaaacgaaagatgtgaattgtgttggacaaataaattccgccctggaacaatttaatacaattttgcttttgcaacatacagggataccttcattcactgaagtgcagcgtgctgctgctgcccttgtagaagtgacagtgcaatggggaagacagagacacttgttagatcatcacacaaacaggtgtaaaattgcagctgtgtccgtgcaagaaaagagtttgtacttggggaatcttgacctagttcgggaggtcagagaagcttccccaggcagaaagtgattgcagattcaaaagacgaacaaaccggcaacagtcaggtggaaagagcatgtgcaaaggcctagtggtgggagggagcaaggcaagttctaaagaagtcctttggaaatgcagagtgcagtgaggtgtgagatgatgccagagaggcagggccaggctgcacagggccttgtagggtatggtgaggtggtttgtcttcattctgaattgaaggggcaggccaggcacagtggctcatgcctataatcccagcactttggaaggcctaggccggcggatagtttgaggtcagaagtttgagaccagcctggccaacatggcaagacctcatctctacaaaaaacttttcaagttagtcgggtgtggtggtgcccacctgtggtcctagctactcagaaggctgatgggggaggatcgcttgagcccaggagctggaggctatagtgagccatgattgcaccactacactccagcttgggtgatggagcgagaccttgtctcaaaccaaccgacaaacaaaaaagcagagccagtgtggtgcaggtggacaagattagagacagttgcagtggtcaaggtgagaggtgacggtggcttacatcagactggtgcagttagagctggagagattctgggatttattgatttattgataaacagtaaaactgacttcctgtcagcctgggtatagtggatgatcaggagagggaggggtccagggaccagtttcgggtgggcggctagctctctggctcatgtgcctggtttgcacagaagagctcactgtggacaaggtgaccttaaggagtctgtgggcttcaaggggacagctggagataaatacctggctcaggggaagtgcctggcttgagatgtaaatgtggcagaaagatgggaattggagtctgagggtaaaagataaaccgggaagagggtgaagatgagaagcgagcgcctgggtgtgagcgtgaaggatgcctatgttaatagcctgctgtggggggtcagcctgccaaggagcagctagagctcaagaagcaaattcaggagagcaacacagccactgagccctggaaggtggcgctccacaagctctgatcggggctcccaaaacaatgacagatggccattcaaccaaggaactcaaggggcctggagcctgtgagatgcgagtgtccccagctgcaagggagctgactgggacacgggcatgtccacaggtagtctgttcagtccccaagggcaagaccagggttcagggagaagggctttgtgtgcatgctaggggtggaggcggggatgctagggacacccagcagtgtcagggcagttctgactggggacaccatgcttgcttggtgttatccaagctggccagccttggggtgtctggggagctgcagccctggcttctgcagtcctgcttttagagatggacttcatctcttgcaggtagaatggccccattccctgcagggcctgtaaggagacagaacgaggtgctcaagccagctgggggtggggatgtgagatgctttggacccactgtagggcctacttggggaatctaaggcttctttccactgtgccttttgccatgggccaggataaagaaggggagggcaggcatcttcccaggcagcaggggcggggtctccccagtccaacctcctcttgccctaccctaggatggcacagattgctgtgagggagtccgagcccacagcatgaaaaccccaggaggaagcaggggaccctcacccatgggcaggttcacagtagcctagaggccagggctggaccccaggggtccaaggccaccatccgtggagcagtcccctctgctggggagcaccctggtgcagagactgaggatcgctgagctgtgctcctctcaaagacagctgtaccctaaataccccctcgctgggaaggaagaagaagggacagctccttgttgggtgtgggagtggagccaaggtggacttgagactctgggcggcttctgtggtatttgaagttgctagtttctcagtatcagcgcgaggctcgaaggtgaagggactgtggaggggctcctggaatcgctcctgcgaccttcttattctacaggtccagataccaagacccagcccagggcctgggaagcctgcaacgccaggactgcacagacacgaaccccatcccctctcccgctgggggaggacgagccaggtcaagttaggtcaatgtccacattgagaagagggtggccagcatgtcccagggtgcggagagacgctccactgcgtaggattctgggtcccgtgttgatacggggtggttcccctcctgcggtggagttagtgtctctcggggggtagggagctgaggaaactgctctatgccccagcccacccccaagggactcgccactcccactgccgtggaacaccaagcaccgggggcccgtccccagcgccacggcagcacgagctgcaggaggcaagggctgtggagacgggtggaggcggccggtgtactctcccagctccttttcgggtagacctgtcttctctcagcgccaactccaaagatcccaaaaagggtggccgagcccaggggcagctcctagagtcatcagcagctccccttcggggacttcttgacgccgggcaggagcctcgcggaagccgacgcgcgcttctggtgtcgccatttggcccggcggttcttgaaccagacctggggatggggggaatgctcagccctagccccaggtcctgcgtcccaccggctcccgagggtcccacagggaccgagaggggagcttcgcaacagggatgtgggcggacggcgctgtagagccgacacccgggccgcggctgcgcgccacctgcccttattcgctgcggacagactcggtgggtctggacgcgagatgggaacccccttagtacccgccccagcctccagctggcggcgaccaggacgccccttcttgggttgcgggctcttctgaatttcccaaattctggacgtgaacgcgggcctctttcgtcaccagaggaaagtgtaaaacaaaagaaaagaaaagtagccctccggttcctttcccgcggcacctccctgctctcacccgctcctcatacccccggacgcccagcgccgtccagggacctcctccctccggcgcgccagggcggggcttgggccgaggccgtctttgcaaagggcgcccgcccgccaggaccccagtccagtgtagccgcggcccgcgcgctccggggaaaggctgggcggggcactcacctccacgcgctcctcgcgaaggcggatgcggccggccaggcgctcgcgcgtactcacgtcaggatactggttctgcacgaaaagcgcctcgagcgcctgcagctgctcttcgctgaagatggtgcggtggcgcctcgtgcgccgctgcgaacccgggccgaccgcgcccgggagcgccccggaacctccggctggcgcacccagagacaagggcaccgccggtcccagcctcagcggccacgccagacgagcgcctgcggagcgagggcgcggtgaggcgcggggctggggccaagctcggcacccactgcgccgcgccccgggctccgccgggccccgcgccccgctccgcgcccactcacccagcccggcggccgcctctgggggcccgcagggcgccgcgcgggggccgcagcagcagcagcaggcgcagggcgcagcctcgggcgccccgggctcctctggcttcgcggggctctggcgaccggcgggctgcggtgggcaggcggcccgggccgggaggctccgctcgggcaggctggagaggatgtgctcgatggagaaggggcagggccgcccggcaccccggcggctcgccgcgcccccagccgctgccgccatgcccggcccggccggggcgccgccgccgcgggaatatatacgtcggggagggagcgcgcagtaatccccgggccgggcgtccagtccacgcgggttaatcccgcagcgccggccgcgaacgcgctaatcctcgactgcggcggccctgcctccgcgcgcgggggccgggggcgctgcagagagggccccctgtgccccccaccccgccccgcgtcctcctgccccacccgcgcccgccgctcaagctggcagggcgacctgcggggaaggggcggagggccgcctcgccgccgcccgcggggcctggcagccgctcggagggcgccccgaccctggcagctccccagagcgcggcggtgcctcccggcccagcctctggtggctccccctcgttcggctgggcctaattcctcgtcccctctggggccctactgcggcggctcagcacgcctgcagaagctcggcctagccgcccacccgaaactcctggaccgcagcctccatggggcccagcaccaccggcaaccgcacgatcccgccgcgctcgggtcccgaacctgcccgccacctcggagccagggtctcatggccctggagggcgtgagagcgcggcaggaagcctgggctgccgggtgcccccagttctccgtctcctcacctgtgtcaaggagacctccccgccccttccgaggcccctcctcggtgcttcagagccgcctgtcctccagctttcccactggtcccagaatccccgcgaaaacatccaacactgcacctcgcccttccccgcactgtcactgccccccagaagctgtgggctccccctcctcgctctccgcccaggccagtcctctggccacaccgtcctcggtcccttctgccacagcgcaggtgacccgcacttggctacattgtttcaccctcagtgaagcggctcctggcagcgggaccgtcacttcagcttaagaccctttcctcttgacctttgaaaatacagtatgggactcatagcacagagaaacagacggcctggctcatactccgttgtcaatttctggccgtgtgacctccataggcgtcttcagcctctgggcttggctttcccaatctgtaaagtgtagtgactaggtgtgagacggttagaacctggccgcctccccagggcaatgcgtattcctgcgctcctcccgccgccagcccctctgcaagactctgccatccccactctgctatcagtgaaagtgctgtggacatcactgtgaccgaacctgctgatttaatttctgtcacaagagctcccacataggtttcccaggggtagtctggaggctcagtgatgagctgccacctccatgagtggctctgtcaacccctcctccacccacctcttggtggtagaatggctgccacagccccacacttttcatctcctcccatggccctttggatggccatggatccctcctccctcagcagacctccctcacagaactgcatctggaccatcctccaaaatcagagtgctgctatgatgggggaggcagggtcattggtcaggagagccagcccaacatttgctgagccctcttcctcctagccctggccattccttcatcctttcccattctcaccctcaatacctattccagccttggagctccagacaccatctttgtgacagtgactcacaagtgcacctccagcctggcctctctctctgctccacgctcttgtttctggagcctgctccacatctccatctccactaccaataaagttctcccagtcaccatgccagaaaggaactcaaggtcttctcaaaatccctttcttaccctatgttctccacttttacaaatgggccactgcccacctgtccatctctagtgctcattctcttctacctatttgcctctgcgtgtgccctgcctctttaccagtccaccttggtaaatggcccactgtggcactttttcaaaaagtttattttctattttgcattattttttgagacagggtcttgctctgtcacccaggctggagtgcagtggtgtgatcatggctcactgcagccttggcatcctgagctcaagtgatcctcctgcctcagcctcccaagtagctgggactacaggtgcaccaccatgctcagctaatgtttctgttttgggggggttttgccacgttgcctaggctggtctcaaactgccgagctcaagcaatccgcctgccttagcctcccaaagtgttgggattacaggcatgagccaccgtgcctgcctggcctgcccccctcccttttttttttttttttttttttttgagacggagtctcgctctgtcgtccaggctggagtgcagtggcatgatctcagctcactgcaagctccacctcccgggttcacgccattctcctgcctcagcctcccgagtagctgggactacaggcgcctgccaccatgcccagctattttttttttttgtatttttattagagacggggtttcaccatgttagccaggatggtctcgatctcctgaccttgtgatctgcccgcctcggcctcccaaagtgctgggattacacgcccggccttttttgtttgtttttttacttttgagacagggtctcgctctttcacccaggctggagtgcagtgggtgaccatagctcactgcagcctctgaacacctgggcttaagaggttctcccacctcggcctcccaagtagttgggagcacaggcacacgccaccatgcctggctaatttaaaaaaaattatagatagggtctcactatgttgcccaggctggtctagaacttctgacctcaagcaatccacctgcctcagcctcccaaagctctgaggttacaggtgtgagccaccgtgcctggccactctggcgcctctgaaacatgctggcaggttctctgatgctgctccctttgggagtttaattgggtttcttcctgaaacatgggctggccttcacgacttgcttgtaatccatagaatgcagcagaactgacatcgtgtggtttctgaggccaagtcacacacagagtcacacagatcagatcagcaacccaactccttctctctctctcacacatcttgggatgcttgatctttacacccagccaccatgctgtgaggggcacaggcagcctcgggagaggataggcgtgttcctgccagcagcaccagctgaaggacccatccaccccctgcacgggtcacctacaagtgagtgaggaagccttccagatggctctggccccggccaccattggactgcaaccacaggagacaccaaaactgagaatcccctccctgagcccagtcaagccccatgactatgaaatataataaaatagatgatgctgggtgtttttactgcaccaagtttgatgtggtttgttatataactatagataagcagaacgggatctggtactggaagtggggtgggtgctgctgatacaaaacctaaatcatgtgacattggctttgggatggggcagtgtccaggagctgggaggaccttgcagaggctgacagtggggacttagaggaaagtgaagaaattgttactggaagatggaggaaagaagaccattgttatgcagtggcaggaagtttagcaacattgtcacctgtagccaaataggaaatagaagctagatagtattcccaagaataaaatgatctaaggacatacccagagagaaagttcaaggtgctacttggcttcttctagctaccaataataaaaagaaagaagatatgattcaaaaagcaagatttagggccgggcatggaggcttactcctgttatcccaatgctttgggaagctgaggtgggagaatcacttgaggccaggagttcaagaccagcctgggcaacatagcaagaccctcatctctataaagaaaagttttttctttaagatggagtcttgctctgttgcccaggctggagtgcagtggtgtaatctctgctcactgcaacctccgcctcctgggttcaagcaattttcgtgcctcagcctcccgagtagctgggattacaggtgtgtgccaccatgcccaactaatttttttgtatttttagtagagacggagtttctccctgttggccaggctggtcttgaactcgtgacctcaggtgatccgaccgcctcagcctcccaaagtgctgggattacaggcgtgagccaccttgactcatcaccctggagcttcaggtacttctcttgatgtcctcatctcctaacatccttcctcttcctccccctcccctcccccttcccctccccctcccctccccctcacctccccctcaccctccccctccccttcccctccccctcctcctccttcttcttctccttcttcttttcttttcttttcttttctttttttttttattttccaagacagagtctcactctgtcacccaggctggagtgcagcagtgtgatcttggctcactgcagcctgcctctgccttccaggttcaagcaattcttgtgcctcagccacctgagtagctggattccaggcatgcactgacatacccggctaattttttgtatttttaatagagatggggtttcaccatgttgcccagcctggtctcgaactcctgacctcaggtgatctgcccatctcagcctcccaaagtgctgggattacaggagtgagctactgcaccaggccctcatctcttaacttctaatcttgctctgtccaggtccctgaaccaaccagctcaactatttgctacagctggtgggtcttgcaggttctgcctttgcagagtggatggcacagtgctcacagaaactctgccgtttgggagtctttgccctcatgctccactgccgttcagggctgcctgagtgagctgtggggcagatgtcataagtgaggccacatgggatggcagtcacctgctttcacagcttacgtgtgtcctctggacttgctgagagctgatcctcgtaatgccacttctgttgtgtggatggttggtaccttgagacctggtggcttggccaagcacagtggctcacgcctgtaatcccagcactttgggaggccgaggcaggaggattgcttgagctcaggagttggagaccagcctgggcaacatagcaagaccttgtctctacaataaataaaaaaattagctgggcgtggtggcatgtgcttggggtcccagctactcagaaggctaaagcgagaggatcgcctgaaagatcgcctgaacgagttcgaggctgcagtgagccgagatcaaaccactgcacttcagcctgagtaacagaacaagaccctgtctcaaaaaataaaataaataaagcctggcatggtggctcatgcctgtaatcccagcactctgggaggacaaggtgggtggattacctgaggtcaggagtaccagaccagcctggccaacatggtgaaaccccgtctctactaaaaatacaaaaattagctgggcgtggtggcaggcatctataatccgagctactcgggaggctgaggctggagaatcgctttaacccaggaggctaagttgcagtgagccaagatcacaccagtgcactccagcctaggtaacagagcgagactgtgtctcaaaataaaataaaataataaaataaaataaataaaagacccagtgggtgtctctgacaatacccagctctaatgagccttctggtcactcagtagcccatcgtcagatgcccagttcctgccagggcccagaaacgtggaaggagctgttttgttttgttttgttttttgagatggagtctcgctctgtctcccaggctggagtgcagtggcgcaatctcagctcactgcaacctccgcgtcccaggttcaagtgattctcctgcctcagcttcccgagtagctgggactacagacacctgccaccacgcccggctattttgtgaatggtatgtggcatggccttgctccagaaccctaggagtgggcactgccacccttccactgcagcctgctgaaggcgccacatgaaacctttctctgccaagcgttggccatggctctgtcaggtcacagggtcaggctcagggctgctggtaccacagcctggacctgcagcaaatcccatactgccctaggctctactaaaagctggcatcctccatatcacccacaaatttcttgggcagtattcccaagttttttccgcctccaaatcgcaaagaagcctcaccctgttgtgttctttcatagtggtgagaggagctgggcgctcgcccttcgccttggaggagttgctctggcatcccaggccgctgggctcccagaggctgcttttttttttgtctcttcttcattaccggtttgtgagagttctttgtatatttaagatactagtcccttatcagatatatgatttgcaaatattttctctcattctgtgggcagtttttactttttccttttctttcttttttttttttccagagacagagtctcgctctgtcgcccaggctggagtgcagtggcgcgatctcggctcactgcaagctccgcctcccaggttcacgccatactcctgcctcagcctccccagttgctgggactacaggtgcccgccaccatgcccggctaacttttgtgtttttagtagggatgaggttttgccatgttggccaggctggtctgaccttaggtgatccgcccacctcggcctcccaaagtgctgggattataggagtgagccactgcacccagcctttacctttttttttttgaaacaaggtctcactctgtcgcccaggctggagtgcagtggcatgatcatagctcactgcagccttgacctccttggctcaagccatctttccatctcagcctcttgagtagctgggaatacagccaaatgccaccatgcctggctaattgtaaaaaatatatatatacgtatacacacacacacacacacacacatatatatatttgtagagacaaggtcttgctggcctggcacagtggctcatgcctgtaatcccagcactttgtgaagctgagatgggcggatcacctgaggtcaggagttcgagagcagccaagccaacatggtgaaaccccgtttctactaaaaatacaaaaattagctgggcgtggtggcgtaggcctgtgtcccagctactagggagtcaaaaaaaaaattgagacaaggtctggctatgttgcccaggctggtctcgaactcctggggtcaagcagtccttccacttcagccacccacagtgctgagattacaggtgtgagccattgcgcctgcccgttttttgcctttttatttttagagacaaggtctcactatattgcccagactggtctcaatctcctgggctcaagtgatcctccagccacaggctcccgaatagctggaagtccagacgctcaccagcatgcctggcttcagctggcattttaataggagttatattgaatctgtagattagttttcggagcaatgccatctcaacaatatttaactcttccaagccatgaacattagatgtcttccatttatttagtgctttgatctctttcaacaatgttttgtagttttcagagtttaagttttcattttgtttacatttgttccctaatattttgttcttttttttttttttttttttttttgacagagtctcactctgttaccaggctggagtgcagtggtgtgatcttggcccactgcaatctccgcctcctgggtttgattcccctgcctcagcctcccgaatagctggcactgtaggcgtgcaccaccacacccagctaatttttttttttttttttgtattttagtagagatggggtttcaccatgttggccaagatggtcttgatctcctgacctcgtgatccgccctccttggcctcccaaagtgctgggcttacaggcgtgagccaccgtgcccggccaatactgatgcattttatttctttttcctacctaattgtagagctttcttttcttttttctttttctttttcttttttttttgagacagagtctcactctgttgcccagctggagtgcagtggcatgatcttggcctactgcaacctctgcctcctaggttcaagtgattctcctgcctcagcctcctgggtagctgggattacaggcacgcaccaccacgcctggctaatttttgtatatttttagtagagacggggtttcgctatgttggccaagcttgtcttgaactcgtgatctcaggtgatccacctgcctcgttctcccaaaatgctaggatcataggcgtgagccactgtgcccagcttagagctttcaatacaatgttgaattgaagtggcgagagtgtacatccttgtgttgttcctgatcttagaggaaaatgattcggtcttcaccattgagtgtgatggtagctgaggatttttcataggtgccctttatcaagttgtggaagtgtccttctttttttttttgagacaaagtctcactctgtcgcccaggctggagtgtagtgacgcaatctcctctcactgcaaccttgcaatctccgcctcccgggttcaagcagttctcctgcctcagcatcccgagtagctgggattgcaggtgcgtgccatcaagcccggctaatttttgtattttcagtagagatgggttttcaccatgttagtcaggctggtcttgaactcctgacctcatgatcttcccgcctcggcttcccaaagtgctaggattataggcgtgagccaccgcgcccagcgtgtccttctagttttgggattaaacaacatgatccactggtttttgcaggagccagataatgtattaaactgggatttgctaaagaccacattgcaacctcctttcaatctttatttatttattttttgagacagggtcttgatctgtcactcaggctggagtgcagtggtgtgatcaacactcactgcaacctcaccatcctgggccctggtgattctcttgcctcagcctcctgggtagctggcactgcaggcatgcaccatcgtgccgggctaaattttgtgtttttttatagagacagggtctcactatgttgcctaggctggtctcaaactactaggctcaagcgagccccctgcctcagcctcccaaagtgctgggattacaaggcatgaccagccactcccggccatcctttcaattttcaactgagacctctaagctctgctatccttcctgggacgcagcactgtatttttttcttttgagacggagtcttgctctgtcgcccaggctggagtgcagtggcgcaatctcggctcactgcaagctccgcctcctgggttcacgccattctcctgcctcagcctcctgagtagctgggactacaggcgcccgccaccacacccagctgatttttttgtatttttaatagagacgaggtttcaccatgttagccaggatggtctcgatctcctgacctcgtgatctgcccgcctcagcctcccaaagtgctaggattacaggcatgagccaccgcgcccggccagcactgttttttttatcttggtaggggcagttcaggaactttcatgtagcctttattgcaaaacaggtctcacttttgagaactgaaagtaaaatcctaagcactcccaccaactgaaaagatcccccttgaccaaaggaccccagagaaaccttaaaaactgagttaacagccatgacaggacagaaggtcagacatgcctcgctgtaccctgtcccttttgtggtttaggcacaactgaccaacattaatgttaaaatagagatcataagactgacagaagagactctggcaaaacgataccaaattataaacaggaccaaaggccatgctaggcaaggattaagtcatgcacccctatacttaaagaagaaactatattctgtcacaggtggtttttttttcctctaacagttaaacaagcactagcctcaagataaacaatattaaaacaattacaactcaaccactgccagacactcactgaccctcctgttgtacaagccacaactacagctttgataggacatgagactggatttagtaactttcttctgataaaaagaccatccaccctagactggttctggctggttacagaggctgcacacttgcgtgccttcacgtccgtccctacttcaccttctgacgtgtagggcctaattgtaatgcatttaaatgtgaagtctccgccccaaagtaaacatggctgcatgggacatgcgtatttgcttctcacatatgcacatgttcccccttcatgaatattcacagctcctcctagatcctgttaaatatgtatacttggctggcctggtgcggtggctcacgcctgtaatcccagcactttgggaggctgaggcaggtggatcatgaggtcaggagatcaagaccatcctggctaacacggtgaaaccctatctctactaaaaatacaaaaaaattagctgggcgtggtggcgggcacctgtagtcccagctactcaggagaccgaggcaggagaatggtgtgaatctgggaggtggagcttgcattgagccaagatcgtgccactggactgcagcctgggagacaaagtgagactccatctcaaaaaatatatatatacacacacacacacacacacacacacatatatatacatatatatatacgtacacatatatatacacatatatatacgtacacatatatatacacacatatatatatacacatatatacacacatatatacacatatatatacacatatatatacacatatatatacacatatatacacatatatatacacatatatacacatatatatacacatatatatatatgtatacttggctctcctattcagcataaattcctgtttcaccgctctcatcctaaacatgcctgtcttttgatctctgcgagaggctacacttcccagcctggccgccttgcaggctataaccctttataagaaataaagttggcagagcacagggctcatgcctgtaaccccatagtcccagcactttggaaggctgaggtgggaggatcacttgaggccaggagttggagaccagtctgggcaacatagtgagaccccatctctacaaaaaataaaaaaattagcaggtatggtagcgtgcacctgtggcctcagctacttgggaagctgagaggggaggatctcttgagccccagaatttgagactgcagtgagctatgattgtgccactgctctgcagcctgggtgacagagtgagactgtctctagagaaaagaaaataaataaagtctcctttctaaatttataaattgtgtgatttttcagttggcactctacaggttagaaatcactgtgaaagttctgccaaatactaaatatgtctattccaattatgcattcagaaactgcagaaataacctgtgagtagctcatgaattgctgggcccactgtgggatggaattgggccaggactttgcgtactgcccggctgtctgtgctcctgctctagcagggaggccatgagggcactttgggtcccaggaatcagtgctgacttggagccagtatccaacagcactaaaaagatctgggttttccctttccccagcgcacagctacctgagtaagcggaaacaggccccttcgtgaaaggatgaggggaatcactactagaagtacctttcatggtgttcctggctccttcctcatgggaaggagacttcagcagaggaggtctgggcctgagaactggctggacactgggcgacactgagacatttcagtgggcaggtgacctgacctcagccttttgcccttctattatttttacttatgtttttaaatgtaaaataaagacagcatagcatttaccattttaacctttttgtttgtttgtttgtttttggtagaggggatcttgctctgtcacccaggctggagtacagtggtgcagtcatggctcactgcagcctcgatctcctgggctcaagcgattctcccacctcagcctctggttgctggaaccataggcatccaccatgtgtacctaatttttgtatatttgtagagactgggtctcacttatttgcccagattcattttaaccttttctacgtgtgcaatacaagtgtgcattaaggatatccacaaggctgtgtaaccctctccgcgaccattcccagagctttcctaatcagaaaactgtaaccattgcacagtaattgcccttccctgaactcccagcccccggcgagcggggctcatggctgaataacactgcactgcatgtgcagactacattttgtttatccacttatccctccagggtccttgggttgtttccaccctctggctgctgtgaatagcgctgctgtgaacatgggtgtaatgcgcttgcttcagttcctgcattcagcccttctgggtatatactgaggagaggaattgctggggcgcatggtaattctatgtttagggttttgaggatccactgaacttttccacagctgcatcttacattcccaccaggttcccataaaagttctactttatccacgtcctcaacaacatttgttattttctggttttaaaatgtatagacatcctagtggggatgaagtatttttctcattctgacttttttttttttttttttttttgagatggagtcttgctctgtcacccaggctggagtgaaagtggtgcgatcttggctcatcgcaacctccatctcctggttcaagtgattctcgtgcctcagcctcctgagtagctgggattacaggcgcccgccactacactcagcaaatttttgtatttttaatagagatgggtttcgctaggttggccaggctggtctcgaactcctggcctcaagtgattggccagccttggcctcccaaagtactgggatcacaggtgtgagctattgtgcccagcctctttgcttatttatttatttatttatttatttttatttatttttttgagactgagtttcgctcttggcccccaggctagagtgcagtggcacaatctcagctcactgcaacctccgcctcctgggttcaagcaattctcctgcctcagcctcccgagtagctgggattacaggtggctgccaccacacccagctaattttgtatttttagtggagacagggtttcactacgttggccaggctgatcgtgaactcctgacctcaggtgatctgcccaccttggcctcccaaagtgctgggattacagatatgagccaccgtgctcgtcctctttgctcatttttaatgtttttttcttttttcttcttcttcttttttttttttgagagagtctcgctctgtggcctaggctggagtgcagtggctattcacggctcactgcagccttgaaatcctaggctcaggtgattgcgtgagccaccatgcccagccagttgtttgttgttgttgttgtgttgacttacattattttttccaatatttcatcatgaaaattttgatgaaattttcatcaaaatattcagataatttgaagggatattcactgtctagattattcaattattagtattttgctatagttgatttatcactatgtatgcattcgtcttttatttttacaaatggggtcttggtatgttgcccaggcttgtcttgaactcctggactcaagtgatcttcccgcctcagcctcccaaattgctgagattataggcgggagccacagcagcaggccaggattgttttttattaattttccagtggcctgccaatggtatatataaatccagtccatgtttgtgtagtcatctggtaactgttttagcatcccagcacacagtcaagaaaaataaactttaaaaataactaaaataactaaataactaaatggcccaggcacggtggcttacgcttgtaatcccagaactttgggaggccaaggcgggtggattgcctgaggtcaggagttggagaccatcctggccaacatagtgaaaccctgtctctactaaaaatacaaaaaattaaccaggcatggtggcgggtgcctgtaatcccagctacttgggaggctgaggcaggagagtcacttgaacccgggaggaggaggttgcaatgagccgagattgcgccattgcactccagcttgggtaacaagagtgaaactctgtctcaaataaataaataaaataactaaatggaaattctagaactgaaaaatgcaacatgagaaataaaaaattccctaaataggcttaacagcagaagaaagataacagtataacagaagagtcagtttgagactagccggataatagaaattatccaatctggggtgggatggtggctcgcacttgtaatctcagcactttgggaagccaaggcaagcaggtcacttgagctcaggagttagagaccagcctgggcaacatggcaaaaccccacttgaatttctacgaaaaatacaaaagttagccgggcatggtggcacatgcctgtagtgccagatactcggaggtggaggcgggaggattgcttgagcccaggaggttgaggatacagtgagccaagatcacaccactgcactccaacctgggtgacagagcgagactccatcttaaaaaaaaaaaaaatcctggcactttgggaggctgaggagggcagatcgcttgagcccaggagttcaagaccagcctgggcaacatagagagacccccatctctataaaaaatacaaaaaattagccaggggtggtggtgcacacctggagtcccagctactcaggaagctgaggtgggaggatcacctgagcctggggaggtcaagactgcattgagccatgatcctgccactgcactccagcctgggtgacagagcaagactccatctcaaaaaaaacaaaagcaagtaaaagaagattttttttgtatagagtcaataatatataaaagggcaaaaataggccgggtgcggtggctcacgctgtaatcccagcactttgggaggccaaggtgggcaaatcacgaggtcaggagatcgagaccatcctggctaacacggtgaaaccccgtctctactaaaaaatacaaaaaattagctgggcctggtggcggccacctgtagtcccagctacttgggaggctgaggcaggagaatggcgtgaacctgggaggcggagctggcagtaagccgagatcacgccactgcactccagcctgggcgacagagcaagactccatctcagaaaaaaaaaaaaaaaaaaaaaaggcaaaaatagagaaaataatgaagccaaagataaacaaaattaataaactaaactgaatcagaaaaaaggaacactaattactaatatcaggactgagggaagggatgtaactatagattctgcagaatttaaaagaataataagggaatataatgaacaactttattaataatctatagttaacctgcagttaatatcatactttctggcaaaacgttggttattttctccctaaaattaagagtaaagtaaggatatccatgacacttctattcaacgttgtcctggaggttttagtcagtgcaataaagcaagaaaaatatagaaaaggtataaagggcttggcatggtggctcatgcctataatcccagcattttgggaggccgaggctggaggatcacttgaggccaggagtttgaaaacagcctaggcaacatagtgagaccttgtctctaaaaaatattttttaaaaattagcagggcatggtggtgcacacctgtagtcccaactacttgggaggctgaggtgggacgatcacttgagcctgggagttggaggctgcagtaagctatgatcatgccactgcactcctgcctgggcaccagagcaagactccatgtcaaataaacccctcaaggccgggcgcggtggctcacgcctgtaatcccagcactttgggagaccaaggcgggtggatcacgaggtcagcagttcgagaccagcctgaccagcatggtgaaaccccatctctactaaaaatacaaaaaaaattagctgggcatggcggtgggcacctgtaatcccagctacttgggaggctgaggcagaattgcttgaaaccagaaggcagaggttgcagtgagcctagattgcaacactgcagtgtagcctgggcaatgagagcaaaactctgtctcaaaaaaaaaaaaaaactctcaaaataaaaaacctaagtgcgcaaggccatccactcagatacaccgccccacacatcagcgtcccaccccttcactatcaggctgtcactttgctgtgagagccttgtttaggttgagatcccctgcttctcctggagttcggctgtgctccactaacccccggggcctcatcttcatttctgtccacccgccggccagtctctgcatgtgccagctgggctctgatgcggggcactctgcttcatgctgttgatcggtgtgtctggatctgtcatgttctctcctcaaggaatcaacagtgcttagcaacagcctctcagtcccatggctcttggagttcctccccacctctcaggtgcccagggcactgcaccagtgacactgcctccaaatgtctcccatcccagttccccctggtgacagttcttactgtcacactgtgacccaggccgggggctgtcagttctccacctgacaccttggcatctacgaggatggaacaccacaaaatgctggaaacacgagaagagtgacagctcctcgttgccaccctgccggcgcaggagccaatttcagagtgctgtccttcaggtgggcttcccagggccacccaccagacacccactgttgaggtcgagttccctagaagcaaagcctgaagcaaggattcttgttctcgggctgttgctgagcgtgtgcccaggagagtgaggaagtctgtgctgccttccggtggtgctgagccctgaacggtttccaacaggagcttacttgttcatacttccagaggtcaggaacccagatcagggtgtcagcagtgtcgtgctctcggaaggctccaggggacagtctacccggtgcccttctcccagcatctggccttgctggacccactgggcattccttggctcacaaatgccccctcccatctccaccttggtcaccacatggtcttctcctgtatgtggctcttctcttctgaggacttcatcagtcttactgggttaaggacataccctactccggtatgacttcatcttcatttgcatggttcttgttgttgtctggtttacaggcagggtcttgctctcttggccaggctgaagtgcagtgatgtggtcacagctcagtgcagcctcaaccttctgggctcaagcaatcttctcacctcagcctccaaagtagctggtaccacagatgtgtaccaacatgcccagctagttaatttaagtgtaattacatctgcaaagatcttatttctaaataagttcacattcacagataggatgagcgaggactttggcatctctttgggagacacaacagaaacctagagggactccccatcctgatttgcctgtgactttcccaggttttggtgctgacagccctgctttccgggaaattccttagtcttgggaaaactgagatgcctggtcaccgtggaagtaggacagggctgggtggtagagtgcagactgctgagcagaaagctgtctctgttacaggtcagttttcatcattccacatggaaccgctgtggcagacactgagaacttcacagatctgaaccacctttcggcaaagcagggatgcccaggtatcagccattgtcagggttctgcctctgggtctggagggctgctgtgtgggtggctctcattccccaggacaattctccaagaccaaggtggccatgagccaccaggaggcaacagtcagcagctggggaccagtaggctgacccctaaaggggatctgaatagagccatctatgcacacccatccccttgtcttcccagtaaatggcccgcggccccacctactcacctgggtaaacacacacctcgactcctgtgcaccttggtaaacacacacctgtccgtccaggtaaatgccccactcactcacctgtgcaccttggtaaacacacacctgtccgtccaggtagatgccccactcactcacctgtgcagcgctcacctgactctagagctgctcaaggctcagctggtgggcaatgcttagcactccctactcccacctcggatctcatcgtccacctccagctccatctggtattgcccacgcctgtccctctgcactgcctccaccttggcgccagtcgtagatgtctgccaccggcacccccacagtggctggcttttgaacccactcccagcaacttttctctcctgtcctcctccccaaagtgagcctccccgagaggcgtcaatgcttgccacaaacagaagtcccatcatggcaccctcacttcagatgcccggagtgagtggtcctcagtccctggaagccctggactctgccacctctcccatctgtcccctccctcctcactctcagctgcccaggtccctggtcagctccttcaatgcatccaccctggctccttgacgccctatcctggggctcctggcacctctgcaagggggccttccctactgtccccacctgcacctctctagacaatcccagtgctcccggctgccaccatttctttccccgactaaagaacagacctgactgtttccaggactggatgaaactgaggcagatgaagagggcagggatctggaggggctgggggagaattagaggccacagaggaatggagctttgggtgggcacggacagaccactggatttggacagtcagggccgggacgcaggagcagctagggcccagggagccgggggttaggtccctcagatcccgcacatgcaaaagtgaggctgaggtaggggggtggtccctcggcatgtgagcccagggggttcccgagccaagtggcagccggaacagtggggagggacagccaaggaggtggggaggggtcgctggccccgctcagggctggttggggtggaggaagcccgggcccaggccgccccccgctgggtcgaggccaccccgcctcgagggcgcggccgtccggatctcctgattgctttctttcatctctgttcctttctcagccacaaacgcccgctaatgcctcttttatcacggaattaggggatttagggccggtcgcacaaaggggccctcgatagcggccataatcaaaccccaatcggccgaccttggacgggccggggaagaaaggagcgccggggattagcgcggtaccgcggccgggcaggcagagatagcatcggcgccgctgcggggctgaagccgcggagggctcggccgcgctcggagaaaggacggcttagctcctggagccggggattctgaagccattaggtggggattaacacccaagttaatctgctttggtcgctcaattgtcagcagcgaacgcgcgggactgaggaagcctggctcccagcgaccacagggccttgccacccagcagtccagagctacgagctggtatcagtttccccagctgtcacccggccaaggcgggccttggagccaaaagggagatgcacaccttggtgggctggccaacgggtctggatgagtggaccccctgccccgccagccttcctgggtaatcagggaactcagagaaggatgttcctgccccatcctgacccagaccacttgtggaccctgacagccagtgcagccctgggtgccacccacacactgagcttgggttgcacggcaacatgcatgacacacctgtccccatcaagcagggtcagggggcagcctgcagactgggtggacgctgacagcagctagcagcccccttgcagaccctccatcttccctttggggtccctgtccaggtatagccccctaaagacctctgttgaccaactcactgacagggcagatgtgacaccacctgctctcaattcatcctcactcttcatcttcagtcctctctcactaggcggcagagggagggactggacctatacaggtcccaggtaggtcctttgtctctgtctgggttttcctatctgaggaatggagccggctaaggaaaggcccaaccagaatgtgccagtgtcgtgtgtggcctgtgctcactgctatcttctgtggggacgcaaccccaaccctgactccttctcctgttcctgccagcaggcccccagagtaggtggctcagaggggtgtgcttacacctgcctcctcctccatggagatgtggcaaggtcactgtgccttacatgagcctacaggcagcaacaagtggctggactggagctgaccaggcaggcaggatggggtgggcagtagcagaggagaggccagtggagcgctctgggtccccatcttctttcccatggctgagactagggacattggaacaaaaagtcccaagtggaggaaaagacgcagtcataagtacatttgtctttccttccctctcatctcccttcctccctttcttccttcagcagtgaccaacgattctcccatccaggccctgtggaggggacacaggcgtgagccacagacccaggctctgccctctgggagcttgggtccgaggacacagttagacaaccggatgggagggcgcccttcgggaaggggaaacaggcaccccacatgcacagggccaggcagggcctgaagggcagtgtgaattacagggaaaatgcggagggagaggaagagtgctccagggcgaggaagccgcgcccgcagcgatctggagtgcggtggggagcaggtgaggcgggagaagcccagttctgggacacgcaggccagctctaggcaggggaaaggaggggcgggaggccagggaatgttccctcaggctggtgcgtcagaatggcccaggcagcctccagcgtgggcccccgctggtcccgggaggcgccgccagaggctcggggagggtggacgatgtggctgggccggcgagaatccaggggctgcaggcaaggacggggactcgcgatgaaacccgaagatcaggggctggtggcagtgaccgcgaggggcctccaagcagcccaatcaatctcggacgaggggtcgagtcagtggcggtgcaggcggcaaaggcagccagggtctgagcagcgcggctccagccccagcagcaacgggagagcgcgtgcgccgccccagacgactggacgcgccctcgtgacgccatcagcgcgcgccgccccaacttccgagcgcaagcgtggtcgcccccacagcctgtgggctacgggaacgcgatccgactcggcggccctccctgcctggatggccggtccccgaggctgaggaagtccattcctctttcggaaatggtccccaggaagcttctccgtgtccccctatggccgggtactgagcggggcccgggtggtctgcggccgtggcccccgcccctcagcgcaggcgaccctcctggccctggcgggcacagcgcctctcccgtgacctgggccggcccgcaggatgagcccccggatcacgatcgctggcattttatttaccttcttccattacaaccccaggcgagtctcccgggccccgagaggagggggtgactggtcagggtcatcggtagcggcggcaggggcctgcatagggctgcctcggggcgactagcagaatggccgccagcctcggctgccccagcccccagcgcatggaatgtgccccgggccccaggagctccaggaaccgcgcttgtgagacggagcttcggctgcttggagctagtgagccaccggccacggcagggatttgagcagaacttgggggcagagggatgagatggtgcatcccttgaggtcacttcaggagatgacactcctgtggctaagtgtagcttcccaggtcatggctcccaggtcaggcctggtcaatggagaattaagtgggcgttgggtggtggatggatgtgatttggcagaggggacaaatgtgacaacagtgtaataagggccatgttggggagggtcaggggtcagggtccggcccaacctgagcagaagggaggctgctctcagggatatttgtcaggtaggaatgggtggagtggaactacagggccaccatgtttcccatgggtcacccatggtggccttgtcatgtttatccgtgatcctcagtgttctctgtggtcctcccgtcacccctttcagactgtcctttcagttctccactgtccctgcatcacctctgcccctgtcccgtttgtctgtgttcagtccatgttcccaggtcttgaggtggcccctggttctatgccccttacctaagaccctgtgcagggaatctgtgaaaacacagaggaaataaaaagtgaggaaaatagtactcttgcatcctcgaccaagatagtgtttgttgtgagtgctgagacggaccagcattctctttgttggtgaagaggagacagacccatccacaggagtcattggcttttttgaatactaagctctgactgccattcatcatctacacagggacagaaaacccggtctgggggacgtggcacgcagcagtgtgtgaggggaatgccaaggaatctggggagcgtcaaggaatctggggagcgggaagatggagcggggtagctgcctggaggcctcagtcccacagcagtgaggacaaggctggaggttagccaagccctgccctaggtgtggtcacgacctcaccagctcccttttccttttctctgaggccattgtctctcctgggcacagtccgtaaggttcagattccagactgtgactttaactggtcaccgtggctctggctggagcaggacatggtgacctggagtctccatccactcctccgatgtgcacttagccacctcctggggctctccccagcactggccgagcatcctggttagtggggaaacgtggagcaccaggctagaaatcaagacccttctgcctgcagactagcttggagacccatccacgtgtctctgctcctctgccccttaagggcaggtgcgccccagtgttcttagtctgtgctactccctgctgcgggcctcctctctgcagtctggttaaatgcaacttggctccctccaggcccctgcctgcctctccagcctccagctctttcctgcacagacacctttccccttgggtctcagctccaagactggaggctgcttgcttcttgagggaatgtgtgaagcagcctacagtgtgggttctatctaccagagtacgtggctcctccatgctcgtggccccaagggactcagacccagctcaatcaacatttctggctgggctatctgatgtctgccgtgtgattcaaaggtgattcgaggtgaccctgaggatggcaggggtccagggagggtggagacccatgccatcctacaccctgctctcacctagtgcagcctcggccccttcctgtggagagggacagggacaggactcggtgcaggtgtgcagtgagtggctggcatctctggaggtcagtatgtgagggtgggggtcccctccaggcagctgcgagggcttggctgctcccagaactgcctggaacctggggagactgtaaacaacctcttgcaaccccaagaataaagctgccatgtgtgagggcttgctctgagctaagcatgattctgagcaccggcagggagtacagcaagtggatgctgaggcctggagggcaggccccagagagctgagtgcccctccaggtttcatggctggcactgtggaccagtgtggcccactgcctgcttgccaccccacaacaaagcttcagaggtgcagaaccagtggcctgagctccagggacaggaagcatcttggcgtggggttctcatggtggcacttgcatgccctagtgcacaggggcggaaggggaagctctgttgcctgggccctttctctgtggcaacagatggggaagtctgccgtgaggatagagagtgcatggccatcccatcacagcacaggttgagtgctgagccaccccgagccctccccagcccagcggctctccccaaggaggcttcaaaaccccgtgctccctttgtacccccaagcccatgcttggctctcagatccacctcgggccctttgcaccccagactcctccccagctgcacattcccgggattccaggcatctggtgctgtgtgaggtcactaggacagggcagtctccccagggacgggacctgttcacatggagtttctggctggcaaaagcttgttctccagtctgagccaaacgcttgcatgactcttcccccacggaggcacttggacaggaagctggcttctctgcacagccaggggcactaagtgatcccatcctgcctgagcgtcctccacgtggctcataggctgtggaaagaggggcttggccccatggggacatgccagttcagagctctggcctccagccagagggacacctttctctgaggctcatggctgtggcatgaggtgcccagagagccctggtcaggcagccccacctcctgctgccccagggcagctgcctcccagcccaggtgaaggaacaagggagggcccctgcccagagcctttgggtagcagatgccagacacccacccccacctggagttcagaggcctcaacgtgcccccatctcctcctccccacgagcagcccatttcactcactgaggagctgggcataccccagaggggccctgggcaacccaacccttccctaagcttccctgtgggtgaggggcaggcagtcgtcctgggggctccatctcctgggcccagccccctgctctgaacactctgccaggccacccctaggccttgtcaacacacccttttacccatgccacgggatcttgcccagaggccacagggaaggccagggtgcacccagatccttcttggcctggcgctgggcttctcagggagccaacactgtggccacagctgctctgccctgggtggacactaggctttccctgtccccctactgcagtgtcctcagatgggggtggcctggtcccctgcagaggcacagccaccaatgcccatgcatagatgggtccatacagggacgaacacaggacaggaggctgcaacaggatccggtttattctgccttggcagggtggtcctgagagtggtgggtgccaccctgtccggggcggagagagggcccgagggccagttaaggccaatggcgggagaagcagggggctgcagcccctggaatgcggtgaagccaggccgaggcccggaggcagctgtggtaggccagggcagggtggaaggcaccggactgggaccgggccagggctacagggccgaggacccaggccacacgggcaccccgggaggcggggcacagggtcacgtgacacagaacatgaaacacaggcacagggtcataggccagatgcacatccagccatggctgggccagacactgggacacagtggtggtgtcacacacagaccacaggggggacacatggatttgacagccacaatgcacagaccaggctacagagctcgagggacgtgggaaggggccttttggcactactgcactggaatcgtgagacaaaggtagcaggacactctggcggtgcctggggcggtccccttgcggcctctctaggcttagtccgtcttccacactttgttgagcagcttcaccacttcatcatagatgacaaacactatggccacatccaggcagacccggcccaggcgggggacagtgcccttgtagaatctgggtgggaggaggggcggggagaggaaggcaggtcagcacagtgtccctgcacagggcaatccccagatactgaagtgagaggcacagaggcctgaaggggacagagtgggcaggccaggtaggccgggaaaggtttgaggtggggacaatagccctgcccctcccccactcacgccttgagcccctccttcttcaggatctgcaagccgcagtcccacgtgttccggtatttgtgcgcctccaggccctatgggggacatcagcaggcaggggctcagcagctagctctggcctggtccccccttcccctccccttcccggccccaccacctgcatccgggtcttaatcacatccagaggagtgtttccaaagacactggctgcgcctgcaatagctccgaagaccccagtgatcagagggttcatgggcttgttggggttgtcccctggatataggaggggtgaggtgggtcagagggtgccgggaggggcctggatcagcacttcaaaaggtgggtgcccgccacccaggggtggccccaaggagaggagaggagctggccatgtgcagagatggggccctgtgatgcagacacacctcggtaccagttgcgcagggaggtcatgacgaagaagcggatggcctggttcgagccctgcttcaggacagtggctgtgaggccctggtacgtccccttcagccctgcgggaaggcaggcacggggttaccctgcagcctctcaggccccggttgggaattggtgtgtgtggggggtgggtgttgcacaaagcccaaggcaggatgggaggtgcaggcccttcccaccctggcccaggtccctgagccctatcaggaaggtcgagtggctcaccttgttcccgcacaatctccctaaccccgtggaagaatcctctgtacttggggtttggggaggtctggtcgtggatgaacttcacctgagagagagaagcaaaggcgcaggttctcggctgccacctgggtgggtcctggctagctggcaggcccagggcccatccagggtggagggaactgggaactcttccccaggaagcagtgcagccaaggccgccctgggctgcccacacggaccatgccccgggacacagggcagcccacacggaccatgctctgggacacagggcagccctgtgagcagcctctccctttatgtttgctgctcttttccagttttggcagtgaaggtgtcattttgttttctgctttataaaagtattttttaaagactttaaggctgcctttagcatagactcagcctccacgggtggcccttcgtggcaggcgtcctgccccagggccccgcggtcaccccgccggccttccctggcgtccaggagaccctccccagcttgccggttgccccgggagcaccgggccagcggggccgcccgtctccgtactccctgcgtgtccggggtcctcgccaggaccttccccaccttgatggtctccatggggcacacgaccaccacggcctcggccacgccagcgcccaggccgcacagcagcccacgcgtgctgtccagccgtccctgggcatcccgcatgtggttgctgaggaactcgaacattccaaacctggaggcgggaggcgggtgagaggggctgccgcggccgagcccccctcccgcagcagccaccggccgggcctcacctgacggccgccttggggatggaaccgtagagcagggagctaaggccgcggtacaggcccaggacgccatggctgcgaaccgtctgccgcacgcagtcccctgggggagggggcggtcaggaccccacggccctcggtgccgccgccctgggtacccgccccccgcggcgccgcggcctccccctcctcaccgatgccccggtaccgcggcgggtgcgagcgctcgtccagctgcagctgcgtcttcacgtactcggtggggaaggtgatgcagatctcgatgccacccgccaggccgcctgcagggaccgggaacccgctcctgagactcccgcccggccgctggcgctcgggcccctcccccgtcccggacttcggtcggcgcggccgccgcgccagtgccgcggggaacataggctggggccccacgcccccatgccctcaccccgttgtcccggcgaggcgcagggggtgacagacgggaggcgggcgagtcccagcgcgccgggtggggaccaggaccgcgcctccacgactccccagcccacggcccaacccggaagtggggcggggcctcagcgtcccgggcccacccagaagcgcggcgggagaggggtccgcgtcccggaggggcccacctgccaggatcgccttccccgggtgcgtcagcttggccttcccggacgcgggcgcggcggccgccagagcgcgcggggcgcggggcgcgggcatggcgggcgggaggcggggcgccctgtggcggcttcgggtccgagactccagaactccgcgctcggtccgcggtggcggcggcggccggttatggtcccaggggcggggcggccgcgtcagctccaggtcccgccccgcgtggtccgagccaggccccgcccccagcccgccccgtgcgggccgggaaactgaggcctgggcggggcgcgccgaggcaggcgtaggggcggggccaaagcgcagccaatggccgaggccgagtccctgggcgaccgcgagcggcgggacgggggcggggctgcgggaggcggagccgtggcccagctccgagcagtgggtcaaggtgcactgtgtgccgcgccgcgggatagcgggcctcgggtctgcgcgactgtcgagagcggcgggatccccagggatcccggaggccaggggcacaccctccccgaaaacacgtggggctagcccagtcccagaggaactctaacgtttcaaacctggaggcgggaggcgggaggccggtgagaaggggctacgccgccgggcccccctcccgcagcagccacgggccgggcctcacctgccggttcccacccacacctttcccggttgtagtttctgcgctcagcgaacaaggtcaggaaagaccacaaatgcaagcggctgtattctcctaggcagcttgtctgggcaacggaggtcccacaccccaaagaggacccagcaaatctttaatggactgcggggcctaggaaactggcccgtccctcctacccataccagcaccaagcagagcacctttgcctggataaaccgactttaatatttatgattgccaagaggctgagagtccttttatgaggtccggtacctccaaacaagacgtgttcatgtagtcttcaaactggcctggagggggcagctccagccagtcggaggcgcccaggaggaaggcctggctccagcaggagggcccacagtccagtctctgttgtcggctaaagctggtcttgcgccgtcagcctctaccctggcctccccaggctctgggatggctcagaggttgccgtcattgggtttcagcaaaaataaatattgtccaggtgtccctgcctcccattgcgtcccctgtgctgctggagtgacatgctccttggagaagttagtaactctgcaggtagggtgggtggtgacaacgcccactacacgcggaagttgtacattggaggctggcgaagttgggagcagaggcatatccataggggaagctggcaggggctgggcccacggcagggcctgcagagggggaagcccacaatgagcagagctcttcctgcccatgggggtcctctcctggctgcccctgagtagcccggggcccagggagcagggtctataggaccagcccttaccacccagacgctgaggccccaagagagcaggcatccagaggcaaggagcgtggggtcagccagagaacctggcctggctagaggataagctagtctccaaatgggacacttacttagtgcaatcagctgggtctcattcatgcccatcaaaatctaaaaaaaccagaatgacattaatggtggaaggacacactcagccggacgctggagacccgccggcgtgctgcacactcacaccacaccctcaggcctgtgtttgccccacagtgtccaagcaccccacagcctctccagtctgctcgacagccaggctgccctgggcaggttctcaggtgcaaagcccctcccagcacacaccagcagcagccttgctgtccaggggccaggcccagcaggacacagcagtagttcacagctaggcaggcacccctatcagaaggcaggcatccttacagcagggaggacagcggccgtgccaacattcctgggcgtacacttctccacacccagtagccactgggatccttccagcccccacccatctattcccatccccatccaaagcccagccaggtaagggcagtgggactttgactccctccctgctccctccccagggggttgggggctacaggtgccacctaccaaacacgagaggggcaggctctgtcacatgctcctcttgcttgcgcagactctccaaggcatccagtttgtccacctgcaaggaggcaaaagcacgtgagcacccgcttgacagagtgcagtccggcctctaggtgaaagtggagtggaaggtcaggacacagggcctccaggagaatgacagtggaggaggtgcacatgggcagatgtggagtggctcagcccacaccccatgcacttttagaatgcagcaaggcatggagaggtgaagcctcggtagctgggctgagatggaacgccaggtggggcccccagagcttcccagtgggcactggggcagtcagttgttacaggctgtgcatgtggcctgcttatggggggccaagtcctcctctggatacagggacactgccacttaccgacctgcagggctggggccatgtgcagggaacactgtctgcttctggctctggccagtctagtttgcccgcccctccaaaccagcagagagatcatgtggctctcagagacaagtcacctggcacctagacacttcacctgagaagcactgaggacaaactgcctcctcactcttccctgaggcttcaccaggcactgaccccacccactgccagagagcgaggcggcagcactgcactagaggggcggcagcaactgtgcagctaggatcccctcacaaacacactgagtaagaaagagaaataagaatgtgccccccatgagctggggtctggggggggctgagaaatgaggaggaagcagggggcacacttgctgacacctagggtgagggctgagctaggcctgtaccctccctacaatgggagagcgctgggggcgtctcagagggatggccctcaagcttcccagatgagccacgaggccccaggcccagctgtccaccaggaaaggactgtgcttcttgtccgcgccctcattctcccagcactgctgtgtggtgtcagctgagcaccagctcaagctgacaatcagctcacacccccatgccactgactgggaaaccccttgccagccccctcctctccttgaactctccccatgacaggcgtctcatctgccccagcaggaataggtgggtggcagcagagaaggtgctccagcagccaccacctcccagggccagtggagtctgggaaccctgggccaaggctgtgcagccacagtgtggaccaacgtgatagtggctgctaactccatcatccgcaacagaaagggaatgtgcgcctcaaagtcctgggggatccccacaagcactttgacccccacagcaatgacactccctagggcctggtgagcctgagttcctctgacactaacccacgggcctctactgccaggaagagattcaagcactttctttccttgtgctggttctcagaacacagactactttcaggaaagacacccgagggatgggaaaacctgctcatcatggtgacagcagcttccacaggcacgcaccagacaccgcacaccacacactgcataccacaaaccacataccacacgtgccgcctgtagggagttgccatccactgtggtgggggaaccagggcccttgtcaatccaaccagtccatgtcccctggcagcccacgaatctcaggccacgtagccagggctgtcccttcctccccaacccttgagagtcatcagggagtctcactcaggcatgctatgcagatgggatggggtcacactgtcctacaggagggcaacggccttgaatggactctgggatggcctttatcaggggctgggcagccccctggaggctctgcaggcggcaggcagccctccaggctaaagctggcagcatgagcccgccttcctgtttccttcctacctcccactcacctgggaggcccctcccttccctcgctccactgagtgatgcttcagcatgagtgccttccgaggctctccatctggcttgaaggaggttagataggcaagtagatgctactggaagtagcttttccagtgttagaaacaacaaactgtaccagatgacactgctgacacaggtctctggacagtggctaaagctagatcccagcagggactcctaggacttcaacacccagggagagttttacaatcaagtactgtcacttcgatgaggcagagagtcatcctccctatagctgttagaaggattcagtggatctgtgaatactcctactatgtgttcagcaaaaggcagctaccaccaaccgtatgctaacagctgcacccccagacgccactgggagctcctcagggagctgggattgccagccacctcactgtcaccttgttgaagtccagggctggggatgagcacgcctgttgtgctcctagcagtgtgcacattgggacagctgcccagccagagtctacaggagggctgctgccagtgggcactccccatgatgattttctggaggggcttaacgttgggcagaaaaccacttcagcatgaaggaaagcagccactcctgaaggcagccagggctggctggggaatctgggttggcctcaaaggggcccacccttaagacctgcggccagagtcactgccagggttgggtcatgccacacaggggccggggagctgcagccggcccggcacctaccttgctcaggtactccctcatcacctggatgaagtagggcatggccaagtccacgaggttgtgcctccaggccagctcaagcaccatgtctgggcgaagcaggtcatagcaggtgaagagacaagctgcgaagcactccctcttgccttcctccaggaaccactgcagcaacttctgggccagctcagcatcccgcgactctgcagcatgctgcatggcatcctgcagccaaggcaaatgcttgcttgggcatcctgcaggcagaggctttgtgcctgcagcagctgggccggagggcagggagtggcactagactccaccaaggacttcctgcgctgtggagcaagcctggacccatggctgggccattccctatgccctgctgcccactggtgaaacggagatgccacctccggaggctctggaggggacaggtggctcacggaggcgcaggtgccctgggagacaggaactctagccccgagggcagagggcgtgcacaggctgctctgaggaaggcactgatgggagtttgggggttgtggggctgctgcagaggtgctgcactcaggtccatggagcgtgtgacaccaggggagcagttaggaggggtacggctactgctctagaaacagcaatgtgtttttctttcaagtggctcaaaaacccctaactgctattttcatccttgcaaatgtatttgtctaagacaatatcattgacaaaataacacctgcacctgaccagtcctgaagaagcctgcactttctgtggccattctctattttctagctccacagcaggcactggatcacctgattccttctatggcaggggctattagtaccccattcagagaccaggaacctgagacccagatgtagtcacttgcccagggccactccacctggagttggccatgatccactgactgtgacctgtgctctccagggataccctgtggcggtcccagctctgcatgcctgccatcgcctgcagcacacacctctgagttccgtttgggagacccctgaggacgcccagtgcccacatctgcatggacccgatgtgctgagctggctccggaaagaagtctcccccgctggcatgctgctcatcgatcgctgcctcctgacccacactgttcctacaaaggcaccaggattctgaccctcaggtgagagctccaggtgcctttgggtctccgctttgaggacctgtgacgcccgctcatctgtctccctgccgtgccctccaccggcccagcctacccttgctgacttgtcttccacatgtgcctaaagtgggccctgctctgttcctcctctgtgggccttggggactgtctcactgccttcccagaggacttccagtagaagcagcccccaggaagctcccagtcagtgtcccgctcctgcggcctggagcccagctcgagtcaggctctcccacaccctcctctctcatcacctccccggcccatgccactctcagggaggcttcatcctggtccccatccctgtgtccagctctccagtctacacctgtacttccgcagcccctgctcttcactggtgggtgtgggagggccccactgaccgaactttcatttaaatgctacttctgtcatctggaaatacagttttctgttgctagctggctttgccctgactggacacgctgtgacctggccactcctccaggaagactccaggaggcttcagctctggcctcagggcaggctcctccagtggcagtgctgaccttgggaggtctggggagccgcctgtgcactggggcttgtgggccccatccctgcctctacggcctatacacagcaccacgccctaagctgtgacaaccaaacattccctggggtcacagtcattcctggctgacagccactgttctgggggaagcgcgctcggccactttctttttttttttttttcttgagacggagtctcgctctgtcacccaggctggagtgcagtggcgtgatctctgctcactgcaagctctgcctcctgggttcacgccattctcctgcctcagcctcctgagtggctgggactacaggctcctgccaccacgcccagctacttttttgtatttttagtagagatggggtttcaccatgttagccaggatggtctcgatctcctgatcctgtgatccgcccgcctcggcctcccaaagtgctgggattacaggcatgagccaacgcgcccggccctgtgctcggccactttctatctgtggctttgtcctctggactctcttctgggcccacgtggctcggagtgggtggctggcaaggccagtaggcctctggcagcactgatggccctgctcactcatcactgcctgagtgttgaggaggctgtgtgtttaagcccctgacagggaccacatgggtaggacagaatggctgtgatcagccagccgagggcagccttccctcaggtgcgtctgagcccagctgtctcctcccagcagccaggtccagagacctccaggtgcggtctcagagcctcagcagcttttcctctccattccctctgcaggggccctgtgggcacctcaggaaggatcacaagcactgtcaccaagggctaggatatgtcacagaacagtccagaacactggaggtgacaacttagggtgaaactcaatgcaacactgatgcaggcatcagaggcctccacggagtctgagccaacagccgcagaccaggagccatgagaatgaggcccctgtgcgggacaggaagtggcaagtatccatgtgtcctgtgaagatactcaggaatgcctaaggccaactccgtaagtaacaccctcaggtcaagtccagagtctttgggcacaaggagcccttgggaattggctcagctgcatcacacagcacccacaagggccctcttgtacaactccacctcacccccgcggggagatgttcaggccaagcagaggatgttaatgccttcagggtcttgggggtccctccaggcagcccaacctgtctagctgatgcccagatcccggtctgagaatgatactaagaaacctctcaccagcagaaaaaacacagtttctttttcctctcaagtgatcctcccacttcagcctctaaagtagctgggactacaggtgcacacaaccgtacccagctttgaaacaaatgttttgaatgtgatttatttatttttttcctttttttttttccgagacagagtctcactctgtcacccgggatggaatggagtggcgtgatctccgctcactgcaacctccgcctcctgggttcaagcgattctcctgcctcagcctcccaagtagctgggattgcaggagtgcaccactacacccggctaacttttgtattttcagtagagatagggtttcaccatattggccaggctggtcttgaactcctgacctcaaatgatctgcccacctcagcctcccaaagtgctgggattacaggtgtgagccaccacgtccagcctttgaatgtgattttaatttaggtttttaaattcctcaaatctttttttttttttggagacagggtctcactctgttgcctagagcagtggtgtgatcatagctcactgcagcctctgactcctgagctcaagtgatcctcccttctcagcctcccgagtggctggtaccacagatgtccatcactacacttggctaattttttgtaaagatggggtcttgccatgtcgcctaggctggtctcaaactcctgggctcaagcactccacccacctcaacctcccaaagtgctgagattacagggaagttcccaaatcttgataggaagtaaagtaggtgccaagaagtgaatcttgccacactgtgttttggtagagtgaaactcacacaaaactgctgcgaaaagaatcaactccgtaaaactctacaagtctttcaatccaaacagtttttaaggggtgctagctcactcccaattcttactctatgttctaaatatggtctcccattaatactaatccccccacccaccacgaggatcccctggtgaagctcagagccaggtctcaggaacaagagggaagggatgtgacccccaaagccatcaggaaacacaccaaggcaggaaggtgggaggaaacgggcccaggccaccaaccttgtagagatgatccttcttgcagagctccacgctctgggcccaccagttattgcccttgtacagataggccgcaatgcacctgaactccatcagctgatgcttctccagctgctgagccaggctgatgttgtcaaagttgtcataggcatcgatagatgcccttaagccctaggaagacagcctttctgtgagggatgggacactgacatgggctgcctacacatggagcaggcaccttgtgttacttgatggctgttgctatcagcacagccttagaaaggcccctgcccatatatccactggtgtcctgtggggcctgcacaccctcctgtgcaaaggcagcctgctttgagaacagaatggcagttgcaggggaggagcccagcccacccaggacagggctccttcctgcacacccacctgatagtcctcctcctctgtcagcaggtggttgagtgcctcattcacactcttgttgttgtggctctggactgaccgcaggtaaggcttcaccaggggcagctgacctgcctgacaagttgagggaaccgtcaaggcacttggccaagcttgttatggggacactaggcaggggcacaggtgggcacgtgcgtgccatccacttgaatggtccagctctggagccaagggcaccttctggacacctagaaccaaaagacctacactcacacaaagaggactgtctgggcgattcagtggatgccaatgtcaccacagacattcacaccttagagagacacatgggtttgggtccagaccaccacaataaagtgaacattgcaataaagtgagtcatattaattcatgtttacactatgttgtagcctaagtgtgtaacagcattatgtctacaaaaacacagtacacaccttaattaaaaatattttagtgctaaagaatgctaacaatcatctgagccttcagtgactcgtaatctttttgctggggagggtcttgcctcaatgttgatggctgctgattcatacaagtggtggctgttgaaggctggagaggctgtggcaatttctttttcttttttttttttttttgagatggagtcttgctcgtcgcccacactggagtgcagtgccgtgatctcggctcactgcatcctctgcctcccaggttcaagcaatcaattctcctgcctcagcctcctgaatagctgggaccaggcgcttgccaccacgcctggctaatttttgtatttttagtagagacagggtttcaccatattggtcaggctaagtctcgaactcctgaactcaggtgatctgcccacctctgcctgccaaagtgctaggattacaggcatgagccactgcgcccagccggcaatttctttccttcttttttttggggcgggagacggagtgcagtggcgcgatcttggctcactgcaatctctgcctcctgggttcaagcgattctcctgcctcagcctcctgagtatctgggattacaggtgcgcgcccaccacacctggctaatttttgtatttttagtagagacagagtttcaccacgttggtcaggctggtctcgacctcctgacctcatgatccacacgccttggcctcccaaagtgctgggattacaggcgtgagccaccgcgctcggctggcaatttcttaaaataagacatcaatgaggtttgcctcactgactgactcttccctttatgtaagaccactctggacttgtgttgcataaaacaaaataaactaaacaaacaaaaagactctgtgcagcatgcaatgctctttgatagcactgtactcacagtagaacatttttcaaaattggtctcagtcctctccaaccttgctgccactttatcaaccaggtttatgcactattctaaatcccctgtagtcatttcaacaatgttcacagcatctgccccagcagtagattctatcttaagaaaccactttctttgctcatccctaagaagcagctcctcatctgttcaagttggatcctaagattgcagcaattcagccccttcttcaggctccacttctaattctagttctcctgctgtttcccccacatctgcagtgactttctccactgaagtcctgaacccccaaagttatccatgagggttggaatccacttcttccaaattcctgttaatatatggatattttccttatatactggtgtctttacttgtttccaacttcttattgatacatgatagttgtgcatattaattgggcatatgtaatattttgatacatatacacatgtgggatgatcaaatcagggtaattacgatatccgtcacctcaagcatttatcatttctttgtgttgggaacatttcaaatcttctcctttagctattttgaaatgcacaataatttattgttttttttgagatggagtctctctgttgcccaggctggagtgctgtggtgcaatctcggctcactgcaacctcccgggttcaagcgattctcctgcctcagcctcccaagtagctgggactacaggtgcctgtcaccacgtctggctaatttttgtatttttagtagagacggggtttcaccatgttggccaggctagtctcgaactcctgacctcgggtgatccgcctgccttggtcatccacccaccttggcctcccaaagtgttgggattacaggcataagccaccattcccggccattaattagcctaattccaatgctgttgtgtctcagggaatagggaggcccaaggaaaggaagagggaccagggcacggccagtcagcggagcagtcagaacacatacaacatttatccattaagtttcccttcttataggggcatggtttgtggcatcccaaaacaattacaatagtaacatcaaagattgctggttgtgtgcactggctcaagcctataatcccagcactggaggaggccaaggcgggaagattgcttgaggccaggagttcaaggttgcagtgaggtatgaccatgccactgcactcccacctgggcaacagagcaagactgtctcaaaaaaaaaaaaaaaaaaaaaaagatcactgntcacagatcaccataccatntnnngnncnaaaatttgaaatattgtgagaaatcctaaaatgtgccacagggacatgaggtgggcacatgctgttggaaaaatggtgctaatcgactttctcantgcngggttncaaacctccnatctttttttttttttttcttttgagncagngtctcacactgtcacccaggctggagtgcagtggcacgatcttggctcactgctagctgtgcctcccgggttcacgccattctcctgcctcagcctcccaagcagctgggactacaggtgcccaccaccacgcccagctaatttttgtatttttagtagagacggggtttcaccgtggtagccagggtggtctcgatctcctgacctcgtgatccgcccgcctcggcctcccaaagtgctgggattacaggcgtgagccaccgcacccggccacaaacggctaatctttaaaaaaacacagaatttgagaagcacaataaaatgaagcatgatacgggaggtattcctgtatctgaaacctaaaacactttgatacactggtgaatcttcaagtcagctgggggtcatttcaaaaactctttataaaggtgctatcattcagatgactttgttagagctagcccaatacactcttctacctggggttttggttgactcacctttgaaaagaaactgactgtccaggtgtggtccagccggggtgaaagcaccagcagcaggtcattgatgagcagtggtttgtaatccaaatagaactgcagggctctgtaacagagctcgacgttggcaacctgtggtgagcaaagctgagggtcagtccctgccgctgtctccagataccccagggctccttccagtttttgctcaaatgacactttactactgaggcctgccatgactaccccctataagactcaatggcctgtgaaggtgcctcctctcatccctgaggtattttgtcccccagcactgacacactgagcatttttcttaagaggccagcctcagggtttcctgcctcaacccagcacctagaccagtatctgatgcagggtccacgatcactcagtatcggctgaatgaatgaagtgtaatcagtcagaatgaagccccacagcaaaaccaaacaacagagtatgtttccatccaagcaagattactccagctttccttggaggcctcagcctgagccataaccaagtggacagcatgtcctgtgacatcaccagagcttttgagctgaaacactgtggtgctcagaccctgggtgagacctgaaggccagcccatgcagagagtggaccactctgggtggaccctgtgcctgtgctcctgggtctcgagatttggccaggctgctgtntctcttagcactttccccactggtctgccaccattctcttgctgggcgatgtcatcttttttttttttttttttttgagacggagtctcactctgtcgcccaggctggagtgcagtggtgcgatctctgctcactgcaagctctgcctcctgggttcatgccattctcctgcctcagcctcctgagtagctgggactacaggcagctgccaccatgcccggctaattttttgtatttttagtagagccggggtttcaccgtgttagccaggatggtctcgatctcctgacctcgtgatctccccacctcagcctcccaaagtgctgggattacaggcgtgagccaccgcgcccagccctggcgatgtcatttggtggcttgctgactgtggcatcgatgtccagggcctggacacagctctgttcagggagcatgcaagccagatgggcatgaaccaagacagtggtgatgaatgtgtctgcgtgagtgtgggggtcccgggatgtgcacagggcacagctggagctaaagtcatgctgggatcccagggtgatcaccactggagcctccagcactgctgggtttgggtgacctggcaaaaatgtggggcccgatggggtcttctgactaaaaggggtctaatggtcccactatggcttactggccacttcagggtgtcttctttctccttctcttttccttttgtgctagagcactcactgtcaccagagattctgacccagacaggcagcagggtccctagtacccgccaccatggattcagagcaaaacggtgaactggccgcatcacaaagcttcacctatggcactggtgggcccccagactctgccacaggccactgtgggtccactcctattggagctctagcacctgtcagccttctaggctggccctttactcagcagcagggccaggacatgggggcctcaactagacactgaagaagcagagagcagtcaggatgtgatgtggggctgaagagaagggtagggactcaagttcatcttctgtggcgaatcacctcctcaaagccccacctgcttccccaccaaccacaaggctcctcaggcctcccgtgaaggagaggaaccatccaaggacaagcccatttcagagactcttgcaggtatcacgcgagtggacagacttgaagtggggcaccagcagtcctagcttcccttgtgggacacctggtaccatgtgcactcttggccctttcaacaggtccatgcagcatggccggaatgccgtttaaggtggagtataactgccatgttcccacccagttcctctggtgttgaggcctgcagggacacacatctctgttgggctcagctgctgggatctggagccctctgcactacaggaggaatggagcggcggggcccctctggagcgtcctccagatccaagctgaaagacaggatggggtgagtccactagccacgcgccaggacatggagcactggcaggcccgtgcccactagcatggtcagcaaggacagccagcaccccagaagacatggtagtatccctgttttatacaagggaaaactgaaggctgggcgtggtggctcacgcctgtaatcccagcactttgggaggccaaggcaggcggattgtgtctgtaatttattccttccggtgggttcttggtctcactgacttcaagaatgaagccacagaccctcatggtgagtgttacagctcttaaagatgttgtgtccagagtttgttccttcagatgttgagaggtgtgagtttcttccttctggtgggttcgtgatctggctgacttcacaaatgaagctccagaccttcgcagtgagtgttacagcttttaaacctagtgcagactcaatgagtgagcagcagcaagactgattgtgaaaagcaaaagaacaaagctcccacaacatggaaaaagacccgaacaggttgcactgctggctcgcatggccagcttttattcccttatttggccccacccacatcctgctgattggcccattttacagagcgctaattggtccattctacagagtgctgattggcccattttacagagtgctgattggtacgttttttacagagtgctgattggtgcatttacaatcctttagctagatgcagagtgctgattggtgtacttacaatcctttagctggacacaaaatttctccaagtccccacccgacccaagaagtccaggtggcgtcacctctcaagatcacctgaggtcaggagtttgagaacagcctgcccaacatggtaaaaccctgtatctattaaaaatacaaaaatgagccgggcgtggtggcaggcacctgtaatcccagctactctggaggctgaggcaggagaatcgctcgaggctgggaggcggaggttgcagtgagccaagatcgcgccactgcactccagcctgagtgacagagtgagactccgtttcaagaaaaataataataaaacaaaaaaagaagagaaaactgaagctgagattccgccacaagctccaggatagctggttggcgtgctgtgctgcacaacctgaaagaagcgcccaccggatgccaggcacctgccatggaccacttggtcgggaggaaacatgatgtccattgtatggatgggataacgaggttcacagcggtgacacccctagcccacatggagagagacagtgaatggctgagctggggtgccccccgtgtgagttagcaagctcccctgctcaggctgctgctggcccagccctatggctaagtggattcctgctatcgtgtgccccaaatacagattggatgtcgtccatctgattggacccctgcactggcgagtatcctcctacccccttcacacctgagctgacagtgtctgtctcccacacggcagggtgtagtagaagcatcatgaatcacacaaggaactggactcagccatcagccctgcaggcaccagatgagagatgctgctctcccacacagtgagtctcagctgtcctgctattattttatatgccagtaagaaacaaaagcatggccacttccaccacggctcagcaatttttaaaaacaccctaatatcagaggagttacaatgtgaataaaatacacacaggattgatcaagtatggattttccagcacacagacaaatctacaaggcagcagccacgtgtgccaggccacagtaaggtatgacctggccgcactccctccagcaacctgcagactctgctcagggtgggacgccccatcaaaggcccccactttcacgtaccaccatgcccagtaacatggatgtcctccaacaagaagctcgggcttgtggcctggtgctcaatactgggttccttcaaatagttcccaggaaaggcagaggctgaaggctcacctggcagcacacgtgccactcgcgcccaccctcagtagccgcatgtggaaaagaggtgcatgagcgaggccacagctcactgctgtgccactccagtcacaagccgactgtgacaagttagttacccaaagaccatggcacaaagcgcagatacccaatgcaaagggatgggggctgaggataaagaattccagccccttcaccaaactcacatacagagctggagaggggtgggtcctgaggttgaactctctaagagaccggaaacaaaataacaaaggctcacttgaccatggcacccaaacccgacaccacccaacagtgtggctgctgacagagaaactcgggtcccggtttagcccagttaggctacaggatggaggcccactcccagacaggtaaggccgctggtgctggggagagacatgaactaaaaaaaaaaaaggtccgatggtgaacaataaccacaggaagtgggggtgggagccctgagctgacagggcagaaggaagaacgaactgaggcctggccacaagggcgtggtatggtgggaggggcgggcaggcagggccacagggccacggctgcatgctggcctgaccctgcccgcagctcagctgtgcatcgctagacgggtcacctgcccttcttaagtgtcagttcccttcaaagatggaattactaccatctgcccagagggtggtggactcatacaagtgaacgcacacacagcatgggggcatgctggtactcattccactcccacctgcccattcccctgcacccagaatagggcctggcagaggctggcaggagccagcgctctgtatcccctcttaccttggtaatgatgtccttgaactgaccctccttccaggcctcagtggggtggctcatcatggtgagcacagcattgtcatactcctcgtacttgtcatagaggaacaccagctcagcccacaggtgtgcctgctctgcagccctcagcacctggacaaggaggtcagggtcggcttgtgctgcacgtggccacggctgccagactgcaaggagtacacggtacctttgggatgttgacacgggaccagaaaagctccagatgctccagcatcttctgtggcttgaatttggagtagaggatggccagctcagtgaacatgcccatgtgggcccgctccaggcccagggccgcttccaacagcaagatcagctcctcaaagtagccacgatcctagcagaccaacagccacgcgtggggcagagtgattgcatgcctcctgcagccaccctccagcccatgcccacgccgcagggactgtgcttgtgactgggaatgatcccgaggaggcatgtgtgaagaaaacgtgtatacatactgtgctacagatcatgccatttacttagcaacttattggatcatctgacaattaccagtggcacactgcactacaattttcaagtttagtaagtgcaaattagtattgccaattttatttaaagaattagaaaaaaaaataggaagtgggtggtaacagggtctgggaatgatttgttttaatcccttgctacagctcattactgagatcctggctccaacaaaccttcaactccactcacgatgccacgtggctgttgtttcactgtgtccctaattatgatggccagccccttgcattcagccccacacgcctctgacactctccctggacaagaccagacgtctggttacagcctgctcagcatgcagaaagcctggagaaacacccagccatgtgaccctttccctttactctaacgaccacagccctgggagggtccgacctagaggactgcctcacacctcttgttttcccaaggaggacacccttctgtgccccctccactctcagactaacctcatttcccagtggcacacttgtctgctggcagcatctgcaccccccaatcagctacagacacgccgcctgtgctcctgtctggaacctgcccagcctgcagctccatcccacctgcttgcctaccaaggccacagctccggtgactcctcatttctcttctgccttattttcactctccacagctgggttcagcaagcatcccgctcatcctcctatcctaaacaccctcttgacccgatgtccctgctagctacctcccattttttctacttccttttgcagcaaaaactcctcacaacaaccattcccattcctctccctgttctctccagccaccatcaggctgagtctctcccaagctccaggtcacaagcagccccctggccctgccatcctgctgtctgctcagcagcaggccctgtccctgctgaccggcccctcctctccagtgcatccaggagccagcacactctctgggttttcttcccactgtactggctgctcctgctcccctcctcagcccacccctgttgggcagtctggtcttttcacctacactcatccccaggggactgcaggcaaacatagatggatgtggatcacctatatgtcagcaactccaggttcactgctctagctaggcccctcctctgtggagctccagatctgtctccagctgcctacatgatgcccccacctgaacatccagcgggcagctcaagacttagcaccatgtgtccaaaaagtaattcttgtccttccctcccgtgctgcaccttcagtcttcccctcatccactggtgataactccgttatttctacttattcaagccaaaaccaaatggagttatcctgggcttttctctctcactccacatcagtgcattagcatatcaaggtggctgctcattcaaagcacacacccaatcctgatggcctgatcacctctcaccctgtcaccaccaccctagtcagagtcactgtcccttctcgcctagaccactgcaacagcctccagctgctcttctggctcctgtccctactcctcaagtatgtgtctcagcacatgagccaccatgatccttttacccccgacagccctgcacccatcccaagtacagcccgtgaccttcctaacggcctgagatctggccctccgtcagcctctctgccccatctctggctccagccccttccttgaatacacagcacacttctgcctcaggactttgcctggccactgacccttccctcaaatgttcccatgaccaaatccttccatttcttcaggtctttgctcaaatgtcaccccctcaattgctgctaccttgaccgcccctttatgaaactccatccaggcactcctatgccctcaaaccggctccattttcctctataactgatcaccttcaaacacactatataattattcattaggtttgttgcttgcctgccaaccttgctgaatgccagttcaattaaatagaggcttttctgttttgttcactgacacaattattgagaataatgcctagcacacagtaagtactcaaagatttgctgactaaattgttcttttgtcagccctgtactgcttgatcaccctccctgttggctttccagttcatttctcaggcgcctctctgggggtgggaaagcatttctcattgaaaagccatcacacccagctaatatctggacactctggcgctggtgcgagcccctccagacaacgtctcacatagtgaggggtttggggctcaatttccatggccatggtgacactgctgagcagagtcagatcccatcttcgtctgccttgactaaccatacctggagttgtcatgtggctctaggaatcccacaggtggaagcccaggtccctaaacacacaaatcactgtctaccaaccactcaagagagcctacctacagcatgaacatacagggccccacccttccaaagggtccaggtggggttccctctcttgcctgtgctttgtccctaaggcacttgaaaaacagactactggggctgcacactgtggggaactaggctatggactagagctctgccaccaccagcccagtattctcagcaaccctccaagggttgttcccgtcatgcaagccactgactgggcttctgaaggcccaataacacaagaggatggagagaacttaaaaaacacaaaattccagccagccatgaggtcgaggatagctaacaaggcaattgaatttagttcataaatgactgtctaacacatgaatcttcccctcagggccatgcttcatatttgcagatgcaacactgtgatggtcacgagctaaggggatgaccgtgcctctctgtggagtgtttaggcatcacttgtcatctgcattaccagcagagatcatctggtcacctggtaatagcacatcagctcctccagctcatctgcatgaatgacgatgtgaagaccacacagctgtgcgaagcggaactcttgtccatccatgcaggcaaagcacacctaggggacggagggcaagcgtgagggtccccaagacaggacacagcaccacagcagctgacttacaaggcacacagttgcaaatgcagaaataccagcagtggggtattttaagttggattctgaacaagtagctaactctatgatgaattgtacaagactgggagaaaaaatatgacatttgtaatctgcaggccaagggggtgcttgagaccatggaaagaataaagtttgtgcattacttcgtaggccctgagttttgttcaggtggcgggaaagtcatgctggaatttcaggtttggggtttgaaaaggaaggctaaaaaataatgaccatcagaatgcatctcatctgagtgttgttttcacgggggagcttgttttaatagttttttagactacttttgttttctgcactgtacagtatgtatacttaatgataacaagccttgagaagtgcagaattcccctgtacaaaaataatcacataagccagtgtcattaacttgagatataatctttggcccactgtttcctatgtgtgatgcatacaccagcaccctgacaaatttcccacataaacacagtggaattacatcatacattctgcatgatgatatattcctcgcataatattggcaacatcttttcctgcaactctgcctattcatcttaaacagcagggtagagttgtaatgcatacattaacaaaggccttggccgggcgcagtggctcatgcctgtaatcccagcactttgggaggctgaggtgggtggatcatgaggtcaggagatagagaccatcctggctaacatggtgaaaccccgactctactaaaaaatacaaaaaaattagccgggcgtggtggcgggcgcctgtagtcccagctactgggggagctgaggcaggagaatggtgtgaacccgggaggcagagcttgcagtgagccgagatcgtgtcactgtactccagcctgggcgacagagctagactccatctcaaaaacaaaaacaaaacaaacaaacaaacaaaaggccttgacattagacctttaggctaattttaatctttcattaaacaatgctgttttggatatttcttcagttttttctacttgaagatggattctgatattatcagagagcctccagacaatttaccaatttgccacaaaggaccaataatgtaaatttacactgattatgcaaataaggtgacatgatttaaaagtgttatgaaaatacttataatactggtaattccatgctattaaggctacctctgggggccaactggttccacatcagattctctggggcctctgttccaactacaaacactagcctagagactctaagaatcccaagggttcagacccctgcctgggcaagagaccggcacccagaagagtaccgagcagaacgcaaaggacacggagagcgtgcctgtccagcacactctgccgtctgcagttgcccgcagctcacctccttccacgtccgggtgctgctggccttgcggctgttgtccactgctgcctgatactcaccgaggtgaaccaaggtggaagccaggcgggcaaagttagaaacattgctatagagcagcttggcagcctcgtacattccctcctcgtaacagcggtctccaactacggataatagggtagctcgactgagacactcttcaatgggaagatttctccagagttgcttttaagttcctagatggcagaggtatttttctgtttgctagggtggtaagcatctttctgatcgcaccagtgaccagatgaagttggccttggctttctagtccctggacaccctcctccacctcagggggcgcttctacctgcccgctcctatctaaccctgcgttctggcacctctcaggccctggctgtcacctaccacatctgcaccccactgggcctgggctgaggaggtgtgctccttgctgcttccaagccgttccccttcctcctcaataaaaaccgttcacaaccaatcttgtgtcaggtatcactcaccagccctagttcctgatgccatttacaaatctttctcattctctggcaatttatttgacttcctatgagctggggaccttgttcttctcacaagaacaagtcactgccatagccacaccttacacctcagaagagagatgccagccctgggaaccttccacaagtacctactctgcctagcactgcccagctcgccatcctgagcgcctcaactccaccagtccagtgactggactgaattcctgcagccctgtccatgcccaacttgcacttgccccagctggtggccccagatcatgctggacagctcctggcattcactcttgactctcctgattgttctcagtcctgctcagagctagttctctgcccattccatacctgtggctgcagagctaaacacagacagcagaaccccaaagtgctgatgggtctctctaaattcatgaaggctaacatcaaatgcactggcaacactacccatcctacttccgccatccacagcacctcccgcaccaaccctccttccgccatccacggcacctcccgcaccacccctccttccgccatccacggcacctcccgcaccacccctcctttgccatccacggtacctcccgcaccacccctccttccgccatcacggcacctcccccaccacccctccttctgtcatccatggcacctcccctccttccatcatccatggcacctcccctccttccgtcatccatggcatctactgcactaccctacttccgtcatccatggcacctcttgtaccacccctacacgcctgtcatccatagcacctctactgccacccctccttccatcacccatggcatctctcatgttaactctttcatatctccttctcttctcaaagctctaacgattcctcaagctgagtatttggcttcccttttcctgagaaaacaaactatcaggagagcctttcacagcacagtgtccgtggaatgtccttcctatgccaccaaggcctgctccatggatgtccctgaccccctctccacatgctccatgtcagggtttcagcaaatccctgcatcagcatccatcaccttctgcactcatccactctgacaagcttaaagaaccactgttcttttctctagtttaaaacaaaacaaaactggccaggcacagtggctcacacctgtaatcctagcattttgagaggctgaggcaggtggatcacctgaggtcaggagtttgagaccagcctggccaatatggtgaaaccctgtctctactacaaatagaaaaattagctgagcgtggtggcgggcgcctgtaatcccagctactcaggaggctgaggcaggagaatggcttgaacctgggaggcagaggttgcagtgagctgagatcgcaccactgcactctagcttgggagacaagagtgaaactccatctcaaaaataaataaaataaaactaatccaacttgctctgccctcaacttacctgggggctgtcagcctgtttccatgcttcccatcagagcacagttctcagggagtatctgtgtgtctgtaacagttgtcccctgtcttcctattctctctgcaatccactccaatcaggcttctgccagcctctctgccagggtcactgctcctccagacagacgcagacatggttttctggacacccctgcctgcttttctcccaccccgctggccagtctccatctccccctctccctgctgtggggctttggggtgctctggcttctttggtccatccccccccagccccacacccccactgccatgctctcccacacaggtggcggctgtgggtgctgcctgtccctggaggctgcccatgcacatctctagtctgggcttctcctctaaaacctaactcctacttccagctggacagatccacatggcatctactagaggtccgacttgtccgaatattagtcctgatgcccccaggcagtcctcacacactgtccccacactggtaagcatgactgcccacacccccaagcttgacccgccctcactgcttctctcctcacaccccacttggcagcacgccctgccggctctgccttcaacacacatccagaagctgactatgctttgcacttgccttgcccactttatctgctgtcgctgccccttgcgacatcactgcaccatcctcctctatgcactccctgctccacccttgtccttcactctgtttgtagcatagcagccagaggggttccgctgacccctagaccagatcattttcctcctctgctcaaaatgtccagtctcgcccagagcagaagccagagaagccagagtcctgatgacgacccctgaagtcctgacccgcagaggccaacagctgcctcttcctactgctccccaagcctctctcgctggatggctgtgctccagccaggggctcctgcaccccacaatgctcctcacaggatccttgcacttgccccgctgtcttgttctaagggctccttcccagaggtgtacagactcagcacttacccaggggccctttctaaaaccagaatgtccactgtcacacccacaccgttccaacgcttcttatccctgccccgcttcacttagctccttatattcaccatttaatagatcacagtatttttaagaatcttatgattcacggggcagaaatctgattaccattttccctgctacatccatagcccctactctggcacacagctagctgatgcttaataaaaggtgatgaatgcataaatgaagtattctatcaaaggggtaagcatgtaagacttgttactgccaatttacaggaaacgcagggaaaatgagttaaatgacattgtggagttgcagtcagcagatgccagactgtgggaaacatacacaaaccaggcgatgggctgggatctggcccccaggctgaaggttactggcccctatctcaggggagtgacagcagaaggcagagagcttgccaggcctggggccactatgaacataggtaaagagccaggtgtgcctctgccccacccagccggccctatgtgagggagcttctgctctggcccacagcgcctctgactcaggagaaccctgttactaacccagagggggattgggggcaaggctttgttttctattattttaactactttttggattataagggcaatttctaaagttacatgatcactgattaaaaaaaaaaaactttgcaaacacaggcaagtaaaagaaaagcaatatgatattgccaattccaaatcccagagttattcactgtcctcatcagtattatactccattgatggatgttgttatttaactatttcttggccgggcacagtggctcacccctgtaatcccagcactttgggaggctgaggcgggtggatggtttgagcacaggagttcgagaccagcctgggcaacatggtgaaaccccgtctctaccaaaaatacaaaaattagctgggagtggtggcgtgcacctgtggtcccagctactcgggaggctgaggtgggaggatggcttgagctcaggaggtcgaggatgcagtgagctgagatcgtgccactgcactgtagcctgggtgacagaggagaccctgtttcaaaacaaaacaaaagcactatttccttttgccagacattggcttttgatttttatttgcataatcatgctgcaatgattaaatatttataggtaaaactatgtggatcttttctactttcttgggatagatttttacatctagacttagaggtccatgtttagaaataataaaactctatagctatatttcaaatatttatgtattagctgaactgatattttcctttatgctttcttccactgcttacatgtttaaaaattcctttctcatgcaaaaattcaaatacatatttttaaaaaattttaaggaaaagctcaatttttacctttaattctttcatctggaattttacttggttacagaattacatgatgaacttttaacacctttcaaaactttaacttaatttccaaccattgttttttttttttttgacacaggcttctcactccgtcacccaggttggagtgcagtggcacaatcacagctcattacagtcttgacttcccagcctccagtgagtctcccacctcagcctcccaaatagctgggactacaggatgtgccacaatgcctggttaatttttgtatttttggtagagatggggtttctccattttgcctgggctggtcttgaactcctgacctcaagtgatccacctgccttggcctcccaaagtgctgagattacaggcccttcacccccttgttttctttttgtttgtttgttttttaaagacagggtctcgctctttgcctaggctggagtgcagtgccccgatcacagctcaccccgatcacagctcactgcagccttgacctcctgggctcaggtgatcttcccacttcagccttccaagtagctgtgattacaagtgcatgccacacactcggctaatatttttnagttttttgatagagatgggggtctcactatgttgtccaggctggtcttgaactcctgggctcaagtgatctttccacctctatctccagagttgggattagaggtgtgagccaccgtgcccagccccaacaactacttggaacttattttgaaataaaaagctcaaagttcattttggttattttttttctttttcctttttagagatgggggtctcattatgttgcccaggctggtcttgaactcctgtgcccaaacgattctcgcacttcggcctcccaaagtgctgggattacaggcatgagccactgtgcccggcccactttgttgttattcatttcaataaattgcatgcgttcctccaagaagtgcacttgtaactaatatagagttataatacattccattatctcttcatgtctctgcatcacattttccaagggtaacatcttatctacatggcggactccacaattatttagatcttttatttatggttaaggtttatttaaacattttggctttattcctattaaaaaaggaatgttttcttccccattatgttatctgatttttggtgacataaactactaatttttttttttttttttttttttgagacggagtctcgctctgtcacccaggctggagtgtagtggtgctatctcggctcactgcaacctccatctcccggattcaagcgattctcctgcctcagccttctgagtagctgagactacaggcgtgtgccaccaggcctggataattttgttatttttagtagagacggggttttgccatgttgaccaggttggtcgcaaattcctgacctcaggtgatccacccgcctcatcctcccaaagtgctgggattacaggcatgagccaccatgcccagcctattaattttcaatatatattttatgcatccagattattaactctgactcaattaattttgttttcttgtagtaaacagaacgcctggatgtaagtcttcacatctcttctaggagaattattctgatgtgtatagccaagagcatgtcaaaattccatgggtctcaatttccataccaataatagcaacaggttacttacttcctcgtgtggcttgcttctcatgatctttatctgcatcacactaaagcagcggtccccaacccccatgccacggaccgctgctggtctgtggcctgttaggaatcacgccccatagcagcaagtgagcagcaggcaagcgagtgaagcttcatctgtatttacagctgctcctcattgcttgcattactgcctgagctccgcctcctgttagatcagcagcagcattagattctcacagagcacaaaccctattgtgaacagcacacgcgaggatctgtgttgcatgcttcttatgaaaacctaatgcctgctgatctgtcactgtctccatcatccccagatgggaccatctagttgcaggaaaataaactcagggctcccactgagtctacattatggtgagttgtagaattatttcattatatattacaatatgataacagtagaaataaagtggacaataaatgtaatgcacttgaatcatccccaaaccacccccgacctgtctgtggaaaaactgtcttcgatgaaaccagtccctggtgccaaaacagctcgggactgctgctctgaggaacatccctggacctaaatctgactggcagtgcacagcccccagggggcatggcctacctgctggatgtgggcattgttgggtccattaataaaatcttctagctcagaaacacggctggttttagccaaggcaaaaataagttcagtctctatataggactcacggccctttttcctggccatctgcagaaatttaactagatcctcccagttgtctaaagacagaaaacaaagataggttaacccagagctgataattttaaacaagggctcaattcctcccattctgttctcagccagacacatttaccctccagttatgtctcactgggaactcagactccagataacgtctaggaggtcttgattatgctcactaagcagatccatagctcagaagggaggaggggaggggcagagccacactcaggccacctcccttagaaaagactttgccaggagacagaatgcttgttctggacatcagagaggtcggtgccacaatcaacttgaaacaccagaagatccctgggaattgtgggcctgtcactcactttaaaattactacagtggcgatattgagatatctagtgtgcttaaatgacctcatcttgtaaaggagggcaatagtcaactaaagagctggtgtcaataacagaataatgtttatctcagactcttgtgggaaactttcatgtagatgtgccctctgatatctctggatacatcatacgtagagatttgtgagaatctcttcaacttcttgcttcagccaggttttgcatcagtgagatgcagagccctagggagaggggactcacttactgctcctgctggctgactgaacaacttccaggtaagaggaagggtcgtcccctctgatataggagttgatggcttccttcaccaaatctttctggagctgggcttgggccagctgactccacacagcaggctcattgcatctctccgcaaactcatatgcccggtccaggtttccaatgtgctcgatcaggacctaggggttatgagaggacttccattctctgcaacatctagtcagctccaaaaaacagacacatttttgtttggtttcctgttctgcctaaagctgcatgaccatttcacttcagtcagaagcaatcaggtactaagcatttctcagatggacaggttgagggaagagacaagagctattatatgagaagggggatgccgaacaaagaagagacactccaataaagaggcacagagatggagatagccaggttaagctttctgggccgggggtaggacatgggacttgctcctgaccttgggaggaaagacagtgcaacagagcatagaaactgtaaaagagttcacaagaattgctgtggggaataagattgctcaccaggcagaaacaggcttgctgagcagtctggcagattgcgtgacagtgagggccacccactgtatagtagtggaggtggtggcagtatcagctgccccctaatatgatgagctggtctgtctcaaagcaaggccagagcccatgagggggcacaaaagaagggctcctggattgggggtttcacagcaggtatagaaataaggtaaaggaagaggcaaggacataaagataattggtaggacagcagttcaggtgagatgtcctgtggtttacaactgatttggaaataaaaccagaagaggctcatagactggaaagaaagggatgcagtttaaagaagaagagttcttgaggaggcagaggggcaggcagggagggctggagggcctgctctgggaacctgaccttggatcctgaaaagctcctgctgaggagatgggggaatggggagtatagggggtgagtagcatggtgcagagggctggaatggttgtcattgagggtaagatgtgagtgcctctgaaaatcaaacgtttctgtcacctgggctgaccgatgacattgggtcaggtacccaagtccaagggagtgctggggagtaatagggaaggggcagactaacagccaatggaaggagcacccacagagaaggtcaagacaaggggccagcgggctgggaagatgggttgctggtgaggaacagagaagagcacgaagagatgcactggacaaccagagggtctgacacccttggagaggacaagggcttgcagggcgcactcatgatgtggcagaaggtgctaggtccgacatgcttacactcagcagcccacctggattgctgaggcattcatatcaaacttgtggaaaacggtgaaggcctcctcatacagtgcgctgctgacagcgatgctcgcgatgtccagtgcgtcatagttgtccaggcggctgatgtactccatgacccgtgtgcggtctgccttgatggcagtcaggatcaacagattctgtagattcctgaggagagagggtggtcagcacggcatcccaggaacgaaggctgcacaaaccattttttggcaggtcaggcatccccagacccccagtttttttaaaaaagtaattaatatacacacacataactgctaagtaaatacaacagagtatttgtgaagtatttgggatctaaaaagaaacagtatagcaaagtcttgggaaagcacaggtaagagaatcagaatgtgccaatcaaaccactgggagggctgctgtggctttttagagcccagcctctggatcctgctgtagaggtacctattttcctacctgtgctttctttgtgattcattatagctttatcacatctactgtatttctaagcaatataggcagctttgcatttttttttaactttttaaaaattttgagacggggtcttgctatgttgcccagctggtctcaaactcctggcctcaagtgatcctcccaccttgcccccacaaagtgctgggattacaggtgtgagccaccacaccaggtcactttgcatttcttgaactttcctttgctttaattataatagatgcattcttgcaaaactttatacaattcaaaaatgtggaaaaaaaatcagtgtaacacaccacatatcaataatctaaaaaagaaatactacatctttatcaaatgatcagaaaaagcatctgacaaaatctaacacctattaatgagaaaaactctcaactagaaatagaaggaaacttcctcaatctgagaaagtacatctacaaaaagcccactgttaacatcataagtaacagagtctggacactttccccgaggatcaggaacaaggcagggatgtccactctccacacttctatttgtgctggaggttctggttaaggcatttaggcaacaaaagaaacaaaaagtttcttttctataatgaatcgcaaagaaagcacaggcagcactagattaggaagaaataaaactgtccccggtgtctcacgcctgtaatcccagcactttgggaggctgaggcgggtggatcacaaggtcaggatatcaagaccatcctggctaacacggtaaagcccgtctctactaaaaatataaaaaattagctgggcgtggtggcaggcgcctgtagtcccagctactggggaggctgaagcaggagaatggcacgaacccaggaggcagaggttgcagtgagctgagattgcgccactgcactccagcctgggcgacagagcaagattgcatctcaaaaaaaaaaaaaaaacaaaaacaaaactgtcccaatttgcagccaacatgattgattaaaaaaaactgaagaaatctacaaaaaaaaaaaaatccaataaatgagtttagcaaggttgtagaatacaaggtcaacatacaaaaatcaattgtatttctatatactgacaatgtttttcaatgaacaactgtaaacaaaaaatctatttaaaatacttccaaaaatatgaaataagtataaatctaataaaatctacatatgacctatatgccaaaaactataaactgctgatgaaagaaatcaaagatctaaataaatggagagacatatcactttcatagaatcaacatagtaaagatatcaattctccctaaattggtccatagatttcatgcagttccagttccagcagattttcttgtacatatagacaagctaattctgaaatttatatagataggcaaaggaactacaatagctaaaacaattttgaaaaagaataaagttgagcccaggtatagtggctgacacctgtaatcccagcactttgggaggccaaggtgggaggagtgcttgaacctcagggtttgagactagcctgggcaatatggcaagaccctgtctctaccaaaaaaaaaaaaaaaaacaactagccaggcatgatggtgcacacctgcagctactcagaaggctgagatgggaggactgcttcagcctaggaggttggggctgcagtgagccgtgttcatgccacagcactccagcctgggtgacagagggagaccctattgaaagaaagagaaagaaagaaagaaagagaaagaaagaaagaaaggaaggaaggaaggaaagaaagagaaagaaagaaagagaaagaaaaaagaaagaaagaaagaaaagaaagaaagaaagaacaaaggtggaagaattacactatctggccaattgatttttgacagagatgcaagagcaattccatggagaaagagtatttttaacaaataatgctggaataaactggacattcatatgcaaaaagctgaacctcaccctaaacttcacactttattggataatgaatctaaatataaaatgaaaaagaatgaaacttttagaaggaaataacagaaaatctctgtgacctgggagtattaacagagttcttgttttaacaccaaagcacagtccataaaagaaaagtttatgaattggactttatcaaaattataacttttgttctgttaatgacactattaagaaaataaaagaaaatctacagaatgagaaaatatatggaaatcacatatccaacaaaggacttgtatccagaatatacaaagaactctgaaaactcaacncctaanccaaacaacccaattaaaacacaggcaacagatttcaagagacacttcaccaaagaggatctacggatggtaactgagcacataaaaagttgttcatcatcattagccactagggcaatgcaaattgaaaccacaatggcacactgctatacatttatgagactggctaagataaaaaaataccaatataccaagtgctgctaaagatgaagagtgactggaactctcacatattgctggtgggaatgcaaaatgacacagccattctggaaaacaatagtgaggcggtttcttaaacagtacatataccatgtgattgggtatgtttaaacaaaaatctggacacaaatgttcacagcagatgtattcataataacctcaaactgaaaaccacccaaacgtactttgatgggtgaagagatcctgtggtacattcgtacaacagaatatcattcagtgacaaaaaagaatgtaaggctgatgcgatgcactcaccaagttggatgaatctcaaaggcatcatcacgctgggtgaaagaagcctgtcacagaggagtctataccacgtgactccatttgcatgacattcttgaaaatgcaaaactagtgtggcggggtggtagccagggttgggggttgaggtttgggggaatgtataatatacacggtagctagcacaagggaatgttaaagggtgatggaattgtttgtatcccgactgtggtgattctacagatctacacttgtgttaaaattcctagcactgcattccccatccccttccagaaggtcatttttactgtatggtggttttataaaaaagaattttaaagttgggtgctaagggtcatccatgtacagtgttcatttctactgctatctggtattccactgtatgactgtactacagcctacttattgatggttatctggatcgctcttagagctttgtcttgagtatccctgcacatctcctcatacaaataagctgagttcctttagggctcataaggaagagaggaaattgctggctgtgtgcatcttttttcaccaaactgtttccaaatgtaacgcacattcccagcaggggcacgtcagaggtccagctgttcaacatcctcatcagcactgattaggagagtggggttcctgctgctctggcaggagtaacaaagcatcggatgatgcactgtggcctcactctgtgcctccttggtggctgatgaggctgaattcacaagctgcccttcctctcaccggagggtgtgctcaagctctctgcttggtttctcattgggttgcttgtgtttgtcttttattacaacttttccctactaattttttgttggttgtgttgcaaatatcttccccgcatttgtagcttctcatttgtccatcttctttacgataaagtgcttaagtttaatacagtcttattggtttttcactaaaggtttatttatggtttctggtttctgtgactggcttaagaatttattaggtcataagtatattcttccaagtatatactctaaaaataatatattttgcttttttttttttttttgagatggagtctcgctctgtcacccaggctagagtatagtggtgccatctcggctcactgcaacctccacctcccagactcaagcgattctcccgcctcagcctcccgagtagctgggattacaggcacctgccatcatgcctggctgaatttttatttttagtagagacagggtttcacccatgctggctaggctggtctcaaactcctggcctcccaaagtgctgggattacaggcgtgagccactacgcccagccaaggctatttttacctacgcataaaactgtctggtgaaatcatcaatgaaagaagagcacgaacttgaggttacctgcatgtttgagaagcaagtgtttaagaagacagcagagctacagccacctgtaagtgcctggaagtacacacaaactaacaactatcaaaggaggttgatcagacagcaagacagaatatcgtagccacctcaggcaccttaatcctggcatcctgtcattagtcagggtttatgattccattaaatataatttcacattccatatgccattaccatatagcatctccaagtttaaaaacacacacacaaattcctctctataatactacagcccttgatagcctttctggcctacaaaataaatctcataactaaatctttacagctgcacttatgatgtgagttgattaaaatctgacacagaatctctgatggtgaattttgaagtggagaggaaccccaggtggctggcccatgcggaagcacgcactcttacctctatggtgcctgcccatgcaaaagaagcacgcgctcccacctctatagtgctggtccatgccgaaacacacactcccacctctatactgccggtccgtgtggaagcgtgcactctcacctctatagtgccggtccatcggaagcacgcactcgcacctctatagtgccgggcctgtgctgctgcccctgccacagctcctgctcatctggcttctacattatacttcgggcaagtcttccctgatacatgcccagatctggttctcctgccacctttctccaagctttgttcaccatgatttgaagagttcaacacatccttaggccacatgagaccttcataaaatgccagctccctttctctgagcattgtgttaaaggacagtgtgggccagagcagtaagaggagcgcaggctcctagaaaatgtgaaactgaggctgggctctgagacaggcaggagctaataagggaagggctagattgaggtagaggaggtggtaagaagattggcatgtctggggagcagccaatgggcaggctggatgggtgaagcggtacgagattgtaacagaagatgagtatcaagcagatgttttgaatctgcctgtgtccacagctacccctggcatagcctcacctgtgctcgctgaagacagagttatccagaactatcttctccagcagttcaatcagttcattaggcaggtcggctgtcataaaggctttgacagtgaccgaaatctcttcaggatcccgtgtttctgacaatgctgtctgtaccacctggttttaaaaagcatttgaaagaacttgattaaagtcaattcaagactgtatctttgaagctaaacagaagggaaggactcctccaagatggtctggaatagacacagagaaaatgggagacttcttaatgtaacaaaggaagggttttcaaagttaatttcaggaaattctgtttgctctgttttgacaattagtttttctctcatatcaaatatgctacagactcttactcagctccaatgaccagtgcaccaggcattttgaaatgaatgtctccttttagatttgtctcttaaagccactaatagcaaatatggctccacttctctaatgaagacaccgcagggcttccagcagcctcttactagaagagagcactgccactgctgtggcacagtccacagccagagctgtggagccacgtgccttcacaccggatgacactcagaaccacaatctgaaggaaagaccaacaaaagactggctgtgccacccctcctccaattataggtgtctcacatacaaaaacacttacaaatagggtggaaagacagttttccaaagagtacatttcccatgcaacagcagtttggaacgccagcactgttctctttgcactttggaccaggcaccttcagtgacttccagaatctaatatttttgccaagtttctggttctcctcaggggtgggcaacagccgtgtatcaatgagagggaagagacagctctggacggtctttcatggctaacacagccctctgaccatgaactttcacctagcaatcttgaggggccttaaaggaacctagggtcaaggtcagtccagtccacctttctgctagtctttgtgaactcaatggtaccataagatgcaaaagttctacctctgtggaatttgtagtaactacaacaaggaggctgaagagtttgagaacaggagctctcccagcagctaaggaaccaaaagggtatgcctgagggaaaggggcaccaggacacagcacaagtccatccaaaggagaaggtacacttccaacagtgacatctaactgtcaattcttgaaaaccttggaggccggccgcggtggctcatgcctgtaatcccagcactttgggaggccaagacgggcagatcatgaggtcaggagatcgagaccatcctggctaacacggtgaaaccccagctctactaaaaatacaaaaaagtagccgggcgtggtggcgggcgcctgtagtcccagctactcgggaggctgaggcagaagaatggcgggaacccggaaggcggagcttgcagtgagccgagatcgcgccactgtactccagcctgagtgacaaagtaagactctgtctcaaaaaaaaaaaaaaaaaaaaaaaagagttcgagaccagcctggctaacatagtgaaaccccatctctactaaaaatacaaaaattagccaggcgtggcggcaggtgcctgtaatcccagctactcaggaggctgaggcaggagaatcacttgaacctgggaagtggaggttgcagtgagccgagatcacgccattgcactccagcctggtgaagagcaaaactctgtctcaaaaagagaaaaaaaaaaaaaaagaaagaaagaaaaccttggngcancttaaataaatacacacaggttgttttaagggcaaaaataaatttctnccatctgtttgagtcaatacaggatgccccacctaaggttgcctcaggacactgctctcagtaaacttttcataatgaggttccactccagacactaaaagcagcctccctctgttattatgcgctctggattacaggagcattgcagttgaatttcgcaccaggaggtggctacagatatccaattacagcagagataatgaaagaccagcagctctacccagaaacaggaagacaagaggcccccgctggctccggtatggtgcagtgttaaagtggcccttccccagtaccaacatgaagtcaccttcaaggtgtaccaggtggctggactatacctggagaaatgtctgatgtctgggaacctggatgtagaaccctagtagaatattgtgttgtttaatatttttattagatttggatgggtaagtccaaagttgaaacagagattcaaaacaacatgaccttccataaatctcaaagtatttcaaaataaaaagtttatttaaaaaagtagtggcacaggcttgaggaaacagtggacagaaaacgagaggatgaaattcagtagagataaaggtcaaatccagccctcaagcctttcgaaagcactggtccagcaggttggcaatgtgtatgagggaggtgggagttttaactggtcctattctcagggctgaagccacttgttggacgagggttttgttccaacattggtcttgccccacccctaaacagtctgcctagcacctagggacagtgctgagggcagcagaggcactatctgcaaatgtctgtgaggctataactggagaggaggctcttccacagggctgtgggaagccctcccagaggccgaggcagactcccacctgccaggccatacccaataatgacccctggccccagcactctgcccagtctccaaggaggtgctggatagtcacaggggcataaagagcacctcaacaaagggaagtcagctgagacaaccttgaaagctacttcacctctgtccacgagggctgagctgggcccagcatgcaggcatgacaccaggtactctcttcctgggctgcatatccctgctttggatccaagggccaactctatgcccttggccagttaacagttccaagtcagcttaccctggggaatcaagctatttttaggcaagctatttctgcaggggagaaggttcgtaaggactaagatgttttatttatttatttatttatttatttatttatttatttaatttttttgagacagagtctcacccagttgcccaggctggagtgcagtggcgtgcagtctcggctttctgcaacctccacctcctgggttcaagcgattctcctgcttcagcctcctgagtagctgggattacaagcatgcgccacacagtgtgttttcgtatttttagtagagatggggtttcactatgttggccaggctggacttgaactcctgacctcaagtcatccacccgcctcggcctcccaaagtgctaggattacaggcgtgagccaccatgcctggcctatttatttatttttttgagatggagtctctgtctgtcgcccaggctggagtgcagtggcacgatgtcggctcactgcaacctccaccccctgggttcaagcaattctcctgcctcagcctcccaagtagctgggattacaggcgtgtgccaccatgtgcggctaatttttgtatttttagtggagatggggtttcaccacgttggccaggctggtcttgaattcctgagacctcaagtgatccacccacctccgcctcccaaattgctggcattacaggcgtgagccactgccctcagccaagatgttttaaattaaaaatgaaaccagtcacttgagccacaatgatgatcggacggcaaaatgcaggtgtgcagacatacccatctctgtgcctcacctggtcaattagctgtctcctggatgggttggtctcctcaaggacgtgagcccagagctccggatcctttctgcataccaggtagcgggcctcgcttttgaacagagaattctcattgcacacctgaaatgagcacactcatgtgtgtgacacagcagccaaccagcggaagctgcttgggaggacacaccccaattcgttccctgtgtgcctgatactggtttggtggacagtcagggcccaggcaagacgctatgctttgacatgggatgagcagcatcctacagggttaacgatggactcaaactacctcaaaatgccctttccaagtttacaacaactcccagggatgtgccacatatctggccagtaggacttcctgcattcagggacatgctctgtctcccattctgtctgatacagccactagccatgggaggctactgagcccttgaaatgtggtgcgtgacaggaactaaactggtaatttttaatttagttaaatttaagtactcatatgtagctagctttaaaccatctgtaaaatgttatcagaacagcctagaactggtataaaacagcacaaacactgcaatgtttcaagatctaaaaactgtaaactgtgctttcactggtagatctggagacctttttctgaatgttataacagatctccaaaacaccaacagtccactggaatgttctagcgtgtgcagcacttgctaaatcctggtgaggatcagatctgttgagtgccagatgcccggcacaaggctgagcggcgtgcacacgtgcttgcggatgcagcgcagtccgcctgtgtatcacaggaaaagcccaagcaggctggtgtggcaccaacctcacaggtgccctattcatgtctggatttttagatctggatttttagatcaaatgattaggtaggaacagttcatacaattcaacctaaacatgtaattatatgtggatccaagcctgggcagatgcaggcaaaagacctgggcagatgtctcaaggagaggccagcaagagctcattggtcaggtgatggggaagggcttgtgtagagggttaccccaaaaagggggcatgaagtacaagggtactcgggacatgaggcacccagggaattgcaggcctctccaggtggggtggcaagatggatggctgatcaagttcgggagttgggaaaggtggcagtccacagaggagctcacgagtcaggccaaggagttcaattctgccctcaaattgccaggcaatagtaaggactgtaagcagagggatgataagtcaggttcaggaccaactggtctacaggtacaatgcatacaaattgcatgagcaagttcccaaaagctgtgagaatcacaaggaaataatctcatgacctgccatctccaggtgcacagaaagccctgatcagctccccacaggcacacctttgaaagcttccctgggagcccagggttacatgggcagctcagcacatctgctacccaccttgatgagctcaaggtcacactgcccccgctcataggcaacacaggccagatgggggtctcgcttctcacagtagcggcccaccacgctgctgtcatagtaggcattctctctcaggaagcactcggggctgttgttgctgtcgatgtagattttagccagtgcattgtgagtggcaggctcctcacagccttcctgaatctgggactccagccagggaagcagcagcttgagcctttgaaagaaggaaggtgctgtaaagtctcaaggctaccactggaagtcttgagggcaactccagggctctgacagatgtttcctgaaacaaaaaatctcagagtccattgacttcaggttgctctagggaccaagatggacctggtttccaaactgatttctactgttaggttttcccccaaggtcttcacagtaccaatagcaagtaactcattgctacatctaagatgtgtacatgaacgaccagctatagagacagtcctggagaattagacagaaacaacaacagacactagaatccaggggtaagagaaaacaccaagtaaggacaccttacctatttcttttttctacttcagccaccaactcatcagtagagaactgtcctctcactgccatgattaagtgtttaatcacttcctcagaacaatccacatcaagcagccctccaatcacagctggggtccggctagggttgacctagggtagtcaaggtcaagtaacttcagtgttgcaaacacaagttattgttagaagcctcctacgacgtggacagtttgggcaaaaccctgaaagggctcctgtttagcactgcgctgtgtcccaccaaaattcacctgctgatgtcctaacccctagtgggattctacttggaaagagggtgtttaagaaggtaatcaatgtcaagggtggggccctaatgtaatgggactagtgtccttctaagaagaggaagagacaccaggagtgcacatgcacagaggaaaggccctgtgagggcacagccaggaggctgtctgcaagcgtgggagacagccttcaccagaaaccagccctgccgacaccctgatcatggacttccagcttccaaaactgtgagaaataaatgtgtgttgtttcagctgcctggactgtggtcttctactctggcagtctgagcacacgaacccaccacccttcaaaatgatagtctctgaaatgtcaggtgttacaggcagcctctgaggggaagactgccactgactggggcccagaggcagccgggtgtcactccagggagccagcagtaccttctgcacgtagatctcaatgtacctctgcaggttgttgcggtataaatataggacaaggtcatggacaaagccaaaacgatcacacacgatgatgaggggaagctggtctgtgagcttggcctcctgaggattagaatgcacagaacaagtcagggagtggagaaaccagacagccagacctcggactcattgcacacatgggacggctctgtctctgcagcagagtgacacacaggagactcagaatgagactgctctaaataggctgtcgttttgtggtatggcatttgctttgggaaataagtgagagaaagatattagtatttggttaaagactgctacatttggcattaacattccaaatctggacaaaaatatcttttaagacaagcagctcattatgtgcaaacccaacagaaaccaggccattctcaagaacagcacacctgcggtaagggctgccttttcagacacgcagccgcaggccatggaaacacacccggccaccattcccagatgatgatggcacttgggtaggacagccacaggccaccacaatcatgcctcccctcatgtggtcccgtgcctagatcacattttgaagttttaagtgtggccacatgacctcatttcctccaatggaacgtgaatccaagtgtcatctgccacttgcaggcctcgcccataaaaaccacctatgctggttcctctgtgctcttcccttcctctagctgactgggaagacgacatccaggtgaggtgctgaacacggcaaagcagccatgaagctggtccttgaagtacagtgggaaggaaagtcaccccactgacctccagcctaccctggactgccacataaggaagtaggcttcctgttctttatgacactagtgctgagtggtctacttgtttctgcagctttgcctgcctaattgacaatggcactaatgggatgttgatgaattacaatgcagcaataagtgccagatacttagagcacagcctcaagctgctttccacactcttaaaacgatagaagggttactttagaactttaagccataaagtggagctctgtccctgggactaaggggtccctggcgagacagatccagcttcctgcccctgggacgtcctgcggatggtctgccccacctgccatcagcaagggcagctcatggaaggaggcagcactggaacacaccttcaggaagttcttcacacgctctgggttgtagcagctgctctctcggcatatcctctccacctccttgatctgccctgtcttacaggcagcctgaatgtatttcagatgcacatctgggtcttggctgaagttcacgattgagcccaggaagtagaagaggcctatgaagagagaccattccatttttgtccttgtaacacctgcctgtctcctccgtagctgctgcccaccttccctcgatgaccctgctccactctccagggacccacagcacactcagaactcataatcaatatgccatttgtctgttttggcagctcccaaaaatagctagtcggatttccattatatttggcaggtatacctggcatgttttgatgtaaaatactagatatttggtacaagtgaaattccttttgtgggcccaggtatacctagatagtcgtcatcaagagtaattcccactgaggtaatctgaaatggtggtgggactgcttctctaaaaagacacatcaagggacagagaaataagccatggcctccaggaggaggcctgcaactcaacacagagctgacagtgacatgggcaccacatgctgagccccagggtgagccccagaggacagcattcacagaggctaatgatgttcctcatcattacagaggccagccaggaggcaccagtaacaacagggtacgacacatctgagaaggcccctccctgtcgaggtctttcactgtaactgtgagaccctgatgctaggaagggaatgggcagcccctgggctgacggttctccaccaacctactctactgccctctcccagcccagctccactcaatcgtctgccatggtctttcctacaggggtgtcttctaaagagaaggccagttccctgaggacagggtcatgtcccaccctccaccgatgccccaacctcactggacacatggcagtggcttgatgcctagacaaatgcttagtctctatcctgggtgggccagacagcccccatctgtccctaacaaagccactcccatcccaactgccctagaacacttttttggtgtgatgtccaagaaggggaaaggaagacaaccaggttaccttgtcagccccccacaatcaactgggtagcagacaccacaaagcaatgcaccctctatcgtgggctctcatttaggagaggcccaaagagcctccctcctggggctgtaaagaccagacatcaggccctttcactgtacccacgacacaggcttttagatgaattcttgccagactgtgctgcgtagacacaccgggctccataagtttctccatcccatcaccaaccaacctgatttcttcctttggaaataccaaaaaggttactgaagctgagggtgcacatgagatggcagtagcattctgccaccgactgagcacccaaggcagccagtgctgcatcctgcctggctttgcaggaaggccgtcttaaggcgggcaggtaggcagcaacacctgagaaaggaggtgtagtcacatggtggggtcggcgagaggctgcatggtttacctttgtaactcttgaaggattcaaagagctccaccagggcctgcgtgcccagctgctcgtggtacttagaggccacctgcacacacagctgaaggttctgtctgatgttagcagacagcatggcatgcagacactccacagaatcctccaccgataaggagccaaagaaattgacaagccactgggaacaaggaagagtctgtccacaacgatgcaccactctaaagattgctaacacttggaaaataactaggtcattctcctgttcccctgagtgtcaaaaatacagagaatttccacataaaggggttgaaaagcaactatccatcacgggaaaaagtaggagcaaggagtaaagctgggaaaagacactgatctaaactgttcacctggaatattccacagatgatgctaaaacttattccataaattggaacacaatagctagtttagctttgctaatggtttcagacagtcctattaggttgtcaatgttaaaaggtgaccagtatactcctgctattagactaagtcaaaggtggatatcagaaagaaaggtgctacagggcccagacatgctgctgagcagataaactttgtgcgtgggctgaattagaactgcttttggtagtaaagtatggtaggttagggcagtgacaggctcaggccacagttccacaatcaccaacaggtgaacactggggagcatgtgacattaattgcatagacaacagccataataggagtgcccaggggtacacagtacctcgggattgaggaggtgagtgtggaccacagccctcttgatgtcatagaggtcggtgtagtgctccagtgcttgctgcaggaggcctgccttctcacagagctgggcaatgtgggcccggtcgtaatgagtaaacattttatttccaaggatggcatctgcaacctatgaaacagggagttcggtgagaagccctgatcaatggcaataactttttaagaccagctgctcaatcttgccccagggtagggtatagcctggcaaccagaactcacaggcccctgtccacatccatacctctgtggtggcagcagtgcttgtgggtcccaaatccctggctgtccttcaagccatcttaggccctttgcacaaggcttcattctcccatgttgcagctgggccaagcccatgtggtcacagagttgggcctgtgagaaaggctgaggctccataaagccctattactgggatgagtccaagtcactgttgcagcttttaagcaatcacattctttttttcctttttttttctttttttgagacagagtctcactccatcactcaggctggaatgcagtggcacaatctcagctcactgcaacctccatctcccaggttcaagcgattctcatgtctcagcctcccaagtagctgggattacagacgcacaccaacatgcctggcttatttttgtatttttagtagagacagagtttcgtcatgttggccaggctggtctcgaactcctgacctcaaatgatctgcccaccttggcctcctaaagtgctgagattatagccgtgagccaccgtgcccagccagcaatcacattcttatagggtttctatggcaagatcaatgtgagggctcaagtctaccgattctccttgaatgagctcaagccttagattagcaatgaccagaaggagacctgaacaaaacaaatcccatttgtgcttactagacttctctactaggctaaatacagaactaggagttggggattgcatttaaaaaacaatgaacactcctggaaacaattttgatgaggcataaaatcttttttttttttttttttttgagacagggtctcactctgttgcccaggcgaatggagtgcagtggtgcaatctcggctcactgctgctttgacctcccaggctcaagcaatcctcccacttcagcctcccaagcagctgggattacaggcacatgccaccacacctggctacttttttttttttttttttttgagatggagtctcgctctgttgccaggctgcaatgcagtggcatgaccccaccctgctcactgcaacctccgtctcacgggttcaagtgattctcctgcctcagcctcccaagtagctgggactacaggcatgcgccaccacacccagctaatttttgtatttttagtaaagacagggtttcaccatgttggccaggctggtctcgatctcttgaccatgtgatccacccgccttggcctcccaaagtgctgggattacaggtgtgagccaccgcacctggcccacctggctaatttttatatttttttgtagagatggggtttggccgtgttgtccatgctggtctcaaactcctgggctctgctcaccttggcctccaaaaatgctggggttataggcgcgagccactgcacccagccactaaatattctcttgaagtaagtaatttttgggctaagactggataggtcaacacagcagccttgcagcatggctgagtgagtgctccctcagtatctaatgatggtcttgacaagctacactcctgggtgccttcccctgccacctggcacactctttcttattccttctaggatctgcatcaccaaccaggtatggccacagagtgaccacagccactgtcacacaccagaccacttcagagtgatgcacagagttgacgatcaaacacagtactaagagtagggctttagaacatctagcacttacctgagtctcctatcctttgtttccttcaggtttatctttacttcttgttttcaaacattttctcctcatagcaacagtgtattttatagaatgtagaaaccatcacgcagtcctactgcccagagaagactgccagcgtcctggggcactaagccagagcctgctggcacctcacccaactacttgtttctcctttagggtctgggcattccttagggtctgtctgccaagtttctgagtgacgcttggtgtgtttcaaatctcattcaccagaaacggttacatacactcacaaagtcatgagagtccagtagaccccaagcagcaaattaacagtacttttatttcctagagttggaatatgacccacttcttagcagctaacttgtagatttgaataaattgaggtaacagaacaatatacttaatatgttgtttcctaattataaaaacagtaagtgattattaaagaaaaatcagaagagataagtaaagaacaaagtgaacttgtacaatcttatccacttagtaccgtggtgaacagcttgatataaactcctctaaatccctttcttgtatatatatctaaatttaacccaaaatagcacagacatgtgatttgattatacctgctcccacaagtttcaggccaacaaatgatgcctcaccacagtgagataccactgcacgcccattaagatggtgattactattattattattttagacagggaagatgtgttggcaaggatatacagaaattggaacagctgagcattgctgggaagaatataaaatggtacagcctcctggaatacagtatggtggttcctcaaaaaggtaaacatagaattactgtaggacatgatccagcaagtccacttctggatatatgcccaaaagaattaaagcagggtctcaaataaatctttgtacacccatgttaacagcagcattattcacaatagcctaaaggtagaagcaacccaaatgttcatcaatggatgaatggataaacacatgtcatatatacacatggtggactattactcagtttcaaaaatgaaggtgtttctaacacatgctacaacatggatgaaccttgaaaataatatgctaagtgaaaaaagccaggtaaaaggacaaatattttgtggttccatgtatatgaaatatcttgaaaagccaaattaatagagacagattagaatggcagttgtcaggggctgggaaatgaggagtcactgcttaacagttacatagttactctgggataataaaagttctggaactatgtagtggtaatggctgcatagcattgtgaatgttcttaatgccactgtatcagacacttaaaagttgttaaaatggtaaatttggttatgtatattttaccacaatgaaaaaaagaagaaaggaagaaatgctgccctaattagaactgtttccatgaaagtcctgtatcatgatttctggaaaatccttttaaggaaagtcatggagaatgtccactgagaagtacaagataaacatctggcacaagcccagcccagtccaaagccactgtgctcaagtctgcaaacccagagaggtgccacaggtgctctgcctctcggtgttagcctacaagtcactgacctggggtgcatgaacaaggttcatctccaacagccatgtctgcaggagtccctcagctgggcgattattcttcaaggcatccaataagaaggaagtacactgctgaattaaactgttttccatgaaaatgtccacaatctgaaacatatccaagccacattttcactcagtatgttttcattcagtgtttcattttcctattgaaatagttcctgaaatattatctcatttagaaattcagcaattagttccctcccttggttttttttttttttttgagatggagtctcgctctgtcacccaggctagactgcaaaggcacaatctcagctcactccaatctctgccctccacctcctgggttcaagcgattctcctgcctcagcttcccaagtggctgagactacaggcacccgtcaccacacccagctaatttttctatttttagtagagacacggtttcaccatgttggtcaggctggtctcgaactcccgacttcaggtgatccgcccgcctcggcctcccaaagtgctgagactacaggcataagccactgcgcccggcccctttccattttcttctgtcatcgcaattcacatacagccaggtgtggtggcatgtgcctatagtcccagctactcaggaggctgaggtggatgcattccttgagcccaggagttgagaccactgtgggtaatgcagtgacctcatctcaacaacaacaacacaattcacgtaatttatggtcattaatttattaataatcttgcaaaatcatatcacctacatcatacttatcagtgaggtattttactgaagtatatgaaagggagtaacttttataacatatgaacccccaagcagtaatcatacattacttaatcacatcctagaggcagctgtgatgcttaactttaggtgtcagcttgactggattaaggaacacatagagaacaggtaaagcattccttctgggtgtgtttgtgagggcattcccagaggagactggcatgtgagttgggggaacaagtagaatgatccactctcaatgtcggggaacaccatctaatcggctgggggcacaaaaaaggaaagaatagatttcttctctctttctcctggagctgggacattctccacctcctacctttggacatcagaactccaggctccccagcctttggactccaggacttacaccaaaggccccccagggttctcaggccattggcctcagactgagagttacgccttcagcttccctggttctgaggctttcaaacttagattgagccacgctaccagaatccaaggtctcctctagcttgcagacagtctatcacaggacttctcagcctccataatcacgagccaattctcctaataaactccctctcatatatctgagatagggtctcactctattgcctaggctgaagcagtgacaaggtcaccactcactgcagcctcaaccttcagggctcaagcgatcctcccatctcagcctcctgagtagctgggaccacaggtgtgcaccaccatgcctggctaacttttaaaaaattgtttgtagagatgggggtctcactatgttgcccaggctccctttcatatagctatagctacgctattgattctgtctctctgcagcatcttgactaacaaagcagctgatacttgatatctaactcatatatatcattatattattggggcacaactgggaaaatgcaaatatttacttagacaattattaaagttaaattgatgttaatttaaataattaatatgccttagtaagatgtgaaatacaggaataaatttaataattgtttttgaaggacagctttacaggaaaataaaaaagaacttattaactgtggaacttctcataaagtatgagaagtttatattttgaacaactttaaaatatgaactgtaaacaagatgtgaactggaaatttctttcctattgaaagctaagtaaatttgtctcaaatctcttattcatgttctccaaaatatctgcagattcccagatgtacaaacacatacaactgcacttattatttctaaacagttgttggttctgatgccttgcttcaagctttgttacacatctatatatcatcaaagctccttgtaccaatttactgaaagtgacttgtcatgtgtttacatctaaattttaagtaggttacactaaaaaacaggctgatgctcacgtaatccaggtcagtcagacacccacaggatgaacatctgggggacgcaacagcactagctcctggtgctcaggccaatggtcagggagagacaatgatgtagtaactggggtgggccacgggatggagggctggaacctaaatgacatcctcacaccctacaccatcaccacccaaagacacaaacccaaacaaacattctctaaagtacttcaaaacaaaggaagcaatgagtactcacatagtaaagactagaagacaaactccccaagtacactagattttttaaaactgcaagattaatagcagatgaagaaaagcattgagacaagttaacaggaaacgaatcaaagaaatcttctagatggctctaaaaagccacaaaaagttgtccaaaactgcctacgctcacctggctaatgttggccagcggctcctcgtcctgcactagcattcgagaaaactgcaggccctgttccggactgatcttcattacacccctcagcagaaagatccagtctggggtgtacccaacctagaagcaagggagcaccaatcaggaaaatcaatgaaaaaccctgggcattagaaaaggaagttatccatcctttgttttaaactcgtgttaacaaagaaatgagcagcaacattatcatgtgtaggtaccaccttctgccaaacacaatatccaattaaatgaattgatttaatgtacatggaaggcacaattaactatacaaagagcccagaccacaaagaagtttcctgatctgtgtgcaaacacagcctgccagtaagcacacagggataagatctgggagtctgccaaaatatcaaattaacatacagaaggaagagagggagagaaaaaacaagataaagctcccaaataaaacgaagatggaaggactggaaaactaaggataataaaaagctgaagagaataaaatatgatcattatgaataaagatcctaacagcaacattgccaactctcacaccagaggacttacaaagaagggtattttataaactttaaaatcagcaaccactcaaccacacgtgagtaatctgtgagatgccagtggttcaacacacgttacctttttggcatagagcacaattttctggaattggcctgtttctgcaaaacactggatcactttgcttggcacatttgcccgaaggtacacactcagagcgagcatggggtcagtggttttgaccaagtctccgagctcctctgagcactccagctgtggtatgccaagggacaaggcaaagttaggaggcaggtagggagcctggaccaagttttcaagctgtgcgggggggctacgagctcacaagtgtttctaccttatcttctttcagccacttctctaggagttgcttacgcccctgctgaagaaccagatggcaaagttctaaggattcaagtttattgagctgaccctggtcgagcaggattccgaagtactgcagcaatggagaagcctggccagactgagcgggtatactctggaatttctggaccgtctctctggtacgcaggattccctaataataaatggaaaaataggtcattgtgttgtaatcacaggggatcccttcactcaacttccttgtatgtaaaaacaaaaatctgccagtggaaattccacactgctctgtcatagacaaaaagtcctctaccaaggcaactgcttctatcttcaacaataaccataagtataggggaatctaggtcctccaggtggcttcacacttagggtcttacttctcccccagcatgctgcagtaagaattcggcctctcaatcagtcttgtagtagtgaagttctgctatcattatattctaattcaaaatactcaaattcacagatgaaggctagaaatggtttgttcacaactaccccttgaaagacaagaaaaattctttcaaggacaagcaacttgaaagtctttatctactcaggaacagatccagtctctgaacaatttatccaaatgaaataaacccaagaaaaagccatatgccgaaatgctatattctaaaagagtggagaaagtccagggtaggactatcgctagataaaacagggaacaaccacttgatgtattgtacagttgcatatttgacaaccaggtagcaagagtggaaaatgctaagttacagaaatgtgaaactgtatctaagctgttgggtgagaggtacgtatgcacacaaagtgggaggcgtgaagaagtgccgatgcagcaagagtgtgttttttgtttacttcctttactgttatgccattggtgcaaaaattttaaactaaaaactcctaacataacactaatagactgcaatatcactagtgaaatgcttttatgacttattttcctctcaaggttggttcttaacactcagaacacttgaacagtattcaaggtttatcacctttggtgcagacgctgcaactttggcggcttcagcatagctgccctgtgcaaagagggtattgaattttctcacaaacaacttctctgccccagccaggttactacgaacggccaaacgcagaccaaggtctggattctgaagcacgttggttgcataattcacaatgttatcttcctcaacacaaactgacagtacctgtaaggacacaacaagtgagagcagcccggcctagaagagtgctccaccatccctctgccatgttcccttccgatgctggagtggtagccacattctcaggcgagtgttgagcacacctgtgatggtggccctcacagtgaaaggaggcaaagcagccgaaagccaaatggtaacaaaacagaacagcataggagtctatgtagttattaaagtcacacagataagtgtgatgcgttctgcgctacagcaaaatgacctatgtggatggaactgacaatttttcttcttaaactttttatttttaaagtacagagtttctttcttttttaaaaaatatttttgtagagacagggtcttactatgtcgctcaggctggattcaaactcctagcctcaagcaatcctcctgtctcagccttccaaagtgctgggattataggaatcagccactgttcccgacttttttttttttttcccctgagacaggctctcactgtttcacccaggctggagtgcaatggtgtgatcacagctcactgcagcctcaaactcctgggctcaagccatcctcctgcctcaacctcccatgcagttgggattacaggcataaactattgtgcccagccaagagtttcttcttttaactatctttttcaactatggttgagaaaagttacttaaataccatagtatctgctttttcaaccctccccagttagggtgtgcatggtataaagatgatgtgcatcagaactgctgttctatacgcaggaaggagctgctctcctcctggaatcaatcctgtgttaggaatggtgctgtctgaagagaggaagtgtcaatatgaaggaggagacatgggtttaagtttaataacaggaactattaatagctacacccagctgctttcctagagaagggggaaagtttaaacgccagtccctaatgaatggaaaaggtagaaaatgaaatgtcagagttacacacctgtccctttttgttgacaccaataattccagaggttggtttgtgtggagcagtgacaaatattgtgtcagcactaatacggttcatgcagatgcacacgccagactctaggtcgtacagatgaagatagccatactttgtgatcaagtaaataacaccatgtttagctccaatctataagaagacagagagcaagaggttggaaagtaaggaggagaagccatgcgggtaaaaagagctcacaaatgataaagaggattcttgtttgtttgtttgttttttgagatagggtcgtgctctgtcacccaggctggagtgtagtggtgccaccatagctcactgcaacttccgacctctgggctcaggtgatcctcccatctcagcctccaatgtagctgggactacaagtgtgagctgccacacctagctatacaaggattcttcagtttctcaggccgagagattactggtgggagcaatgctttcctgagacatggattctaagttgtacttgattgagaattagttttaaagacaatattttgtccaaccactctcaaataaaggtccaataaactcaggctactccatttatctttcaggtagagcgatcctttcacagtttatcgaacccctttaagcaagctgtgagttcataagagaaggggaaagttctggacaaagacctcaaacgccaagatgatgttccagcatgccttctaccaccacttattaacctttgagttttgccaaatgctattaacttttacagaaaaatatttaacacacaagaaaacctgaaggggctggggagaaaaaacagatgcatttgcccaaccagattattaaacatatatattaaaacagacagtaatttttgaagtatgattttaccactggaagagacagagagagaaaataattaagagccctgaaagagaatgaatcatatatgagaatttattaagaatgagtgtgtggtggctaatgactatagtcccagctacttgggaagccaaggcaggaggatcacttgagcccaggagtttgagtcaaacctgggcaacgtagcaagactccaactctagaaaaataaataattagtaggtaacatattagtggaaaataggcactttaatcaatatataacatatattattaatatagttagctagctatctggagatggaggtaagagtaaagaactgaatttctatcttactctttagatcaaagtaaattccagatgggtcaaagattttaaataaaaaacaaggacaattaggataggaatgaaagaaaatataggtaaatgttgtgatcatcttcaggtgcagaattagtctcaaaacatgataccactgccacacaaaaatgcagcacttccataaggtgccacatatcacaaattacgactgggaaaaatattcaaaatacatcagacacttagtactctacaagtacaaaaagctcttacgaataaggtaaaaatcctggagttgggcacagtgacacacacctgtaaccccagctgcttgggaggctgaggcaggaagatcgctcgaggccaggagttcaagactggcctaggcaacatagcaagaccccatctctactttttaaaaaaagatcccaatagaaaaaaaatgcaaagattaggaaaaggcaattaaccggatacatatgagtggctgatacatcaattctgccttgatggtaaccaagggaaagacatcacaacatgggatgctgtccagctaccaccggcagcatcagtaggaatgtgaactggccagcatggtcaggagagtctgtgatgagagtgtgcccctgacccagcagtttaatttctaggaatttatcctcggacttttagactaacatacaaagatgtatggagcacaatgttccttatagtgtttcttgtaaatgtaaataccaatcaacaggggattgtttaaatgagttgtagcaaatccacagaacagatgacacagacaataaaatacatacattatgttactggaacagaatgatctacaacatagctagaggagtttatacagcagcaaggctagtgcagagccattttcataagagtccatctgtataaatctgcacaaatgtatgcatgttaagttacttccaaaggggtagccaaattatcagcagtgctaggatttcaggtgatatttaatcctgctgttacatttattgatattattagaaatgtacagataacatatattttatgagaacaaaagagtaaaaaggagagtagattatataatcttacatatataatgtgatgccaattttgttcagaaaaggtatagatctaaattttttataaaacaaattgtaagattttttatttttattcttatttatttatttatttattttttggaaatgaagtcttgctccaggccgcggtgcagtggcatgcagtggtgtgatcttgcctcactgcactctctgcctcctgggttctagaaattctcctgcctcagcatcccatgtagctgggactacaggtgcacaccgccatgcccagttaattttttatattttagtagagacggggtttcaccatgttgcccaggctggcgtcgaactcctgagctcaggcaatctgcccgcctcggcctcccaaagtgctaagatgacaggtgtgagccaacgcgcccggccaagatttcttatatattttacatccaactggtttatctacagaggaatgttttctgactctgtgcctttgacacttccacaacaatattctgctcctcaataaggaaagcacacttgatcctgtcacgaacacacttagcacacacggaaccaccacaggccctgctgacatgtgtttctgttttagggaacctcacaagaacttcaggtctcatagcacgaactcctcgaagtctggctaggcacatgccacatgcaggttcaggtgttttcccaaccttcttgatgtaaaggtgaataattctcccaccaggggcttgggactacctagtttcactagaggctgcgtgtcaaaggctgggccattctgaatgccagctcaaaggactgtccctgggagctctaggctccctcaatggcagccaattgtaaaggaaataagtgttttattcttttttttattattataagttctgggttacatgtgcagaacgtgcagttttgttacacaggtatacacgtgccctggtggtttgttgcacccattaacccgtcacctacattaggtattttattctttaaatattctcataccacagtgaacatctaatcttttataataagaaggaaagagctgaggactttgatgtgtgacttggcaacgtcttcctgctgccctaactcaccctcatgccgggcattcctttctacgaacagggctttcccagctcacacgccaaagccttaggcctctaaatgggtttgaaagcatcacagtggcaggagacagcagaagcagactaaaaatggcagcctcctgtatcttgggaggtgctagagtagattttaggacatgaagatgtttagagagcagcacattcgtacctgcatagccactggaaaatcattctgtgcctctggaggaaaaaacacatctactgctttctttacaaaaggttggtttcccgctgcaggctgtccaacttcaatgatgtgcaactagaagagagattttaggtcaatcaaggggaccgcctgtggtggtgggcaagtgctagtcaaggcacagaggcaagtggagcctcagctccacacactggatgattaacgctaaaagtcacattcaaccaaagcagaacaacccccttgtcggagtgcctgtgattatccaataacctgctgcccaccaccaagcatggcacaaagggccaatgccaggcagcctggagcctcagttccagcacagtggcagagtcacttcccctccccgggcctggatgccgatgaaacaaagggctccagtcagaatctgctgtcccttccaactctgctctctgcctttctgggtatggcccagactcatacaagcctgttagtgcaagatctcatcactggaggcgaaactcacgagacatcctcaccatggcacaggcctgaggttttcaaggttgtgctgggcgggggtaagaatctgatgagggagcccatccctgccttatgagaacagctccaagttcctgacctatgccagtgccttccctataactttctttttcttcttttttttttttttttttaagatggagtctcgctctgtcgctcaggctggagtgcagtggcgcgatctcagctcattgaaacctctgcctcccgggttcaagcgattctcgtgcctcagcctcccaagtagctgagattacagattacagatgcatgccaccacacccggctaaactttgtatttttagtagagatggggtttcgctatgttggccaggctggtctcaaactcccgaccccacctcgggtaatccaaccccacctcggcctcccaaaatgctgggattacaggcacgagccaccacgcccagccaccataactttcatctaaagaaaaaatattataactaacacaagtccacaacaaaatccaaaatgaagggtaagagacacaaaacaagggcgggaggctgggcttagaggacacagacaagggtgtctgtggaggggcagtctgggtttgcggtctgggtttggccgggcagagagaggagggaaacaccaaaggggctcagataaggaggggagcagcactgagagccgggccaatgggggaggctgagcggcaagcatgtgggtgctcctgtggggacagaagtctgtggatggggaatagaaaagtcttgcactgggagctttaaggcagataaaaggtagtttaggaaaattatctggctaggcctattggtaagaaggcgtgaagcaggtctgaggacctaataaatggctattctgtaacccaaatgtgaggtgagaaaggcttagtgtaccacaaaagggtaagtcagatgtgggacttgttaaaggtcagacagtgacgagagaatagaatggggcttgactgctatgggttcttgctcgggagctgagaagggtgacactgccagcaggagcagaggcacagaaaggacaccaggctctcagggcagcagcaggaggaggttggcagaaaagaactgtgtccaggcaagctccgccccacatgtggagacagctggccagtcccaaaaggacaggtgagtcctgaaaggaaggtgcatgcctgggcacaggcggggcgggcaccctcccaggaccccacacccaccctgcagccgggaggaccgagtctgccacaagacacagggccgctccaggacaggtactgtcaggaaaccgcatttcccaggctctctgggtcacagaagacctcctggtccatctccagctcggctggaggggcatgcccaccagaaagctaggtgtagagagaacccccagccccttctcttcttggggctgccgtctgtgtacagagccccgctctgggaagtgctcttctccacagggcactctgtgaggcaggctctgctcctcagagggaggcctgtcgctgccctgctgcatctgtaaaggagaggtgtgcctcactctgagggaatatgggagcaagctctttgagccacataactaaagtcagtgtccttcatcagcaacaaggctgacacgtgacccgagtccttttccttctggctctcaaatgaggagggcatgaagtatgttactcaacaggaggccaaagtattcagtgtatttcagatgaggaagtttgtaaagccacattctaattgagaactcctctgccttggggaatatttcggggctaacgaacaacccaaaattatggtttgagaaagtgtttttcacaagacgactgtcttgaagcagctctccaagtggctgagaccacaatggcggaacccaaggtctccctgacatcacaagctcttctgtctcctcacctctgcccatggcagccctgccgagcagccgctggccatgtccctgagcctaataaaacccactggctcctgggcacagtctcaatctctctggagcctccctgaggcgcctcccaaccacctgggaagaaccatgctaatggcaaggatggcaccacactggtgatttcacagtcatctccccaagagcagaaactgtgcctcatctaccttttttttttttttttttggagatggagtctcgctctgtcgcccaggctggagtgcagtggcgcgatctcggctcactgcaacctctgcctcctaggttcaagcaattctcctgcctcagcctcctgagtagctgggactacaagcgcacacagccaggcccggctaattttttatattttaatagagatggggtttcgctgtattgtccaggctggtgtagaactcctgagctcaggcaatccacccacctcggcctcccaaactgctaggattacaggtgtgagctaccgcacctggctgcctcacttacctttagagtgcatttcagtctagtctgtgtggaaggattttttttttttcttttgagacggagtctcactgtgtagcccaagcaggagtgtagtggtgcgatctcgactcactgcaacctctgccttgcaggtcccagttcaagcaattctcctacctcagcctcccaagtagctgggtttataagaatgcgccaccatgcccagttaatgtttgtatttttagtagagacggggtttcaccacgttggccaggctgttcttgaactcctgacctcgtgatccaccctcttcggcctcccaaagtgttggattacaggcgtgagccaccgcgcccagcctgaggattttttaggggaatggggccacttaatcatgtgcatcacggtgcacagttctcaacaccaccatgaacctttcctcacacagacatctgcaggccatgcccagccacacacacgcacacccctaacaccagctcatgacacttttctcagggagaagacagtagagtggatcttaccttgcctcctgtgggattacgtacagcaaagcagaaaagggtggcaggcttggcattcccctccatcttgaactctgcaaaagccgcagcatggccttctatgggttgtgaaaccttcctatccacagagtagagctgcattgctccaaccacacggttttgctaagaaaagatattatgcaatgaaagggagagaaaagagaggaatataaagaaacaattcttaaaatatatttctaaaatgaaagtctcatacattagaggtatacttcctctagtaaaaattaaatgtattagctattaaaggcatgatatcactctgaattttatgtggaaagatggcaaacactatggaaaaaaataagaccacaaaaaagtaagatggacaaacctaatttgttaaatatagtaagtgtgagagcattttttcatggaaagtaactcgtgcactttggaggaaaaactctaaagcattaatagtagttaaatcgggggatgcaatcacaggtaattttgaaaattgtgttttctgaaatttctaagtagcaaaaattgtatttaataaaaaccaataaggccagcacagtggctcacacctgcaatcctagcaccttgggagaatcacttgaggccgagagttcaagactagtctgggcaacatagcaagacgccatctctacaaaaaaataagaaaattagctggtcatggtggcatgcgcctgttgtcttagctactcgggaggccaaggcagggggattgcttgggccaagaagtttgaggttgcagtgagctatgactgcagcactgcactgcagcctgggtggcagagcaagactctgtctccaaaaaaaccaaaacccccaaaccagtaagactaatatcttttataaaacttagaacttgtattttctttctttctttcttttttttttttttttttgtgatggagtcttgctctgtcacccaggctggagtgcagtggcgtgatctcggctcactgcaagcttcgcctcctgggttcacgccattctcctgcctcagcctcctgagtagctgggactataggcgcccgccaccatgcctggctaattttttgtatttttagtagagacggggtttcaccatgttggccaggatggtctcgatatcctgacgtcgtgatctgcctgcctcagcctcccaaaatgctgggattacaggcttgagccaccatgcccagccagaacttatattttctactaaagaatttcagtacatttatatccaatgtcaaatgctcaaaaagctaagtgaatggaatacaaaagggtcccagttcaagctcctgtaattaaacattcaatcctctctgctgagtgagctcacatatagtcgtgggtaaaatcctcagtctattcctcactcactcacaactccttaaaatgggataacaaaggcttcaactttgtctttaaaaatattttctattgcacagatttctgttaacgttattaagcaaagtactgacacatgctaccacatggatgaaccttgaaaacatgctaaggaaagaagccaggcatgaaaggctgcatattgtctgattccacctatgaaatatccagaaaaggaaaatttattgagacagaaaatagattagtggttgccaaaggctggtaatagggagaaataaggagtaaaccagcagataagtggtctgtgttttaacagaaaaatgagcatggaaaggtaaaaatgagaatccaaagacaggacaaaactcaccctccccaagagactgtgggaagacttccagcaacatgatgatagcacatttgagtcctaaaggtacagatacctaaacgaagcctaaactgcagccaagacgaagaggcagagaagacagaacagccaaggtgaaggtgagagaccagaccttaggctacgtgtgtggccttgggccgatgtcctgcttctaagtcttaggcacctgccaggcttaccttcccacctcatggggctgctgagtgttaagtgtgtcaaattttggtaaaggcatgttaaggactgtagcaggcaaggattcaatgagcaaatgcattcattgtgccaggcaccatgctaggggccagggataagtaaaatatgacacaggtccttctctcaagaacagatggtaagagtttccggcaagtacacaagcaactgcaatacagagtgctgattgctacagcatgggagagaacaagatgccttatcagctcaccaagatcagtaagtcagggaggcttcccaaagtgacacctaagctggagtaagagctaaccaggtgacaggaacagaagttgtttcaaacagaaacaggcatctgtatttgcaaatgcttagacagggttggcaaactatggccccatgttcccctctccccctcctttttttttttttttttttttttgagacagagtctggctctctctcacccaggatggagtgcagtggcgtgacctcggctcaccacaacctccacctcctgggttcaaacgattctcctgcctcagcctcctgggtaactgggaccacaggcgcgtgcaagcatgcctggctaatttttgtctttttaatagagagggggtttcagtatgttggcctggctgatctcaaactcctgatctcatgatctgtccaccttggcttcccaaagtgctgggattacaggcgtaagccaccacacctggcttcccctcccctttttatgttgaggtgacattcacaaaacaaaatgaaccattttaaagtgtatgattgaatggcatttaggacactcgcaatgtgtggaaccaaaacctcatcatagttccaaaacattttcatcacccaaaagaaattcctgtgcccattagtcagtccccagtcccctgacccaagtcccctagcagccaccaatcctactttctagctccatagatttactgattctaaatatttcatataaatggaataacaataaaatatgaggccttttgtgcctcacttttttcatttagtaagtttttgaggtttacctatgtgtagcatgtatcagtacttcatttttagggttaaataatgtcccactgtatggatacaccacaacttgtttatccactcatttgctggtgaacatttgggctgtttctaccttttggttattataaaaaatgctattacgaatatctgtgtaaaagtttttgtgtggatacattttcatttctcttaggtagacacctaacagtggaactgctgggtcaaatggtaattctgtgtttaacttttttttattttttgagatggagtctccctctgtcatttaggctggagtgcagtggtgcgatcttggctcactgcaagctctgcctcccgggttcacgcaattctcctgcctcagcctcccaagtagctgggactacaggcgcctgccaccatgcccggctagtttttttgtatttttagtagagacagggtttcaccgtgttagccaggatggtcttgatctcctgacctcgtgatccacctgcctcagcctcccaaagtgctgggattacaggtgtgagccaccacgcctggccttatgtttaactttttgaggaaccaccaaactgctttccacagcatctgaacatttttatattcctaccactaatgtaggagggttccaatttctccataacattgccaacacttcttttcttttcttttttttgagatggagtttcgctcttgttgcccaggctggagtgcaatggcgcgatctcggctcacttcaacctctgccttccaggttcaagcaattctcctgcctcagcctccggagtagctgggattaaaggcatgcaccaccacacccggctaattttgtatttttactagagatggggtttctccatgttggtcaggctggtctcaaactcctgacctcagggccaacacttattttctactttgtaaaaattataaccattcgagtgggtgtaaagtggtacttcattgtggttttgaattgcattttcctaatggctaatgatgtcaagcaagtcatttgcccactttttaactgggttgactttttgttgttgagttgtaagtgttctttgtatatctggatactagacccttatcagatagatgattttcaaatattacatcccaggttgtcttttcactttattggcaatatccttttatgcacaaaagtttttaattctgaagtccaaattatctattttttaattttgttgttcaggcttttggtgctattatatatctaagaatccatgccaaatccaaagtcataaagctttctccttatgttttcttctaagagttttgtagttttaccttctacattgaggtttcagatctattttgagtttatttttgtacatggtgtgaggcaggtgaccaactccattcttttgcatgtggatatttagttgtcccagcaccattcctgaagagactattgtttcaccattgaacagtcttgacactctcatcaaaaatcaattggccacagatgtaggggtgtattcctggaccttacattttttcccattggtctacatgtctattcttatgcccatgaggtgttttgttgttggtaaatgcatgggatttttttatttgttgttttttagtttgtcagtaaagcatatacatgtaactatgatttataatttttgttttatattcttcaaacatgatgatttctttgtaaagaggcataattcccaagagtttttattttgttgttgttgttgtcatttgttttgttttgttttgtttttgaggcagagttccactcttgttgcccaggctggagtgcaatggtgtgatctcggctcactgcaacctctgcatcctgggttcaggcgattctcccgcctcagcctcccaagtagctgggattacaggcacatgccacaactctcggctaatttttgtatttttagtaaagacggggtttcaccacattggccaggctggtctcgaactcctgacttcaggtgatcctcctgccttggcctcccaaagtgctgggattaaaggtgtgagtcaccgtgcctggcccccaagggtatttttaaaagcttaattgagatataattcacataccatagaacttatctatttaaagcaagcttgtccaacatgtggcccagtatagccttgtatgtggcccaaacacaaattcataaactttcttaaagcattatgaacttttggctgggcatggtggctcacacctgtaatcccagcactttgggaggccgaggcaggcagatcacctgaggtcaggagttcgagaccagactgaccaacatggagaaaccccatcactactaaaaatacaaaattagccaggtgtggtggtgcatgcctgtagtcccagttattcaggaaggctgaggcagtagaatcgcttgaacccgggaggcggaggttgcggtgagccaagaccatgccactgcactccagcctgggcaacaagagcaaaactcggtctcaaaaaaaaaaaattatgaatttttttgcaatttttgtttttagctcatcagctattgctagtgtattttatgtgtgacccaagacaattcttcttccagtgtggcccaggggatccaaaagatcagacacccctggtttaaagcataccatccaatgtttcttcgtatactcagagggctgtgcaatcatcactacaacatagttttagaacactttcatcctttgaaagaaaccctattagcattcaatcctcattcctatctcccagactccacctccagtcataggcaactacttatctattttctgtgtctataggtcagactatcctgaacatttcaaataaatggaatcatatagtatgtggtcttttgtgactggcatctttcacttagcttaatatttccaaggttcattcatgatgtatttttagtagagatggggtttcgccatgttggccaggctggtcttgaaatcctgaccacagggtgatctgcctgcctcagcctccctcccaaagtgctgggattacaggcatgagccactgtgcctggcccttctaagagttttataggttcagttcttacatttaggtctgatcgattttgagttttttagtattatgagacagaggtcccatttaatgcttctgcatataaatgtccagcgccccaagaccttgtattgaacaactcctctttttttcactgaactgtcttggcaaccttgtcaaaaatcaattgaccacaagggatacaacactttgattagactggaggaataagttcaaatgatcatgcctataatcccagcactctgggaggccgaagcgggcggattacttgaggtcaggagtttgagaccatcctggctaacatggtgaaaccccatctctactaaaaatacaaaaattagcagtgcgtggtggcacgtgcctataatcccagctactcgggaagctgaggcaggaggattgcttgaacccgggaggtggaggttgcagtgagccgagattgtgccactgcactccagcctcagcgacagagcaagaccctgtctcaaaaaataaaaaaaattaaaattaagaaattaaaattaatgaatttttaaaatatatatttgcactctactgatattattttgattcagagaaatatgttcataacttattagaaataaccttgagtagtttgagaccagcctggccaacacggtgaaaccctgtctctactaaaaacacaaaaaaaattagccaggcatggtggtgcacatctataatcccagctacctggaaggctgagataggagaatcacttgaacccaggaggtggaggttgcagtgagccgagatcgcaccattgcactccagcctggacaacagagcaaggctctgtctcaaaagaaaagaaaaaaaaagaaataaccttgagtaaatttaaatttatttctaagttgatggtatggctaggttttgataatttttatttggtttcccttccctttaatcagaaaattaactttcataccctgttcacaaaccatcaaagctgattttgaaacttaaaaaaaaaatcgccaggtaccatgcaaaagcaatcttccctttagaatgactgatggtatgctaaggtttttcgtggcatattattattaaaggtgaatacaaataaatgggccgggcgcggtggctcacacctgtaatcccagaactttgggaggccgaggtgggcagatcacttgaggtcaggagttcaagaccagcctggccaacatgatgaaacactgtctctactaaaaacgcaaaaattagctgagcatagtggcacacacctgtagtcccagctactcgggtggctgaggcaggagaatcacttgaatctggaaggtggaggttgcagtgagctgagttcgtgccactgcactccagcctgggtgacagagtgagactctgtctcagaaaaacaaaaaaagaaaagaaaggaaaacaaaacctgttttttgggcacatcacttttctgggactcatctgttctttttttttttttttttttaattttagagacagggtcttgttctattgcccaggctggaatgcaaagacatgatcatggctcactgtaaccttgaactcctgggctcaagcaattctcctgcctgagcctcccacgtagccaggactacaggtgcatgccaccacaccaagctaatttgtttgtcatctattctcaagttagtaccacattctattttttttaacttttttaatttttttttagacaaggtctcactctgtcacccaggctggagtgtagtggtgcaatctcagttcactgtaacctccacctcccaggctcaagcaattctcccacctcagcctccagagtagctggaactacaggtgcatgccatcatgcctggctagtttttgcattttttgtaaaaaatgggttttgccatgttgcctaggctggtctcgaactcctgggctcaggttatccaccttcctcaacctcccaaagtgctgggattacaggcatgagtcactgagcccagctagtaccacattctggatcactgtaggtttgtggcaagttttaaaattgggaagtataagtactccaactttttatttgttttatggttgttttggctattctgggttccttgcaattccacataaattttaggatcatcttgccaacttctacaaagaagctagctggtattccaatagagattatgttgaatttgtagaccaatttgaggagtacttccatcctaaaagtattaaatcttcgagtccatgaacatgcaatatttttcgatttagatcttctttaattacttccaaacatgttttgtagttttcagaatgtaacttttgcactttttaaattaaatttacctctaagtattttattctttttgatgttattattaatgagattgctttcctgatttcatttttggattgttcgttgcaaatgtttaggaacacaattgatgtttgcaaactgatattgtattctgtaaccttgttcaatttgtttattagttctaatagttttttactagattccttaggatttccatatacaagcttatgtcatctgcaaatagagacagctttaattcttccatttaaatctagatgcctttttgttttgttttgtttctgagacggagtctcgctcttttgcccaggccggactgtggtggtgctatctcggtcactgcaagctccgcctcccgggttcatgccattctcctgcctcagcctcccgagtagctgggactacaggcgcccgccaccgtgcccggctaattttttgtatttttagtagagacggggtttcaccgtgttagccaggatggtctcaatctcctgacctcgtgatccgcccgccttggcctcccaaagtgctgggattacaggcgtgagccaccgtgcccagcctaaatctagatgccttttatgtttttctcacctaattgccctggctagaatctctagtccaaagctgaacagaagtagcaagagaagacatccttgtcttgtttctgatccttgggggaaagctttcagtttttcaacatgaagtaagatgttagttgtatttgttgtagatgccctttatcagggtgagtaagccaaagtcttaggtcttgtctcccctgtatatctgcaatgccactgccttcatctagtcacacatgcttcatatcttctgggggttgcagaaatggaacagagcgttccagaaatggaagtactccttccctgtttgcgtattcttaacctttctcatacatgtctctattccagaacagactacatggttttgttcctgtatctgcctttcaactagtctcctggcctccagtcttcatggtggtccatcttcaacatcaatgatagcattttttcaattccactatgctgctaagaaggaaaattaattacatcactctcactcaaaacctgctacataattcccattgcctgcagtctggcccccaatcatctctctaagtcttgcccctctagctacctaatatgcttacctataggtatcatccacggtgggtgaccccagactcccagaaagagccattctcctccattctgtgcctttgcatacactgtgtccttccaaagtgcactttaatagctagcaaaatgcatcttagatcccctgtgttgcaggctgtcttgacttaagctgctctctcatggctcccacagtattctcttcaaacatgtgacagttccttaattactagaattgtgcagatacaccttccccactaggctatagacaaatcattcactggtcatcaggattgaatgacgaagatctatgtcccaagtgcaaacatcctgtagtcctcaagtatctggtgactgaattagccaccaggaatgaaaaaaggggacgggcgcggtggctcacgcctgtaatcccagcactttgggaggccaaggcgggcggatcacgaggtcaggagatcaaggccatcctggctaacacggagaaaccccatctctactaaaaatacaaaaaattagccaggcatggtggtgggcgcctgtagtcccagctactggggaggctgaggcaggagaatggcatgaacccaggaggcagagcttgcagtgagccgagatcgcgccactgcactccagcttgggtgacagagtaagactccgtctcaaaaaaaaaaaaaaaaaaagggaggacaaaaagatactgctttcagtataatagaatatgagttagtaacattccagtaagtccttaaaatacagtctaagaactacttcttttttttcccataaaattaaatgctttttagtgtttcaaataagcagcatttacacagaagcagctctatgttaaccatctagatgctgggactttgatacaatacctacagtgcagacacacgggggccagagatgccaggaaggccgcgttgtgtgtgggccgtggtgtgtgcgggcagtgtgtgcaattaccaaggacaggccagctgaccgcccatttccccaagacctccctccctgcggcagctgtgcacatcggggccctttgaccccatgggccacggtccctccctgccctggctgggacgcagtgggcaggatgtctagccctctctcgtcttcccgaaggactacttcttataaaactatgggttccaaattactctataaaattcctcaacaacctctcaaaacagtgctagaaatagtttatacaatgaacatcagtaacctgaaggaatgcagtagtagttaataggccaaaggtaaattaagattatttgatccaagttcagatttctttgtaatctctatttctctcagttccaggcctacttttgccttatacctataaccaactttttttttttttgagacagggtcttgctctgttgcccaggctggagtgcagtggcgcaatcttggctcactgcaacctcaaacccctgacctcaagagatcctcccgcctcggcctcccaaagtgctgggattacaggcatgagccaccgcacctggccctataaccaacttctaatgatttaaccactccattctaatattgggctttgaagttacatcagaccagcccctaaaggcagctcaaggcttacctgagccgagatgcctacgagcagcagccacttctggtactcatcagtccggtagtgaatcacctggcagcccaccagactggtatgtctatcaaacatcttcatgggctgggagtcaccttccatgctccagtggtagaccgcggtctcggtcaccaaggcaacagtgttcacagaaacccatttccagaaaatcacttcttctgccatagtatgagccttcattttactcttcatctcaatattaaagatctgaagtgtcttcccagctagtatttgatataatagagattagagaaagacaaattaaaaatctgaaagacaaattcatatactcttaattctgaattcttttaatattactttaggttgtactgctaatctgattaacagggtctgaaagatgctgccagagtagtaattaagcataccttaatgtctaaatattgagaagagcctgtatgcattaaattcttcttcagaggaatgtaaaagtatgtaactattcatagaaatatgtgaataacaatgagaaattagttctactgaagcaagcctctcttttagattggtttcttctagttttaaaatacttttctggataactcagcaaaaacataagacaccccttctctgtgtggtctccaattttcaagaaagactacaactatcccttcacattaaaccaacttctccaaatttgtcttaaattctagaccaatgctgacaaatggaattttctacaatgttggatatattctatatttgtatccatcacagcagataatagctatatgtggctactaagcacttaagatgtatctagcaagatatttcaggaactgaatttatacttttatttaactttaattaatttaagtgttaaacagccccatgtagctaatgtccaatagggcagtacaattctagacaaaatatttggcatccattctctggcaagagatccatattgtttctacatgtagcaatgaactaaattttgattttggaattatacaaaatttagacctaacataaaatattaaaatattgcttcccacaaagattgggaacaaggcaaggattatttctctgaccacttgttttgatactgagaataacatagctggtgtgataaggcaagaaaaataaaaggcataaagatcaaaaaaggaagtaaagctgtcttaactcacagacaacataattatttacaaagaaaatcctgcagaatctacaaatctacaaaacaactattagaattaatagatgactacaggagtgcagcaagatgcaaagacaacctacaaaaatttcaattgggctgggcacagtggctcacacctgtattcccagcactttgggaggctgaggctggtggatctcttgaggtcaggagtttgagaccagtctggtcaacatggtgaaaccccatctctaccaaaaatacaaaaattagccgggcttggtggcagtcacctgtaattccagctacttgagaggctgaggcaggagaatcgcttgaacccaggaggcagaggttgcagtgagccaagatgatgccactgcactccagcctgggtgacaaagtgaaaacaggtctcaaaaaaaatcaactgaattttgagatactagcagcaaacaatttggaaatataaaaaagaattcaggccgggcatggtggctcacgcctgtaatcccagcactttgggaagctgaggcaggtagattaccggaggtcaggagttcaagaacagcctggccaacatggtgaaaccccgtctctactaaaaatacgaaaattagccgggcatggtggcacactcctgtaatcccagctactcgggaggctgaggcaggagaattgcttgagcctgggaggcggaggttgcagtgagccaaaattgtgccactgcactctagcctgaccgacagagtaagactctgtctcaaaaaaaaaaaaaaaaaaattcataccaccacccaaaacatagcattttggagtaaatttaacaaagggtaagcaaagtctctacactataaaatattcctgaaagaaagtaaaggcttaaataaaagaaggggcataccatgttcatggatcagaacacttaaaattgccaagatgtcatttccccataaattacgtacaggttcaatgcaatcccaatcaaaatcccagaatccttttccttctttctttctttctttttaatagatacagggcctcactttgtcacccaggctggagtacagtggagcaatcatagctcattgcaacctcaaattcctgggctcaagtgatcctcctgcctcagcctctcaagtagttgggactataggcatgcactgccacactcagctaatttttcttttttttttctttttcttttatcttttttttttttttttttttgagacacagtctctctctgttgcccaggctggagtgcagtggcatcatctcagctcaatgcagcctccacctcccaggttcaagtgattctcctgcctcagccccccgagtatcagggattacaggcacatgccatcacgcccacctaattttcgcatttttttgtagagatggggtttcaccatgttggccacgctggtctcaaactcttgacctcaagtgagtcgcctgcctcagcctcccaaagtgctgggattataggcgcgagccaccatgcccagtctaatttttaatttttttttttttttagagactaggtcttgctatgctgcccaggctggtctcaaactcctggcctcatgcaatccttccatctcagcctgtcgaagtgctgggataacaggtgtgagccaccaccctggcccagcatcttttgtttgcttggtggaaaataaaatgatgctataatgaatatggaaatgcagaggacaaagaatagacataacaaatttggaaaagagcaaagctggaagacttacaatacctaatgttgagatgtactataaagctattaataaaacctatgttattgtcataagacacatagatcaatgaaacagaagaaagtctagaaacagctgcatgcactgatttgataaaagtgcctcaaaaaactcaataggcccaaacacattttttataaaaatagaaaaatccattctaaaatgtatatggaacctcaaaggacctcaaatagccaaaataatcttgataaagatgaacaaggttggatgatctcacacttcctgaatttaaacctcattacaaagttaaagtaagcaaatgtatggtaacagcatagaaacacagacaccagtggaatataagagagaactcaaaaatgaaccttcacatatatgatcaaatgatctttgacaagggtactaagaccattcaatgagaaaaaagaatactcttttcaacaaataatactgggaaaactgggtccacaaaataataaaattggacccttaccttataccatatacaaaaagtaactcaaaatggattaaagacctaaacataaaaactaaaatcacaggcagaacctgagtcctgttctctcactttcctccccagacagcatgagtttcaccactcactccactaccttctctactaactaccagtccctgggatccgtccagccgcccagctacagtacccggttgatcagcagtccagccggcatctatgcagatgtaagggatttgggctcccagatctctgtgtcctgctccaccagtttccagggtggcttggggtccagggccctggccactgggatggccaggggtctggcaggaatagggggcatctagaatgagaaggagaccatgcaaagcctgaacgaccacctggcctcctacctggacagagtgaggagcctggagactgagaattagaggctggagagcaaaaaccgggagcacctggagaagaagagaccccaggtcagagactgggccattacttcaagaccactgagaagctgatggctcagatctttgcaaattctgtggacaatgccttcatcgttctgcacactgacaatgcccatcttgctgctgctgactttagagtcaagtatgagacagagctggccatgcaccagtttgtgaggagcgacatccatgggctctgcaaggtcactgatgacaccagtgtcactgggctgtagatgaagacaaagattgagactctcaaggagaagctgttcttcatgaagaaccatgaagagggagtaaaaggcctacaagcccgtattactagctttgggttgactgtggaggcagatgtccaaatatcaggaccttggcaagatcatggcagatatctgggcccaatatgacaagctgactcagaagaacctagagaagctggacaggtactgatcccagcagattgaggagagcaccacagtggtcatcacgcagtccaccgagatcagagctgctgagataacactcacagagctgagatgtccagtccagtccttggagattggcctggacttgatgagaaatctgaagatcagcttggagaacagcctaagggaggtggaggcctgctataccacgcagatggagcagctcaacagggtcctactgtacctggagtcggagctggcacagacctgggcagagggacagcgccaggcccaggagtacgaggcctggaacatccaggtcaatctggaggctgagatcaccacctaccaccgcctgctggaagatggggaggacttcaatcttggtgaggccctagacagcagcaactccatgcaaaccatccaaaagaccaccacctgcaggatagtggacggcaaagtggtgtttgagaccaacgacaccaaagttctgaggaattgagccagcagaagcagggtaccctttggggagcaggaggccagtaaaaagttcacaggttaaaaaaaaccccaacaattaaaatcataaaatgtttagagaaaacataggggaaaagcttgatgacattggatcttgcaatgatttttttggatatgacaataaaagaaaaaaaatgaattggacagcatcagaggtcacaaaagagagaaaaggcaacccacagaataagagaaaatataggcatacctcactttattacactttgttttattgtgtcttgcagatattgcacttgttttgttgttttgttttgtttgagacagcgtttcgctcttgttgcccaggctggagtgcaatggcatgatcttggctcactgccacctctgcctctcaggttcaagagattctcctgcctcagcctctgtagtagttgggattacaggcgcccaccaccatgcccgactaatttttgtatttttagtagagacggggttttaccatgttggccaggctggtctcgaactcctgacctcaggtgatctgcccgcctcggcctcccaaagtgctgggattacaggcgttttttttgttttgtgaacaacaacaacaaaaaaaatcaaaggtttgcggcaatcttccatcaagcaagtctattggtatcatttttccaacagcatgtgctcacttcctgtctctgggtcacactttggtaattctcatgatatttcaaactttttcattattatatttgttatactgctctgtgatcagtgatctttcatgttattacagtaattgttttgtgtcaccatgaaccacacacatataagatagtggacttaataaatgtgtgtgttctaactgctccactgactggccatgccctagtccctcttcctctcttcaggcctccttattccctgagacacaacaatattgaaattaggccatttaacaaccttccttgctaaaggaaagtgaaagtgaaaggaagagtcctacgtctctcactttaagtcaaaagttaggaatgattaggctttgtgaggaaggcatgtcaaaagccaaggcagactgaaggttaggtctcttgcaccagttagccaacttgtgaacacaaaggaaaagttatttaaggaaattaaaagtgctatttcagtgaacacattaatgataagaaaacaaacagccttactgctgatatggacaaagttgtagtggcctggatagaagatctaagcagccagaacaatcccttaagccaaagcctaatccacagcaaggccctaactctctgcaattccatgaaggctgagagaggtgaagaagttgcagaagtctgaagctagcagaggttgattcatgaggtttaatgaaagaagccatctccatagcataaaacggcaaggtgaagcagcaagttctgatgcagaagctgtgtcaagttctccagacgacctagctaagatcattgatgaacaaattttcaatggagaagaaacaacctcctactggaaaaagatgccatttaggactcaagcaagagagaagtcaatgcctggcttcaaagcttcagaagacaggttaactctcttgttaggggataatgcagctggtaactttaaatggaaggaatgctcaccgaccactccaaaaatcctaaggcccttaagaattatgctaaattgactgggcgcagtggctcacacctgtaatcccagcactttggaaggctgaggcaggcagatcacttgaggtcaggagttcgagatcagcctgaccaacgtggaaagaaaccccgtctctactaaaaatacaaaaaattagccgggcatggtggtgcatgcctgtaattccagctacttgggaggctgaggcaggagaatcccttgaactcgggaggtggaggttgcggtgagccaatatcgtgccactgcactccagcctgggcaacaagagtgaaactctgtctcaaaaaaaaaaaaaaaaaaaaaaaaagaattatgctaaatctcctctgcctgtgttctatgaatggaaaaacaagagtcgtgatgatagtacatctgtttacagcatgatttactgaatatttaaaactcactgttcagatctactgatcagaaaaaaaaaaaaaggttcctttcaaaagattactgctctttgacaatgcacctggtcacctaagagctctgacggagatatacaaggagatgaaagctgttttcatgcctgctaacacatcaattctgcaatccgtggatcaaagagtaatttcacctttcaagtcttattatttaagaaatgcattttttttttttttgagacggagtctttgctctgttgcccaggctggagtgcagtggcgtaatcttggctcactgcaagctccgcctcccgggttcacgccattctcctgcctcagcctccccagtagctgggactacaggcgcccaaccatgcccagctaatgtcttgtatttttaatagagaaggggtttcaccgtgttagccaggatggtctcgacctcctgaccttgtgatccacccgcctcagcctcccacagtgctgggattacaggcggaagccaccgtgcccagcctaagaaatacatttttaaaggctacagctgccataaatatgtctcctttgatggatctaggcgaagtaaattgataacctcctggaaaggattcaccattctagatgcaactaagaacattcgtgattcacgagaggagatcaaaatatcaatattaacaggaatttggaagaagtgtattccaaccctcatgaatgactttgtgaggttcaggacttcagtggaggaagtcattgcagatgtggtagaaacagcaagagaattagaagtggagcctgaagatgggactgaattgttgcaatctcaggatcaaacttgaacagatgagggctgcttcttagggatgaccaaagaaaggggtttcttccaatggaatctactcccagtgaagatgctgtgaacactgttgaaattactacaagaatttagaacagtacataaacttacctgataaagcagcaccagagtctgaaaggactgactccaattctggaagaagtctactgtgggtaaaatgttagcaaacagcattgcacgctacagagcaatctttcattaaaggaagagtcaatccctgcggaaacctcactgatgtctttttttaaaattatttattatttatttatttgttttttgagatggagtctcactctgttgccagactggagtgcagtggcgtgatcttggctcactgcaacctccacctcccggattcaagcgattctcctgcctcagcctcccaagtagctgggactacaggagcgtgccaccaggcccagctaatttttttgtatttttagtagagacggggtttcaccatgttggccaggatggtctcgatctcttgacctcatgatctgcctgcctcagcctcccaaagtgctgggattacaggcataagccaccgcacccagcctgatgtcttattttaagaaattgccagcctgtcgcggtggctcatgcctgtagtcccagcactttgggaggctgaggcaggtggatcacgaagtcaggagatggagaccatcctggctaatgtggtgaaaccccatctctactaaaaatacaaaaaattggctgggcttggtggcaggtgcctgtggtcccacctatttgggaggctgaggcaggagaatggcatgaacccgggaggcggagcttacagtgagccgagattgcactactgcactccagcctgggcaacagggtaagactctgtctcaaaaaaaaaaaaaaaattgccacagccactccagccttcagccaccaccactgtgatcaatcagcagccattggcatcaaggcaagaccctccaccagtaaaaagtttacaactcgcagctgggtacagtggctcatgcctgtaatcccagcactttgggaggctgaggccggcagatcacttgaggtcaggagttcgagatcagcctggccaacatggtgaaaccccatctctactaaaaatacaaaaattagctgggcgtggtcgcacgtgcttgtaatcccagctactcgggaggctgaggcaggaggatcccttaaccctggtaaacagaagttgcagagagttgagataacgccactgcactccagcctgggtgacagagagagactccatctttaaaaaaaaaaaaaaaaaagattacaactcactgaaggctgataatggtaagcaatttttaggaataaataaatagattattcatttatttatttatttattttgagacagagtctctctctgtaacccaggctgacatgcagtcatcagactcctgggctcaagatattctcccatctcagcctccttgagtaggtgagactacaggcgtgcaccaccacacccagaattttttttttttttttttgagctaaggtctcactgtattctttgccatgctgctcttgaattcttaggctcaagcgatcttcccaccttggcctctgaaagtactaggattagaggtatatgccaccatgcctggccataaattatttatttttatttttatttttattttttgagatggagtctcactctgtcacccaggctgaagtgcagtggcgcagtcttggctcactgcaacctctgcctcccgggttcacaccattctccgcctcagcctcttgacaggctgggactacaggcaaccgccaccacgcccagctaatttttgggttttgtatttttagtagagacagggtttcactgtgttagccaggatggtcttgatctcctgaccttgtgattctcctgcctcggcctcccaaagtgctgggattataggcgtgagccactgcacccagccaaattattttttaattaagataatccatttttttagacataatgctatttcacacttaatagattacagcatagtataaacataacttttatatgcactgggaaaccaaaaaattcatgtaactcactattgtaatattctttttattgtggtagtttggaattgaactcaaaatatcttcaaggtatgcctgtatatggaaatcatatatctgacaaggggttaatatccagaatatataaagaatgcctacaactcaacaacaaaaaacacaaatagtccagttaaaaaatgacccacgtggagtggttcacgcctgtaatcctagcgctttgggaagctgagacgggatgatcatgtgaggccaagagtttaagacagcctgggcaacatggcaagaccctgtctctacaaagaaaaaatgtttttaattagctggttgtagtggcgcatgcctatagtcctagctacttgggaggctgaggtaggaggatagcttgagtccaggagttcgaagttacagtctcttaaaaaaaaaaaaaaatggctaccattaaaaagaaaacaatacaaataacaagtgttagcaagaatgtgaaaaaattggaaccctgtgcactactgagaatataaaatagtgcaaccactatagaaaagagatggcagttcctcaaaaaaattaaaaatgaataatgatatgatccagtcaattacttgtgggtatagaattaaaaggattaaaaacaggttccccaaaagacatctgtacactcatgttaacagcggaattatttacagatctagctttttttgaggtactactatctctgaggtacacagctagaaaaaaagagttaatctgactatccagttagttagccaagctacgcaacaactgatattattacaatattatcatcaattagcaaaactggttttaaaccacaatttgagaaataaggctgctgttgctaacagaaagtctttaatgatatcatgatatacctgggcaataattaagatgatttcttgaattcacaaaaaggagcaactcaatggtgaaatttcatgcaatttttttttttttgagacagagtttcgcttttggggcccaagctggagtgcaatgggtcgatctaggttcattgcaacctccgcctcccggattcaagtgattgtcctccttcagcgtcccaagtagctgggattataggcatacaccaacatgcccagcaaatttttgtatttttagtagagacagggtttcaccatgttggccaggctggtctcaaactcctgacctcaggtgatccacctaccttgtgctcccaaagtgctgggattacaggtgtgagccaccgtgcccagccgaaatttgatacaatttatatccaaaacacatgatcagtaagataaaggcctgctgccataaaacagttctaaagttagctataactatattatcaacttaagtttaaactatataaatttataaaacaactgcttttggacataatttaggtgtgatgtagttttgctctctagtcaaaatggtaaatgttagaccctcactgtcttcaggcactaacagcttatggtaaatgacttctaatcagactgaactaagatgggagctcaaatccacaaaaagaaataaagagcactggatatgataaatatgttggttagtataaagatttctcttaatttcattaaataatatcatttaaaaccacaataaaactacaggttgttgagtttataacatatatagatgcatatatgcatcttattttctcttttttaatatattttatatattcatatatatgaatgataaaaatagcacaacagagggaggaggaaatgaagctatgctggagtgaaatttctgcattttaacagaagttaatattaataatctgaaatcatttgtgatgttaggatgcattttataaaccctacagcaaccaccataaaaatacacatacatacacaaaatagtaaaaagaaaaattcagaagaattaaaatggtatgctacattttaacaagaaaggcacagggtaggcagctgtgcgcatgttcctgaagcagcctatatacaccttgccagaagtagggtttttcaaaacaatcaagaaaactaacaaatcttatttatttatttttacagacagggtctcactctgttacctaggctggagtgcaatggcactatcccagctcactgtagccttgacataatgggcttaggatgatcctcaagcctcagacttctgagtagctggaaccacagacacgtactaccacactggctagttttttgtttttgttttttaatttgtagagatggagtctccctatgttgcccaggctggtcttgaacttctggtcccaagtgatcctgtcacttcagactcccaaagtgctgggattacaggtatgagccaccaggcctgacccaaaccttagttaatgatcaagaaaaaaacagaagacacaaattatcaaaattaagaatgaaagagggcaccactgccaaccccaaagaaattaaaagaagcgaatattatgaacaattttatgtcaacatactagaagacttagataacctggatacattcctagaaagacacaaattaccaaaactgacacaagaaaacagaaaatctgaacagattcacagcaagtaaggaagttgaatttgaaatttaaaatcttcccacaaagaaaaccccaggaccagaaggctttcactgttgaattctatcaaatactcaaagaagacagaaataagtccttcacagattctttcagaatatagaggaagaaggacctcattctctaaggccaacatttgcctaattacaaagtcacaaaaggacatcacaagaaaagaaaactatagaccaattataaaaataacagaaaacccttagaatattagtgaacaaaatccaacaacataaaaaaaccaccatacaccatgaccaaaagagatttaccacaggaatgcaaggttggcttaatagccaataattaatttatgtaatacaccacactaataaaggacacaaactatgtgatcatctcagtagacacagaaaatagaagggaacttctccaacttgataaaggatttatctaccccaaatccacagccaacatcatatttaattgtaaaaggctaaaaactcccccctaaggtcagaaataattcaacgatttctgttcttgtcacttctgtttaatactgtactgggtattctagccgatgcaatgttgaaacaaacagaatctggattagaaaggaagatgtaaaactgtctattcacagataacatgatacagtatgtagaaaatgccaaggaatccactaaaaactacaagaataagtttaataagtatataggatacagaaaaatatacaaaaattattttatttctatatactagcaagaaacaatccaaaaataaaactaagaaaataagtctgtatataataacataaaaaaagaataaaatacttgggaataaatttaacaaagaagtataggatttgctcactgaatatgcaaaacatcactgaaagaaattaaagatctaaataaacagagacattaaatgactagaagacttaatattgtcaagatagcaattcttaccaaattgataaattcaatgtaatctctatcaaagccccagaaggatttttgtaggaattcacaaactaaacccaaaatttatgtggcaattcaaaggatctcgtttcaaagagtttcaaaaactattttgaaaaacactaagttggagtaccaacactatctgacttccaaattaccataaagctacaactatcaagtaatcggtgcaagaatgggcacagatctgggtcgggcacagtggctcacacctgtaatcccaatactttgtgaggctgaggcaggtggattacctgaggtcaggagttcaagaccagcttggccaacatggggaaaccccatctctactaagcatacaaaaaactagccaggcatggtggcaggcacctgtaatcccagctacttggaaggctgaggcaggagaatcgcttgaacccaggaggcagaggttgcagtgagccaagattgcgcccctgcactccaggctgggtgagaagaacaagactctgtctcaaaaaaaaaaaaaattaaaactacaaaaccataggctaagcactcttagctatgactccaaaagcatgatccattaaagaaaaaaaaaataggtaagttgggctttatcaaaattagtaagttttgcccttcaaaacatatcctatggtttgaatgttttttgttctctccaaaatgcatgctgaaacttcatccccaagtgttgggagatggagccttttgggaggcaagccctcatgttctcacaaaagagcttgatggagggacttaggttcctttttgcccttctgtcacagtgttcctcccctccagaggatgcagcaacaggggccatcttggaagtggagtgtgaacccttaacagacacactatctggtagcatcttaatcttggacttcccagcctccagaactatgagaaataaatttctattctttatagatttcccagtgtcagccatttcattatagcagcacaaacagactaagacaagatgtcattaggagaatgaaaagacaaggtacagactgggagaaaatatatgtaaatcacatagctgataaactatgtatatccagaatatataaagaactcttataattcaataataagatggacaacacaattaagaactgggcaaatatttaaatagacatttctcagaaaatatatataaatggttaataatcatatttaaaaataaaagatatttaacataattaggcattagagaaatacaaattaaaactgcaaaatgctagtacacaaccactggaattgctataataaaaaagatagtatcaagtgttggcatggatgtgtggagaaactggcatcctcatacattgctgatgggtacataaaatgagacagtcactttggaaaacagttgggcagtttcttaaaaagctaaacagggccaggtgcagtggctcatgcctgtaattccagcaatttgggaggccaacgcaggtggatcacaaggtcagatcaagaccatcctggccaacatggtgaaacctcgtctctactaaaaatacaaaaattagccaggcgtggcggcacatacctgtagtcccagctactcgggaggctgaggcaggagaattgcttgaacccaggaggcagaggctgcagtgagccgcgatagcgccactgcactccagcctgggtgacagagcaagactcctcaaaaaaaaaaaaaaagaagaaaaaaagctaaacaggccggtagtggtggttcacgcctgtaatcccagcactttgggaggccaagggggtggatcatgaggtcaggacttcaagaccagcatggctgagatggtgaaaccccgtccctacaaaaaacacaaaaattagccaagcgcaatggcaggtgcctgtaatcccagctacttgggaggctgaggcaggagaatcacttgaacctgggcagcagaggttacagtgagccaatatcatgccattgcactccagcctggatgggcgatagagtgagactccatctgaaaaaaaaagctaaacaaatttatcatatgatccagcaattctactccacccaagagaaatgaaaatatatgtccacatgcacacatatgtttattgcagcactatttacaatagcaaagacatggaaccaacccaaatgcccatcagtgatggactggaaaatgtggtacatacacaccacggaatactatgcagccacaaaaagaaatgagatcatgtcctttgcagggacatggatgaagctggaagccatcatcctcagcaaactaacacaggaacagaaaaccaaacactgcatgttctcactcataagtgggagttgaacaagtgaacacatggacacagcgaggggaacaacacacaccaggcctgtcaggggagtggggggcgaagagagagagagcatcaggacaaagttaatgtatgcagggcttaaaacctagaggatgggttgataggggaagcaaactaccatggcacatgtatacctatgtaataaacctgcatgttctgcacatgtatcctggaacttaaagtaaaattaaaaaaaaaaaaaagaaattgcagaacaacaacaacaaagaaaatatgtccacacaaagacttgtcagtgagcattgatagcagcaatattcttaatagctaaaaactggaaacaatccaaatgtccatcaactggtgaatggaaaaacaaaatgtggcatatccatacaatgaaacactattagacaataaaaaggaacaaactactgatacatgttataacatggatggacctcaaaaacactatgctaggtaaaggaagccagatgtaaaagactacatattgtatgattccatttatttgaattgtctacaagaaagtctgttgaggaagaaagcagatgagttgctgcctcgggccgggagtaggagtgagaatggttctaaacaggcatgaggaaactttctggggttgcagacatgttccaaaactgtattgtagagatgattccacaactctatgaattcactaaaaatcaccgagaaggagtgaatgttggtcgggcacggtggctcatgcctgtaatcccagcactttgggaggctgaggcaggtggatcacaaagtcaagagatcgagaccatcctggctaacatggtgaaaccccgtctctactaaaaatacaaaaaattagctgggtgtgatggtgggcacctgtagtcccagctactcaggaggctgaggcaggagaatggtgtgaacccgggaggcagaggttgcagtgagccaagaccatgccactgcactccagcctgggcaacagagcgagactccaactcaaaaaaaaaaaaaaaaaaagaataagtgaatgttatggtatgtaaattatacttgaaaaaagcagacaaagaaagatataaaaaaaaaatctggaccaaaaattcttggtggtacgctgtcaggatgggggtaccttttagtgtcaagcagccttagatcacagaggaaatttcttctagcttgaaaacttgtcaagttgtccttagcctggtttaaatgaacatgtgtttatgaggcacaaaatattcagcatcactaaaaggaccaaaaaaggaccagccttctttgggaaatacttcaggtcagacttaagtagtctaggtgaggagggggcctccagggggtgccattccccctcttctatcccccactgagctcagtgccaactctgccgcacagatactagattagcctatactccatctacttctaaaaattaagagaaaaaaggtaaagtttgtaaaaagagatacatataaatactgaaaaggtaatgtgatatggtttggttctgtgtccccactcaaatctcatctcaagttgtagttcccagtgttggagagggacctggtgggaggtgactggatcatggaggcagatttcccccttgctgttctggtgatagtgagtgagttctcacgagatctgatgggtataagtgtgtgtgtggctactctggacacactgcctgtgggttagccctgctctgcaaggagcagttaaaaaaaagtgtgtgtgtatggcactcccccttttgttctctctctactgctccgctacggtaagacatgcttgcttccccttcaccttctgccatgattataagtttcctcaggcctcctagccaagcttcctatatagcctatggaactgtgagtcaattcaacctcttttcttcataaattatcctgtctcaggtagttctttatagcactgtgagaacggaccaacacacaatgtttcataataaaattgacaatatcacacctgggccagtaatgcaaggtatctgccaactttccctataaaaggacataaaagacctctgtctgttttgttttgttttgtttttacaactcctcataaaaaccattcttggccaattgaggtggctcacatcagtagtctcaggactttggaaggctgaggtgagaggatcattttaggccaggagtttgagatcagcctgggcaacatagtcagataccatctctacaaaaaatgtttaaacattagctgggcatggtggcatgtgcctgtagtcctagctacttcagaggctgacgcaggaggatcgtttgagcccaggagttcaaggctacagtgagccatgatcacatcactgcattcctgcctggatgacagagagagacctgatcttaaaacaaacaaataaaaaacattcctagttcaggagcaaaaagcagaccgtttgccaatccctcagttaaggtgttccactaaaatcacaagcaacagatgagtaattctgccaccacttcatgctctttaagtcaaaggcaaaatgtatctggttttaaagaattcaccacaaatccgtcagcaaagaaagtatgaacagagactgggtactgggtaagtgaatctgctccaggcttctccagaaagccgggcaatgacgtgggctgagtatctctgagcacttgggagttcacggccaggcatgaggacaggctgcaatggtgtcccttttaatttttttttgagacagagtttcgctcttttttgtttgtttgtttgagacagagtttcgctcttgttgcccaggctagagtgcaatagcacgatcttggctcactgcaacttctgcctcctgggttcaagtgattctcccgcctcagcctcccgagtaactgagattacaggtgcacgccaccacgcccagctaatttttgtatttttagtagagaggaggttactccacgttcgtcaggctggtctcgaactcccgacctccaggtgatctgcctgcctcggcctcccaaagtgttgggattacaggcgtgagccaccacgcccggccttaatttaatttaatattatttttagggacagggtcttgctctgtcacccaggctggaatgcagtggcacgataatagctcactacaacttcgaactcctgggctcaagtaattctccagccttggcctcccaaagcactgggattacagacatgagccacctggcctagccctttttgtaaagggaggtccgagagctgcttcacgagcccctttccaatcacaaaacttcaccagccaaaatgggaaaaatctgtgagatacaaggtgcagcacccccccacacaccctgtatttctgcactggatcctagaagctagtcaaggtgtgtgatatggcagaggactctgaggagctcacttacaaatcaatcatctccatcaaccaatcactatacaaacaactctttcttcaaagacagtttgctcattttggtgtagggccttgaaaacacactgtacatcctccacttgtcaacgatttgtactacaatgatctgagattttactgctacagaattagcagtaaaaataagataaagccttaaaattatgtccctttttggttccagagtcttacacttcccccacggaaaagaaaacaagactcaacatgttatagttgaagtgatctatatgaccattaagaacgaaaataaaaagcagcagcccctgccacctggaagctggcctggcaatcacagcaaggccatgctgctctcctgatggacataaaccaccttggagaacaccagcctcaggcaagggccctctgagaccacgatcaagtgagacacagcaagcacagaaaaaacaaggttactgcgcaactcacaaaataccaacacgcctctctttcagctaaaatgagtgactgctacttctttacccattatagctttaatctcactctagtcttccctccctaatagatgaaatttattgagatacgcaatcataaaaattacccccacttgctgccaacatccaatctacagcaaacccctgcttccttagactaccccctaaatcatccaaccaaagcccaaatcctataaaaggctctaacaccttcttactgagacactccccagttccccatggcgtgtgttctctcccactgcaacagtaaacccaccttcttcaactgcaagtgtgttcctggtggtctttggctggaagggattgacaacatctaactattgcgttctctttactccccgactccacaccacaacacacacacacacaccctaggagctccgcactgcacattgttaaagagaactgtaccagaaaaccaggaagattaaaatgcagatcatttctgagacctgctgaaaacactaaacagcaaacaaaaccgcaaacaacatgctaaataaggcctctcaaaagtactacaacaaggctgggtacagtggctcatgcctataatccaagcactttgagaggccaaggcaggaggatcacttgaggccaggagctcaagaccagcctgaacaacatggtgggacccccttctctacaaatatttttttaagtactacaacaacataaaatgcagaaaagggcgacactgcaaggcaaatattccatcaaaaagagccaaggggtaagtgacaaagtaagagacagataaaagcatcattaatatcccataattgtaataatttctaaccaaaatcatttatactgcttacactatatgttcaaataattactttgacaagattacaagggaaaaggtagggttggtaatagaacaaagatcctttcaaataaaagaatttcagttatttctttttaaatagaaaggtcttaactttcagatgtccttctacctactgaaatgaccaagtagacactatttctgtaataaaatagaagcctaggcaaagctaatatttggcattcacaaattttacctccagaaacagtttttgcttttctttgtttcttttttttttttttttgagaccgatttttgctcttgttgtccaggctggagtgcaatggcgcgatctctgctcaccgcaacctccacctcctgggttcaagagattctcctcagccttcctgaggagctgggattacaggcatgcgccaccacgcccagctaattttttgtatttttaatagagatggggtttctccatgttggtcaggctagtcttcgaactcccaacctcaggtgatctgcctgcctcggcctcccaaagtgctgggattacaggcatgagtcactgcgcccggcccagtttttgcttttcaaagtaagtgatactgcatttcacacaaaacattaagtctactgcatacataatccttttatttgccaaatgaaggcaatataagaagattctatatttttcaagataactagaaggctttaagcacccaagactccctgatttcaaggaagtaaaattctattaattatcagctcctctatcattgatgtgtttcacaggaggaaaacccccgagcctgtgtcgtcggatgaccggaagcaccactgcagcaggccctcaggcaagggggccacacagccttcctgggaaacatgcacagtgctgttgtgcgttcctagtcgcatgaagacaaaggcctgggcattttcttcctctcggtgtgtctggcgctgtgggtgatgttaccaagaagctctggtgctcaggggcctcttactagggcacactaaacataacttttgctaaaacttttggaattaagtggaatactattgaggagcacttcgccatgagcttagtgacacttgttcaatatttaaggtaacaaagcagttaaaatgaggtaagattcctttctaacaatcccatcgggtttacctttcagagctatcaccttagaggctggattcatgatggcactctctgcagagataggccgtcggatcggagccattgggtcactcatgtcaatgatcgtgacctgtgcctgctcaccaactttctctcggatacatatgaacttgtcagattccatggtcagtgtgctgaatccaatgttagctggattaattccaaggttttggagctaaacagaaaaaaagcatttgattaaatttttttcctctgaaatggactgactgtagccaaaggcaaaagaggagaagttaaataaaatttagaaaaaagttaacattaggtaaacacttgaaggaaacattagcttgcttttctacgcctgtaatagatccacccaagcctgtgaatcaactctccttgagagattaccagcccacagtggagataagacatgtgcaggatgacactaggcagtgtcaaggacgccacaagtgatacagacaggaggagatgagttgggggtgaactcccaaagaacaccatcagataaggtgtcacagataagcccaccaccgaggagagctttgggaggaaggaggtcttggagaggtgaaggcgagggaagtggaagggaaaaagggaggaaacacaaaacctgatttctccaaaaggcaagaaaaaagaactggccaaaagtttttgcttaaacatttccctagatatcatcaaacctgtctacatctgacttgaatgaatttctaagtcagtgtgaatacttcctggagagtctggggttaataagaaagtcagcaggtttggcacatcttccagggccgatggactgctactactgtgtaaactgaaaccaagcacctttctccaaaggccatcttatacgcagtgcctgggctaaatcaagacctgctaatgggataagcttcagtgaaaaactctgggaaaacacatactcaataaatgtttatcactcccacaaagcaccaagcttatttctataaatttctctgctctgacctacctacaagacacctttatttacttatttacttatttatttatttattttttgagccggagtctcgctctgttgcccaggctggagtgcagtggtgcgatctcggctcactgcaagctccgcctcccgggttcacgccattctcctgcctcagcctcccaagtagctggggcttcaggcgcccgccaccacgcctggctattttttgtatttttttttagtagagacggggtttcaccgtgttagccaggatggtctcaatctcctgacctcgtgatccgccctccttggcctcccaaagcgctgggattacaggcgtgagccaccgcgtctggtcgacacctttatttttaaacactgttctgttcagccccaattctactgctactgattggaccacttaacatctgttaccttgtgtaaccttgaagaggctcacactagcaacaaagatcatggaccgctgcattaaaattgcaccaccctttggaaggaacacaagtgagactgttcatactgagagtataattcaggacggtgccttgtttgtcttttgtagcagagtctagcacatactggatgttccagctgctgagtggagcaggctacaggacaacaagtcacctcatctcatcttcctgttaacccactgagacaagcatctcacacacactttacacttgggaaaaacaaagtgttggggttaagaaatctttcagaaattacaaagctgattaatgatggagccaggtataataaagcctgtgttctgaccacaatactgagttgtttgaaattcatattccattttaacacagaaaagataaactaagtggtgattatgttcccaaatgagtccaccaaaacaaacaaaaacacatataacagcaaaaaaacaaaacattacttcataactgtagtgaaatagttttttaaaaaatagaacttgccaattgatattgccattattacaagaaagtcccttcatgttccaacgttgggttatagcaaggaaaataatgctaggagtggtttattaagcataggaaaaacctaagtatttttcctgttctcacacatcactcaacacaagactgccaacgccagatgtgggggggtttctccagcagacaccacctagttatcctacaatttaattcaattctgacaatatctacctggaaatagtatcagatcccacaggttgagggctcagtcccataagactgactacacttcagacactaatcgcaagccccaggctgtggcctgtacttctgaccatccagctataaagcagggttcccatgaccttcttcctgggtttgactaatttgttggagtggctaacagaactcaaggaaacacgtttctcatttattacaagggatattacaaaggatactgatgaaccgccagatggaagaggcgcatagagaaaggcgcgaggggtgtccttgcctctcccagcacaccgctcttcagggacctccatgtgttcagctatcatggagctcccgacatctatctacacatcagcaccacattattttatttatggaggttttgtaacatctggtagggcctgccgtcctcagcacttgttacttttggaattttcttaggtattatattgcttaacattttgtaagtctaaaaaaaaattcaagccccaaaataagaacatgggggtcatttgtggcaggcgaagtcatgaaactggacggaagcaccaagagagaccgtgaaaagtgagagaatggtttggaagcccagggcacagagccccaggacacaccaaggcttagaaggcaggcagaagagcagcccatgaagatggacataatttacttaagtaaagttaacatatttaagtaaaccaagaataaaagataacagaagccccataagcacaaccactgatacttagtaaaccaggaaaccacattatcacaaccaaagaaaacctcccagtctcaccacctttttcacaaatgagccatgttcaaattccatcatcctctcctagtttagttccctgctggcttatacaacaacatccaaggtcataaattcctggaggacacagatcagattagtggggtttttgttttgctttgtttttgagacggagtctagccctgtcccccaggctggagtgcagtggcgtgatctcggctcactgcaacatccacctcccgggttcaagcgattctccagcctcagcctcctgggtagctgggattacaggcactcaccaccacgcccagctattttttgtatttttagtagagacggggtttcaccatgttggccaggctggtctcgaactcctgacttgtggtgatccacctgccttggcctcccaaagtgctgggattacaggcttgagccaccacaactggatagattagtgttatttactctgtctgcaattaatagaaaaatcctgaaaaatagaataatataaatgccctagaagttacagtatttatgtatttatgtatttatttatttatttgagacagtctcgctgcgacgcccatcctggagtgcaatggcacaatcttggttcactgcaacctccgcttcccgagttccagcaattctcctgcctcaccctcccgagtagctgggactacaggcatgcgccaccacgctcggctgatttttgtaatttttagtagagatggggtttcaccatattagctaggctggtctcgaactcctgacctcaagtaatttgcctgccttggcctcccaaagtgctaggatttacaatatttattaacaaaacagaggacagtgggattccagaagataagactgctgcatctgaggtttcccctccaaattctacaacattatccatcagatttgtgagccctttgaaaagaaaaacatgaatacctgcaatcaatatgggctcactaagaagtcatgccaaaccaatctaattttcttgaagccaagtaaatgtgatagaataaatcttcatttcagcaaagtatctggcttacctctgctgaggtagccaaagtaactttcacggataatcagtcccctaccccaagccttttatctgtggcatgcttatagaatagagagctttgcgctttgtgttagttattcatatttacttaatctcttgtttcttctcagagtcaaattcattttgaatccatcaaaacatttagcacataaaagcccaaacaatgtatgaaacaaaagactcttggaatgaggtagaaaagcatgaggtgagcttgtgtccacagctgaactgcacctcagtggtgctggccacatggatctgtctgtctgctgccagggcccagagctctgaccttaatcacctgctagtcaatattctgaataatgactctaaccaaagtcatatacagggactgttttatcggctaaggttatgctttgagactgtcaatatactagagtaacaatcagaatcttaacagatttgaaaggactatgaaattaaaaagataaatgtacacaaataaaatacatttgtgttaagtataaaaaaaagatcaaagcttgcttcaaaaagcagctctaatacataaaatgtcaaccaaatgcaatgcataggccttctttggatgctgattcaaataaagcatttgaaacaaatagagaaacaacactgacaagatactggatgatactgagaaactactgattttttttttttaggtgtgatgttattagagttaaaaaataaagaattattagtgtatatcaatggatgaatagataagcaaaatgtgttatacacatgcaataggagtattattcagccttaaaaaggaaggaaattctgacacatgctacaacatgaatgaaccttgaggtcattatgctaagtaaaaaaaaaccaaggtctggtgagatggctcacgcctgtaattccagcactttgggaggctgaggcgggtgggtcgcttgaggtcaggagatcgagaccagcctggccaacacggtgaaaccctgtctctatcaaaaatacaaaaattagccaggcatagtggcgggcgcctgtaatcccagctacttgggaggcggaggcaggagaatcacctgaacccaggaggtggaggttgcagtgtgctgagattgtgccactgtactccagcctgggcaacagagcgagactccatctcaaaaaaaaaaaaaaaaaaaaagacagtcacacaaaaagacaaatattgtatgattccatttatatccagtatgtagaagagtcaaatctatagagacaaaaagtagatggggttggggggaggagtgtgaatggggagtcatttcttaacaggtatggagcacccattttacaagatgaaaagagttgtgggccgggcgcggcggctcacacctgtaatcccagcactctgggaggccgaggcgggcagatcacgaggtcaggagatcgagaccatcctggctaacacagtgaaaccctgtctctactaaaaaaaaatacaaaaaaattagccaggcatggtggtgggtgcctgtagtcccagctactcaggaggctgaggcaggagaatggcgtgaacccaggaggcagagcttgcagtgagccgagattgcaccactgcactctagcctgggcgacagagcgagaccctgtctcaaaaaaaaaaaaaaaaagaaaagagttttggagatggatggtggtgatggctgcataacaatttgaatgtacttaatatcgctaaaatatacacctaaaaatggttaagatgataaattttatgttatgtatattttaccacaattttaaaacttggaaaaaaataacaaagagttctctcttggtgacacatcctaaagtgtttaaggataaaacaagatgtctggaattggcctcaataaaatttggcagtgatcggagacgtaagtaaatcaaagctggccacgtattggtaagcaatcattcttggtcttgtctacctatctggattttccggctttagcaggataggactggatgctctccagacagagcagtgcactgaagtgggcctgggttttctaaattgtccttttgttctcagtttggggatcgatgttgggttaatacggtgacattctgatttcaactccaaataccaagaattggtaatcctgaataatttgtatccaatctcttgagcatagtgggttcttaaataatagtagctgagtcaagttccttatctaagagcatacatacacatgtatggcatttgaaaaaggtaaaagtccctcacaaataagacagtgttttaacaactgagaagagtggatccaaaaataagataaagactattagaatcagattaaattaagacagtagttctcaaccaggagtgctattctgcattcttcagaaatgggaaaggggcggccgggcacggtggctcacgcctataatcctagcactttgggaggtcgaggtgggcagatcataaggtcaagagatggagaccatcctggccaatatggtgaaaccccgtctctactaaaaacacaaaaattagccaggcatggtggcgtgcacctgtagtctcagctactcgggaggctgaggcaggagaattgcttcaacccaggaggcggaggctgcagtgagccaagatcgcgccactgcactccagcctggcgacagagccaagactccgtctcaaaaaaaaaaaaagaaataggcaatgggttcgggcgcagtgggtcacgcttgtaatcccagcactttgggaggccaagacgggtggatcacttgagatcaggagttcaagaccagcctggccaacatggtgaaaccccgtctccactaaaaatacaaaaattagctaggcctggtggcatgtgcctgtaatcccagctactcaggaggccgaggcaggagaacccaggaggtggaggctgcagcaagccaggatcactccactgcactccagcctgggcgacagagcgagactctgtctcaaaaaaaaaaaaagaaaaagaaaaagaaaaaaagaaatgggcaagggtagttttaatagtacaatgagtggggaactcattctctactcatttagccaggaatgctcaatacaggacaatcccacaaaaataacttttccatctaagatgccagatactactgtgagtttttctccatacgcaggaactaagtcccagaaaagtgatgtgctgaaaagccaggttttttctttctttctttccttttttttttttttttagacagagtcttactctgtcacccaggctggagtgcagtggtggcaccatctcggctcattgcaacctctgcctccccagttcaagtgattctccagcctcagcctcccaagtagctgggactacaagtgcccactaccacgcctggctaattttcatattttcagtagagacggggtttcaccacattggccagactggtctcaaactcctgacttcaagtgatccacccgcctcggcctcccaaagtgctgggattataggcgtgagccacagggcctggcccaggtttgttttttttttcactagttagtagaaataaccaaggattcctgatccctagtatattattctgataggtaacctagctacacatttttaaaaaaattttctttctttttttctttcttttgagacagagtcttgctctgtcgccaaggctggagtgcagtggtgcaatcttggcttactgcaaagtctgcctcccacactcaaccgattctcatgcctcagcctcccaagtagctgggaatacaggtgtccgccactgcacctggctaatttttgtatttttagtagagacagggttttgccatgttggccaggctggtcttgaactcctggtctcaagtgatccactttcctcggcctcccaaagtgctgagattacaggcatgcaccactgcactggaccttagctacacattttaaatggcatatataagatttaactaaagaaaggtaaagaagatgctgtctaatgatccttttcagttctcaaagcctgcaattaaatcaatcaaaattcaaatctgacaatgggggccagacatggtggctcatgcctgtaatcccagcactttgggaggccgaggcgggtagatcactggaggtcaggaattcgagaccagcctggtcaacatggtgaagccctgtctctagtaaaaataaaaaacttagctgagcatggtggcacacgcctgtggtcccagctactcaggaggctgaggaacaagaatcgcttgaaaccaggaggcagaggctggaatgagccaagattgtgccactgcactccagcctgggtgacagagacagaccctgtctcaaaaaaaaaaaaaaaaaaaaatctgacactggggaatatgcaaaaagaaattactcatctgatagtcctgtggtttctatgtataaggggcttaaggaagatgtctgcctgggaggactacaactgtgtttgtacaagagtattagtgagaacatcaactgcctacatcagtgaagccagaatgcttaagttgcactgaacatccccatgttttcacacctatgtggacaccaatattttttctttctgtatctgtctccttcccagtctcactcactgctttatccttgtgcctagcatatggatggtaaacaaatagtaaaacaaattacttgtttcagggcagtaaaatttagttcatctacagtttttaaaacatactttgagggcctggcgtggctgctcacgcctgtaataccagcactttgggaggccgaggcgggtggatcacctgaggtcaggagttggagaccagcctggccaacataatgaaaccccatctctataaaaatacaaaaatcagctgggtgtggtggcgggcacctataatcccagctacctgggaggctgaaacaggagaatcacttgaacacgggaagcggaggctgcagtgagccaagaccacgccattgcattccagcctgggcaacaagagtgaaactctgtttcaaaaaaataaatgggctgggtgcagtggctcacacctgtaatcccagcactttgggaggctgaggtgggcggatcacgaggtcaagagattaagaccatcctggccaacatggtgaaaccccatctctactaaaaatacaaaaattagccaggcatggtggcacgcacctgtagtccgagctactcaggaggctgaagccaggagaatcgcttgaaccggggaggcagaggctgcagtgagctgagatcatgccactgcactccagcctggtggacagagcgagactctgtctcaagaaaataaaataaaaaacacattttatatttgaaacacgctgggcgcggtggctcacgcctgtaatcccagcactttgggaggccgaggcaggcggatcacaaggtcaggagatcgagaccatccttgctaacacggtgaaaccctgtctctactaaaaatataaaaaattagctggacgtggtggtgggtgcctgtagtcccagctactcgggaggctgaggcaggagaatggcgtgaaccctggaggcagaggttgcagtgagccgagattgtgccactgcactccagcctgggcaacagaacaagactccatcttaaaaaaaagaaaaagaaaaagaaaaagaaacttaccaaagagcctttcctagcctaaagagggagctctgtaaatgagggcctatgaagaatgttgacactaaggtctcttccagaacttacattccaggagtaggttagttcagggatagttaactacatttatataatgctttacagaacttctctcaaattacactattacaggttttctttattttaacaccagtgcacaagactctatatttatcccagttaaatgtcaactagctggattctggcctgtcaagatatatccgattctaatttcatcactgaactttgctatcccagctttgtggcatccttcttcagcctgccaagagtgatggtcatctctctggcatggaggccagcagcaggcctcaagagaagtggaagaaaatgtgggagaagagcctgcaaactcagtaaagtctcagtgaagaagcaaaggaaggaaaaatcagacagattgcagaaagattcccccttagagaagggggtgacagggtgccagcaactactaccctagggaatactgataaacaacatgtcagatagatgcagtgatctgtctgtgatcctatgggaggatcttcagtgtgttaagttacaaaagcaaagggcagaagcatatttaaagcaggattcttttgaacatttttggaaggatatggtggcttcgtttatagtggtttcccctggggagagacagacagaggctgaactgaaagattttaattcccatcagactagcccctgcaacagaaatatctcagcagagaggaaccttgactcagatcctcctaggacttaattctttcaacccaaccaactaaaaaagcactggtttgtgtagcttaggcattctgaacatttaaatgttctatggtgaagatctgtttttccaaagagtccccattcaaattcatttactctttggtcacccacaatgccacagcggtaggtactcccacaaggctcaccctcgcagacaccctggctgaggcaggttactctccttgctttgtaaataaacaagtcagaaggcaactaactggccagtatgtatttccaataccagaagcagtggtaggccaacaggcaaaatttaacagtttacatggtatcttaaaatgacattttacatgggatgcaataattttaggatgcaatgagccaactgctgtcttagtacatcaaaaaccacttcacaaaatgagatagctacataatggcaacataaaccaaatatggactggattactatgggtacgtgtccctttttggagcatgacccccagaagcctctccagacacacacgggtgtgtgtggatgggaactgttttcagttcaagctcaatctacaccttcacagttttactttcccccctctttccttaatgattaatattgactaacatgtagaaggctgtttcacctgggctgtgtgtaagactcacctgggaaggaataccaaagctccatctccaccactcagagctttggatttaacatccagcagaaatatgtttaaggctgcaggccattctcacatgcagcctaggtagagaagcactgattaagatcttgaccatctttctcctacaattctaatgctcaaggtctctacacctgtttcaaacaccgcctcagagacactttgagggaacatgtttacgttttctgtgtattgagctatgacacatttcacagcttacaaacttggagctgcttttttgatatagctggggggaattacttagggctcaagaaaatttttatgtcaccaaactattcagccattcctcttctgaatcaagatgtcttaagtgctcagcccatcctcagatattacaaacagcaatacccttccaactctcacatttgaatatttctaaaaagttcaaatggtagctccctgagctcacaatccagcagagaaaatgaacagctacagtaccctgggaagagtgtcattataagaggaaccccaaagaggcacagaggaagaactcctaactgacaaatcagggagagcttccagagacagcgtcatttccacagataccagaaggctcagtaggagtcagtgagtaaagaggggtgagaggagaatgtgttttggcaaggacacaaagggagcggcagcagagttgagcaggtgttgggctgggaagaacaggaaagagcacgtggggatcagtcttttcatgccagaggaaacacgaaaccactccctgaaggactttaagcagatgctcatccttggagatcatgttgcctgtgtgctggagaatggatcacaggagggcaagactagaagtagaaggacaaagctagcatgaccatcaaggtggggagggatggcatagtttagggaaacggtagtcatgatgacagtggcagaacgatgccaaaagtaaacaggagaaagggacaacaggatggggaaaacacatcccaggctcctggctggacactggacaagatacacatctggggagaaagggaaccccatttatgaacactgtgtttgaggaacctgctgaccatttcctggccttcttcagtaggcagctgtcacaatggcagcaacagctcacaaggacacagtgctttacagtagtcccttcttatccgtggtttttttcacactgttacctatagtctgaaaatattaaatgtaagaccccagaaataaacaattcataagttttaaattgcataccattctgcagagtgatgaaatcttgcaccagcccacccaggacgtgaattatccctcctctgcccagcatatccacgctgtagacattgccagcccattagtcacttagtagcggtcagttaccaggttgactgttgcagcatcacagagtttgtgttcaagtaacccttaatttacttaataatggccccaaagtccaacagtagtgatgctggcatattgttattattgttctgttttattattagttatcattgttaatctcttactgtgcttaacataaattcagctttatcatacatatgtatgcatagggaaaaaaagtgtataaagggttcagaacaatctgcagtttcaggcatcctctgggggtcttagaacatattccccatgggtaaatcgggactactgtattatgtaacagttattgtttaatgctttacatttattaactcaaaaacctcacaactaccttgtgagataagaagtataccttttatccttattttatagatgaagatatagaagcacaaaaaagctacaaacattgccctaaatcacacagccagtaagtgcctgagtccacattcagtgccttcagtttggcctcagtctgtgctcttaaccaggacctgctactgcctcacacacacacagcagtgaaactgcgaaaacactcggatggcttgggaacatcaagcttatgggaatacataacatcaccagcagcatgtcctgaatgaaaaagcagaggggctcaagacagattccaagctcatgcacaagagccgcccatggggcagtgggtgtgggcagagaggaaggagaaaccctgggaaactgtggaaccaaaaacagtagagaaaggaccctcaggaggcagtaaagtgcagcatcaaatgcggctggacatcacagaagatgcgtgtggtgtgatgggctttatctcacctagctcatcgcatcttattttttgagacggagtctcggtctgttacccaggctggagagtagtgacatgattttggctcactgcaacctctgcctcccgggttcaagagattctcccgcctcagcctcctgactagctgggactacaggtgcgtaccaacacgcccggctaatactgtatttttagtagagacgaggtttcaccatgttggccaggctggtctcgaactcctgatctcaggtgatccacccgcctcggcctcccaaagtggtgggattacaggtgtgagccaccatgctcggcctgattttattttttacagcaaagattagccaactgcagcctgcttttgtatggctaaactaaaagtctttttcatatttttagaaggttaaaaaatgtaagaatatgggacagagacagaatgtggcccttacaaaaaagcctgcaggatggcttgtaaccttggcaaaaacagattcaggggaaaaaatggggacaaaagccagactgcaggttactgtggaacataaaaataatgaagcactaaagcagctctttcatgacatccagctatgagacaagagcttcgtggggacaagagcgggggaagaagtttgctggttgtacagatggaagagaggtgagcattgcccaacacaaacaggaagaaacaacaagacagaaggatgaaaatacaggaaagggaggctatgactgaacgaggctcccttatagggaagaaggataccagatccagaacatagacaagaaaggacacctacttttgaggtaacaggaaggcaggaaagggtggctgcagacaaacatctaagtctgcagccatataggtgagaaacatcccagttatggcttcagttttctccaagtcatctgctggttgcaaggcaggagtggcaggatcagggatttaaggaacaggctgaagtctcgaaatgtctgtagtgaaggcagtgtgtgctgactcagtgtttgctctacagaatgcacagcagcctcaaagacccagtcagtgttagagaccacaaaccagacttgcattcacgtggctgcccaccacaagccacaagcattttccagataatggaacatatcaactctgatggacattacaaatcctgatggacattagaaactctgatggacacctaaaatatcttgttgctttcttgccctttgaaaagaacatatttagatagtggttaagcacaggcattggaatcagacctgggttagaactcaagctttgtcacttactagccatgtaacttttgctgaaggaattagaatattaacctcagtgacccatggtagaaaacaggatatcactatctgcctcagttatcatgaggattaaattaaaccagatttataaaatacagtagtctagtgagtggcaagagaaacggctcagtaaatgataactacatcatcatcattattatgagcagcagcagtattttgctacctcaacatgactggtgctggcttagcttagtggcagaatgaagcccggacagatgtcagggcactcccacctccatacaacttccactgtgtcactaaccaagtgaccctggcaggatcccctggatatcaagtttccagtctgcagaatgaggggactggactgcactacacagttcccaaggcttttcccgtctgcatctagggctaacagtgctctgcactgtgaaaataggaactttcaagcaagcacgttcctcgatgtactactttgtggtcaaaaagacttgagtctgaatcctgttcttattgaatgaagatgagttctttaacacttttgagactcggtttcctcatctagaaaagagtaagcgaatcgcaacgaatggtagtgtgatgatttaacacagagcactcagggaggagccgctggctatccctcctctgccgcacctcccagggtaaacgtggggaccagcaccgctcccgggcagacccgcgagcggcccgcacgacgcccgacctgagcctttgctcaaagcagggggccagtccttatgtttctgaacacaaacaaatggagaacaaactgggaccttattaaaaaggcaggctttgggggtgttactgcattgaaaagccctatttaggcttggccctgagaaatttttctcttgggtcacgcatgttcacggtcctcccaggcgaagccgccctggggacgaaaaccgatcacagaggcaaactcaggggcgaataaggaccgcaggacgccaaggaggggcgtggagctgtgggatccgcgcggcccttgggttgccctgcctgcagcgggaatttgtgtgcctcctcgcgggcactgagcggggcgtcccagggggcgttggcttccacccccaccattccccagccggccccgccggtaacgggcttcggcgacggcacccaagcgggtcctcaggagcggccgccgcgcccgggacgccgcagccccagcccaggtgggaggtcggaaatcggcgcggccagctgggcagcggctcagcggggctgggggcgcggggtcaagcctggcagtccggcccggcggaggcgcggctgacagggcagccccccagcccgccgggcctcacctggaagtgctcctgaaagcgaacagggaggatctgcgccatggctggtgcgggacctcggcggcggcggcggcagcggcaggaatgaacgccgacccctcgcgcgggctgaccggtggcgacggcgcaggcgcagtgccccgagctcccggtcctggcccccgccctcctccctgaccgcgccccggcccgcaccccctttccccgccccttcccccgcccctgccccgcccctgccccgcctctgccccgcccctgcccccgcccctgcccccgcccctgcccccgcctctgccccgtcccgcctgcgcggatccctccgcccgctccgagggtccgcggaaagtagtcccgcgcgccctctgccctgacgcggtgtgtgccagctacccgagtgaaaggttttcgggggattaatcctgatggggtctgcggcggcccttgcccagcgccttccacatgtggagcgggccagtggtgctagttctgccgccaactctggacggttgagttcagggccactttttactcaggcacggatgtgacagaaagatggaaaagggtcttggaagaaccacatgtgccgtataacgaacgaccttttggtctgaggaggaccgtgtatatgacggtggtcccataacatgataacggagctggaaacttcctgtcctctggtgagggcttagctaaggacatttcctctcctgtatttggagatacacgtacaggtatgtcattaccgtgccaggggaataacgcacctcacacgcggtgcgggtttgcggcctagcagcagcggaccgcatcagctgcctagttgtgtagtggctgtgccatctgagtttgtgtaagttaccttgtgatgatcccacaaccgagacgcatgtctcagaatgcatggatgcatgggacgcgtgactgtacgtgttacagacgtgtttcggcgtgaggctcggcccctgctcctttaggaaacacctttcctggctcatgcggtttctagagaacactgtgtcggaatatcaatgtagagagtcagcgaaggtcatctagcagcagatgaccagccccaggccagtgaggatcacccagagtgcccgtggctgcacgacagtagtagcaggtggaagctggagcccacacctggtttgcccagcagccagttgtttttccgaggcaccgttggctgatgttttgcatacagatgattcagctgcataaaagatgtctgtcaggaaagggaagcccttggcattcagcacaggcactccctacggggtaatcgatagccgtctctgctgcttcccatgttgctcactggtaattttaagaaatgaacggcccaccttgaataagacaaggatggtgcaattatttgcgcaatggcttgaccatctagtagccaaaaatatgttaaggaatagaacagactgttcactttcaaattaaatctcttttccagtattagccaagacctctgcagcccgccctttctaaaatccatgtggcctcatccgctaaatatagagctgggttttgctgtggttagtactacatttcccaaatctctttattttggcaatgatgcctgtgactccaagtaccctttaccccaaacattatataaattttttagtaattaataccatcactccctaaatcaccttccccagggctttttggggattaaaactaaaattttataccctaaaagaaagaatttaagaaaatcatagttaagcaaagtgacaggattgttaatacgtcgggacctcaagtggggattaagtttcaacattaattttagaggagacacaaatctttctgtctcttcaaaccatagaagagacagaaagcacaacagttatttgaatagacagaagtgaatataagtgatagttgtagttaacaggaaataaagttgttaatatacttgtaaaaaaattaaatgttctgacttgaaagggactttaatattctcaccacttgtaggtaacttgctaagtaaccctaaaaaaacctttcaattcttttttttttttttttttttttgagacaagagtctcgctctgtcgcccaggctggtgtgcagtggcacgatctctgctcactgcaacctctgcctctcaggttccagccattctcctgcctcagcctcccaagtagctgggactacaggcgcacgccaccgcacctggctaatttttcatttttagtagagacagggtctcaccatgttgaccaggctggtctcaaactcctggcctcaggtgatccatccacctcggccttccaaagtgctgggattacaggtgtgagccaccgcgcctggcccgggattaagtttcaacattaattttgaaggggacacaaaccttcaaaccacagaagagagagaaagtgcatcagttatttaaacaaagggaactgaatataaacaatagttaacaggaagtaaatttaaaataataaaaagaaaatcccaagatatggagttacaaacataggacacagctaccacccctagagctcaaagatgaaagagaagctggaattattacagcttaaaggaagggcttgcagagctggaattcagatctctgaggaggtgtgttgaccagctggggctggggtcattgagcccagaggagagatcccatggggatgggactcagacctctgaggagggtccctacgggacttagacacacactatggatgaggggtggctgtggagctgggagtaagccctctaaagagggcactgggagactctcacccagatctctaaggagaaggcatactgaggctggttctgcaagtcttggaaaaacttaaactggattcagcttctgtgggaagaatgtgctgctgccttgttgaagaagcctagctggggtgatgctcacaggaagtggccctgtggtctccctctatcaacctatcagcttagtctaatagggaatattagatcagatcttctttatttgccaatgagaaatatgttttttagagtctcagccctggcatcagaagcagtgtctagaggtgggaagggagaatagagctgaaagacattatttaataactggtacaagaaacgacatgttatagctaaattccaattcccatgggactttcctataggtggaattgaaaagtctgtggaggcgtataatcgcagcgctttgggaggctgaggtaggaggattgcttgagcccaggagttcaagaccagcctggtcaaccccatctcttcaaaaaaatttaaaaattaacagggcatggtgatgcatgtctataggcctagttgggaggctgcaacaggaggatcacttgagcccatgagctcaaggttacagtaagctatgatcgtaccactatactccagcctgggcaacagagaaagaccctgtctttaaaaaagaaaaagtcactggaggactttagttttcagacagcttcagagaactaaaaaggcagtgaataattatgaggccaatatcagagagaaaggacatgagagaggtgagtggtttatggctgctttttcttgaaaggcatctgccaattccagatgaatgtttgagacactaggactctgagcagcacttttaacactctcattgccctaggacgacaaaatttggaggcttggtaccaccaaggaggtatcccactgtactgttttgggaccacaagttgtttgggactccattcaaatcatgtcagtccttgccagcagcaaatgtaaatcttccctgggaatgataacctcatccatggtctcaaattacttctacaattgttcatatgcagtgttcaacactgaatcaaaaataagtaggcatccaaggagaaaagacaaaatggttgcaaaaaacaagagcaagcctggacaacatagtgacaccctgtttctaaaaaactaataataataataattagctgagcatgcacctccagagtctgaggcaggaggatggcttgagcccaggaggtcaaggctgcagtgagccaagatcacactgctgcactctagcctcggtgatagaatgaggccctgtatctgaaacaaaaacaagaacagtaacagacaagtgagctctaggggatcaaaaaatggagttttcacaaagacttttaaataattatgcttaatatggttaagaggataaaagacaaggttaagaattttatcacaagcctgtaaattataaagaaccaaatggaaattctagaactgaaattgtgaaaattcaccagatagtgttagcatattacacacctctgaaaagagaaagctagtgatggtagagttaagtcagaagagtatatctaaattaaagcacagagataaaaggacagaaaataaagcatatgaataaattagatatagaggatacatgtagaggtctaacatacaggtaactgaagtcctagaagtatagagaaagagacagaagcaatatctaaagagataatggcttagggtttgaaaattaatgaaggatatcaatcttcagtttccagaaacattacagattttaattggaatgtgtaaattaaggcaaaatacacttaggcatatcataatgaaatagctcaaaactagggaaaaaaaacttaaaagaagccagagggaaaacaatggattactttctagggagagataattaagcttaactactgacttctcaaacaatgaagcagaataatcgtatcttcaaagtggtcaaataaaataatgaggttgaaactggaaaagttcccttgtcccccttgcagggcatgcgatgggggtgtagcgcgcttcttcagtgccccactgctcaaacctcgaggggagcgtatggacggacaggctgtagggctccaaccccacaacagtgtctaggagtgaatatttacagctcctgaagccccagtgggcgtgtgttacagggtgatcttttagttttgccgtctataggcgacttgtgttaaccagctcaattagtgcctctacttgtcgcatggacagagggctttctgtatcccgggttctcgccttggtgtaccagaagaatcagatcacatctgagcttggagaatgggtgcaaggttttattgagtggaagtagctcttagcagaagctgaaagggaagtcagaaggggatggagtgggaaggattttccctggaattgcactgctcaccagccctgggctctcctccaactgccccagccaaactccacgttgttcagcttcaccagcatgctggttcctgtcagtgccttcctctggatgtccagctacctgtgtgtcgctcccctcccctcaacgtccagccacctgtgtgtctgccagctagggtctctggggtttttataggcacaggatgggggcacggcaggccagggtggtcttgagaaatacaacatttgggcagaaaatgcctgtcctcacctaggtccgtggggggtggagccctagccaggggccacgccctcctctacccagcgcttcccttccccttttccatagcatttaaagggaccacatccttctctacccagcacttccatgtcaacattaggctgggcgtggtgactaacgcctataatcccagcactctgggaggccaaggtgggcagatcacttgaggtcaggagttcgagaccagcctggccaacatggcgaaaccccatctgtgctaaaaccccgtctctactaaaaatacaaaaattacctgggcatggtggcgcatgcctgtagccccagctactcaggaggctgaggcaggagaattgcttgaacccgggaggcggaggttgcagtgagctgagatggcactacttcactccagcctgggcaacacagagtgagactctgtctcaaaaaagaaaagggaagggaaaggaagggagaaaggaagggagggagggaagaagggaaaggaaaggaagaagagaagaagggaatggaagggaaaataaagaaaataatgacattggcagacaaacaagatctgagaaaatttgttaccaaaagatctaaactaaaggaaatactaatgggtttttatcaggtcaaaataaaatgttctcaagtggaagctcagagatatagaatggataaaattcaacaaaaagtatatattggtaaatctaaatgaaagttaactgcatgacacaaaaataataaagccttctgggattaaaaatatgtcagaatttaggccgggcgcggtggctcaggcctgtaatcccagcactttgggaggccgaggccggtggatcacgaggtcaggagatcgagaccatcctggctaacatggtgaaaccccgtctctactaaaaatacaaaaaattagccgggcgtggtggcaggcgcctgtagtcccagctactcgggaggctgaggcaggagaatggcgtgaaccccagaggcagagcttgcagtgagccaagatcgtgccactgcactttagtctgggcaacagagtgaaactctgtctcaaaaaaaaaaaaaaagtcagaatttaaatatataaaatctatagtaagtcagaactggggtaatccaggcatcatctgagaaaggggtataaaaaaggttagatttgtagttgattgaataattggtcccaagtcttaaggccttgtaagagttctattcctctgcactcttgccatggctttgtagtggattgagggtgcttcttcaccccttggttccaggtttcaccctgtgccttgcttcagctcattggatgttagaagtgtgatatgagcagaaatttaactgtcccacattgtttggattgcactcttgcacttctgttgtgtccgtgagtacaatttgtcccccctagccattgccttttgagcttggagctcaggatggcatgtataaagtagatctcagcccagtctgcatcttggatgcaagattagctaagattggccaaactccaactgaaccactgacctgtgagtgagaaaaaataagtaaatgagattataaactacagagatgttgaggttgtttgttatgtgaaaataagaaattcaaaatcaaagtggttggaactttaaattattttgaaccttaaagaaatgtggttatgaggcccaagtcatacaacaggcagctgtaacctaggcagctgtaacctttgttcctctaattatggattagctttttctttacctacattgttttataaaatgttgtaaaagactaaaggatgccagagaagaccctttctctcttaactgttgatcttcattatagattagcttccttctttcttctcttacacaatgacctcacaactatcacattgtctaaaataaaatgttaaatattctcttatactcctttaaattgggaaagaaaacaagctataactaataaagttgcagtaactcataaactacccttgtatgaaaaatgtaattctgttaaatttctttgtttgctgcctatataagtaagaccataacctttcagcttgggatcactgaccccattcctttggggtctgtatttccggatattcatcctcaactttgtgcttgcataaactcttaaactggattctgatgctttaaattatttcaggttgacatactagtgacccagatgggacctgaagttagcttctgccactgactcctgctgttttgctaacagataggtggtaccagtacagactgttgctggagtttatgggagccctaagtgagacccctcttgcattttgaatctccctggcttagatgagattcgtatattgttcaaatgacctgattccatactcaatggggctggaattaaagttctactttaaatctttaaggtaggagtttcatttcttatctctcgagagattctgttgtttgcaggtttacggtttcattcttttttaaggttaaggttttgtttgccttacttgctaaagtttgcaaccttttctctcatgcaaaatctggttaaaggaaaagcagtttccctttaataagatatgaatttctgtggcttaagcaaaattgtgaccttaaactagccaggttttgaagctcagttcaatttggcacatttaaattctttttttgagtgaccaaaaatttataaaagacctttattggctgggcacagtggctcactcctgtaatcttagcactttgggaggccgacgctggaggatcacttgagaccaggagttcgagaccagcatgggcaacatagtgagaccctgtctctgcaaaaaaataaaataaataaaaataaaaaaaaaataattaattaaaaaaaaatctttatgagaatgtgataagtcctgaaggcaacgtacactgttcatcctgaccaaaaggcaccttaggtgactgaggtcttgtaggagtgccagagattatcacttgtgatgagaaatggtcacacaggggatccccaaagaagaacatacagggaaatttgcttaaattcagtaaatatatataaggtactgatgtcccagtgccttaagctcccagaatttctgggtttcactgagacacataagaggaaagaactgatccaagggtaacacacgggggagctattcccataaataatacatttgatccaaaacatctttccctttcacttaagaggagaatacaaattataggcgatcagctatctaaaatagagtcctccttgtggagaggtccatctttagagactccagctggatacctgtacagtacttacggttttacttcttgtcattatttagaaaaattgtctcttgaagaactcacgaagaaccaaaattgcaatggccaaagtagggtactttgaaatgcctaaactaaattatttgtgtgctcaattagaaaaatccggttctggccgggcaccgtggctcacgcctgtaatcccagcactttgggaggccgaggcgggcggatcacctgaggtcaggagttcgggaccagcataaccaacatgcagaaaccccatctctactaaaaataaaaaaaaattagccgggtgcggtggcacatgcctttattcccagctactcaggaggctgaggcaggagaatcgcttgaacccaggaggcggagcttgcggtgagctgagattaggcgtcattgcactccagcctgggcaacaacagcgaaactccgtctcaaaaaaaagaaaataaaaaagaaaaagaaaaatcgggttctaggataaaatagaataattgggagatttatttttagaggtatttagaagcatccagaagaggttctgataaagttacttcactgcaggaggaaaataaaagattgcctaaaggctgggcacggtggctcacgcctgtaatcccagcactttgggaggccgaggcaggcggatcacaaggtcaggagatcaagaccatcctggctaacacggtgaaacccccatctctactaaaaaaatacaaaaaaaaaaaaaaaaaaattagctggacgtggtggcaggcgcctgtagtcccagctactcgggaggctgaggcaggagaatggcgtgaacatcggaggaggagcttgcagtgagccgagatcgcaccactgcactccagcctgggcgacagagcaagactccatctcaaaaaaaaaaaccaaacaaacaaaaggtagtcaactggcataaaatataaccatatatacaaaatccagagtcagttatgttatactttgaaagatgtaaaaagacttttagacaatattcaggcttatgtgaggtgagtgatgctaatcataaaaatgatactttcctgggctgggtgccgtggctcacacctgtaatgccagcactttgggaggccgaggtgggtggatcacctgaggtcaggagttcgagaccagcctgaccaatatggtaaaacctcgtctctactaaaaatacaaaaattagccaggcgtggtggcatgcacctgtaatcccagctacttgggaggctgaggcagaagaatcacttgaacccaggaggtggaggttgcagtgagccaagttgcgccattgcctccaccctaggcgacagagggagactctatctcaaaaaaagaaaaagaaaagatactttcctcaactccaactttatgaatgttctagataaagaattcactctaatagtaaagagacagtgccttagttgggccacttctcaaacccatgatttgattaatcttgctgacgggtcgttgtgtactttaaagaagaaaaagataaagaggccataccaaagaataaagtgagtaaagttatgaatttgcaactaaaacaagtatccaccaagtgtagacagtcaaaataccccaataaacctttgaacaggtctaatccttcaatctgtaataactacaataaaactggccactttccaaaaaagattactgaaaactaaaacagaaggaatgacaacagatgaaggaggaaaatacggaatagaggtgctccaagaaatttaaagggagctttccttttctgcttactaatattctgggaaaaatagaatttatttatttatttatttatttgagaggagtcttcgctctgtctcccagggagtgcagtggtgtaatctcgggctactgcaacctccacttcctgggttcaagcaattctactgactcagcctcctgagtagctgggattacaagcatgtgccaccatgtccagctaatttttgtatttttcgtagaggtgggttttcaccatgttggtcaggctgatctcaaactcatggcctcatgatcggtttgccttagcctctcaaagtgctgtgattacaggtgtgagccaccatgcccggcctcaatagaaattattttaagtaaagaacaataccaagtccttgttgatactgagcaacattatctgtaataaatctaaccttatcacaaagtcggggtaaacatttctgagggtaaacactcggtctaaatggtaggtgtcacaaatacttccatatcagcacacaagtctcaccctgcaacttctcaactaggtatcttacaagggaatcatgttttccttttggttccatcagcccccatccatctgataggaagagacttcttaaaactatataatgcctatatttctttctcccagaagtgggaaatatatttagaattagatggtatggatgacacaacagaattaacagacacaagcaaaaaatttttaaaaatttaatccagttactatccatctcaccattgaggacactgaattattaagcaatgaagaattagaaaacctactaaaggtagtacttgattgattgtggtcaaagtccttcactgatacagaaactattgtttcagctacttcaataacatctcataatattcatcaaaaccccttccaaatatcagatactatcccacgataaccttaggaggggtaaaacctatgatttcagattatataaaaagaggactgatcaggctgggcacggtggctcacacctgtaatcccagcactttgggaggctgaggcaggcagttagtctgaggtcaggagtttgagaccagcctggccaatgtggcaaaaccccatctctactaaaaatacaaaaaaaaaaaaaattagccaggtgtggtggcatacacctgtagtcccagctacttgggaggctaaggcaggagaatcacttgaacccgggatgcagagattgcagtgagccaagattgcgccactgcactccagcctagtgacagagtgagactccacctaaaaaaaaaagaaaaaagaaagaaaaagaaagaaagaaaaaaaaggactgatcattctctatacaagccctcataatacaccaattccccgttaagaaaaccaaatggtagaggatggagacttgtacagaatttgatagcaataaacgacataattccacagcatccggtagtgcctaatcctcacacattgctcatatctattccattgaatgcagaatttattattttgtgtgtgcgtgtatcggagtctcgctttgttgccaggctggagtgcagtggtgtgatctcggctcactgcaacctctgcttcttgggttcaagtgattctcctgcctcagcctcctgagtagctgggactacagacatgcgccatcatgcccagctaatttttgtatttttagtagggatggtttcagcatgttggccaggatggtcttgatctcttgacctcgtgatctgcctgccttggcctcctaaattgctgggattacaggtgtgagccaccatgaatgcagaactttttacagtcatagatttatgcagtgcattctttagcattcctatagataaaactggccaatttctctttgcctttacttgggaagacagacaatatacttggacattcatgctccaggatacactgaaagcctcacttacttttcacaaacattaataaaagacctctcagatgataacttcattgagaagcctgtctatttttttttttgagacagtcttgctctgttgcccaggctggattgcagtgtcacaatcatagctcactgtagccttgaactcccaggctcaagtgatcctcccacctcagcctccagagtacctgggactacacaatacaagccaccatgcctggctaatttctggttgtcctttttttttttttttttttttttttgtagagacagggtttgccttgttgcccagactggtctcaagaaaactcctgggttcaagtaatctgcctgccttggcctcccaaaattctgggattataggcataggattataagcataccacagctttttttttttttttttttttttggagacagggtctcactctgtcgcctagactggagtgcagtggcgctattacgtatcactgtagcttcggcctcctgggctcaagtgatcctcccactcaggctcccaagtagctggggccagaggcatgcacccccatgcacggctactttttttaactttttgtagagatgcgctcttactatgttgcccaggctggtctcaaactcctgactgatcctgagtcatcctcccgccttggcctcccaaagtcaaagtgttggacttacaggcatgagccaccatgcctggctgagaagcctgtctgaatacaatacatagatgatttacgtctttgcttagataacaaataggcttccacagtagatggaatacacctgttacaattggccctaatggatcataaagtgtctaaagaaaaacttcaattttgtaaaaacaaaacaaaaaaaccaaaacaactacttaggccacctaatatccaaggaatgactttctattaatcccgatagattgaatgcaattgtagctgttctgacactgagaaccaagaaacagttaatgttttagggactagcagaattttgtagaaattatactctaaacttttctttaaaagctctgcccttacatgctctcttaagataagacatgccagactctctagattggacagaagaaattcaactaatattagaaatgatcaaaaataggttgggcgtggttgttcactcctgtaatcccagcactttgggaggccgaggtgggcagattgcttgaggtcaggagtttgagaccagtctggccaatgtgatgaaaccctgtctctactaaaaagtacaaaaattagtggggtgtggtggcacactcctgtagtcccaactacttaggaggctgaggcacaagaatcacttgaacctcaaagatggaggttgtagtgagccaagatcataccactgtactccagcctgggcaacacagtgagactctgtctcaaaaaaaaaaaaaaaaaaagaaaagaaaagaaaggagaaatgatcaaaaatgaccttgctaacactccagctttggggcatccaaattataacatttcattatttgtgtatgaaagtggtggaaacaacactttaggggtcctaacccaaaaaaagagttcaaaatagacctatagggtattagagccaacaattagacactgtagcaaaaggactcccaccttgtatgagagccataacagccaccatttgttcattagggcaactgaagaaattgtcatgggaacaccccttactatcttcatcccttattctgtggaggtattgctatactcacgccatacttaacattattcagttagtagactggcttcatatgagatgttgcttattttagcttctcatatcatcatctctagtgtaacgatgtaagccctgcattcttttgccttcatttttacatgaaatgccacacaactgcatagctctaagtgatcaacatttttcttctaggtcagacctccaagagactccctttatgaatactgatgctatttggttcacagatggatgttacttgaaggatgaatcttgaatctaccaagcaggttgcactataatgtctttaagtgaggaaatagaaagtgcctattttctgaaagccatctcagctcaataaaaggaattaatagcattgaataggcctgtcaattggcaaaaagaatatgtgctaatatttatacagacagtagacatacttttggagtagcccatgatttggaaatgttatagaagcaaagagtgttcgtaacctcttaaggccaatccataaaaaacaaacttcttatttcatgactactagaaaaaatccctggccattattaaaattttgggtcattccaaatcagatactccagaaagcagaggatatcagctagctgataagtagcaaatagagctgctctaaacacatctaaacaagagaaccaacctgtgttaacttttaaggaaggacctgaatttgacataaaattagctcaattcagagccctaaaatcagaacaaaaagattgggaaacaaaagggggggaatagattccccaaaagatgaggtatggtatgggccaaacaagttgcccgtactttctgctgaattttagttgttattattattttttttgagacagagtttcactcttcttgcccaggctggagtgcagtgatgtgatctcggctcactacgacctcttcctcctgggcttcagcaattctcattcctcagcctcccagtgaatggagttttgctcttgttgcccaggctggagtgcagtggcgcagtcttggctcactgcaacctccacctctcaggtcaagcaattctcctgcctcagccaccacacctggctaatttttctgtatttttagcagagacagggttttcatcatgttggccaggctgatctcgaactcctgacctcaggtgatccacccgccttggtctcccaaagtgctgggattacaagcatgagccactgcgccctgtcatttccacattttttaggtatttcttacaagcagcaccccactcctcacgttaatctcatctagaaatgcccttacatacacagccagaataacgtttaatcaaatatctgggcactgtgtgacccagtcaagcaagttgacacataaccatcataaatatcaaagtatttgtggaaatattttaaaaactgctacaacatgtatattggcctggtgtggtggctcacacctgtaattccagcactttgggaggccaaggcaggcggatcacctgaggtcagaagttcaagacgagcatagccaacagggtgaaaccctgtcttgactaaaaatacaagaagaagattagccagccatggtagtgcacgcctgtagtcccagctactcagaaggttgaggcacaagaatcgcttgaacctggaaggcggatgttgcagtgagctgagatcgcaccactgcactccatcctgggcaacagagtgagactctctctcaaaaaaacccaacactgctacaacatgtgtataggtttccttgtgatatatttatatttacaaaatacatacttacaaatatatacatctgtatttactaaaacgtgattttttaaagacagaatctcactcacattgcccaggccggagtgtagttgcatgatcatggctaactgcagcctcaacttcccaggttcaggtgatcatctcacctcggcctcccaagtagcagagacaataagcatgcaccactacacctgactaattttttaattttttgtagagacagggttttgccatgttgcccaggctggtttcgagctcctgggctcaagccatctacctgccacagcctcccaatgcgctgtgattacagccatgagccaccacactcagcctcaaaagtattttaataagagagactagaaaatatcttcatggaacagttaaccataagaaatgacccaacgagccagacatggttgttcatgcctgtttattgatttggtatcctgctactttgctggattcacttcttagttgtaaccactgtgtatgcatgtgtgtgtgtgtgtgtatgtgcgtgtgtgtaatccttgatttaagattgtgtcatctgtgaacacagatcatcttttttcctttccaatttgcatgccttatatttctttttcttgtctaactgctgtggctagagattccttcctatgtagaatagaagtggcaagagtaggcatccttgtcttcttcctgattttagtggaaaagcttgccattattgtgttgaggcaattttcttctattactagtttgttgagtgttttatcataaaagactgttgaattttatcaaatgctttttctgcatcattgagataatcatgtagtttttcccattcattctgttaatgtcatgttttgggtgaagtaatctgtttacgcctgttaggtttaattggggtttattgtgttaagtcctctgtttctttagttaccgtctcatctgattgctctatacctatcattgaaatttggcagttgaaggccgggcgtggtggctcacgcctgtaatcctagcactttgggaggtgaaagcgggtggatcacgaggccagaagatcgagaccatcctagctaacatggtgaaaccccatctctactaaaaatacaaaaaattagccaggcatggtggtgtgtgcctgtagtcccagctactggggaggctgaggcaggagaatggcatgaacccgagaggcggagcttgaagtgagctgagatcgtgccactgcactccagcctgggcagcagagtgagactctgtctcaaaaaaaaaaaaaaaaaaaaagaaagttggcgattgaagtctctaacaattattgcagaactatctttttcccttcatttctgtccatttttgcttcatatatattgagggtttgctattaggtgtgtaaatctatatgattcttatatcttattgatatattgaaccgtttgttaatatataatattcttatcttttgtaatctttttaatttaaagtttattatatctgatattagcatagccagtccagctgtcctgtatttaatatttgtataggatatctttttcaatccttttacttttaacctatttgcatctttaatggaaagtgaacatctcttataggcagcctgtatttaaatcatgtgtttctagccaggcatgttggctcacgcctgtaatcccagcactttgggaggcctaggcgggtggatcacttgaggccaagagtttgagaccagcgtggccaacatggcaaaagcacattggtactaaaaatataaacattagctgggcgtggtgacacgcaccttcagtctgagctactcaggaggctgaggcatgagaatcgcttgaatctggaaggcagagtttgcagtgagtggaaatcatgccactgccagccagcctgggcaacagagctagactctgtctcaaaaaataaataaataaataaataaaataaaaatcatgtgtttcgattcttctgctaatctctcatttaactgggaattttaattcttggtattttgctatttgttttctatatgccctacagttgttgtttttttttttttttgtacctcatttccttcattactatcttctttgtttagtttattttaaatagtgaaccattttgattcccttctcatttcctttttttgcttttttgagacagagtctcactctgtagtccagtctggagtgcaatggcacaatcttggcttattgcaacctccacctcccaggttcaagtgattctcatgcctcagccccctgagtagctgggattacaggcgtgtgccaccacacccggctaatttatatattttttagtagagacagggtttcgccatgttggccaggctggtctcaaactcctggcctcaagtgatctgcctgccttggcctcccaaagtgctgggattgcaggcgtgagccactgtgctggcttctttttccccacctttttttggagacggagtcttgtactgtcgcccaggctggagtgcagtgatgtgctcttggctcactgcaacttccacctccagggttcaagcgattctcctgcctcagcctcctgagtagctgggactacaggtgcccaccgccatgcctggctaattttttgtattttagtagagaccaggttttgctgtgttgtccaggctggtcttgaacgcctgagctcaggcaatccacctgcctcggcctaccaaagtgctgggattacaggcgtgagccacgacgcccaggcttttttttgttttttttttgagacagtttctgtcacccaggctggagtgcaatggcatgatcatggctcactgcagcctcagtcttcctcagtctccttgaggtgatcctcctacctcagcctcctgagtagctaggactatagacatgcaccactacacctgattaatttttgtacttcttgtagaaacagggtttcacgttgttgcccaggctgttctcagactcctgggctcaaggaatctgcctgtttcagtctcccaaagtgttgagattacaggcatgaacgactgtgtctggccttcatttccttttgtctacaatttatagattttttgagataaccatgggaatttattttaacatcctaaatttgaatacaattttaacttcaatactgtataaaactctgcttctgacagggcgtggtggctcacgcctgtaatcccagcactttgggaggccgaggcgggtggatcctgaggtcaagagattgagaccatcctggccaacatggtgaaaccctgtctctactaaaacatacaaaaatttgctgggcatggtgacacacgcctgtagtcccagctactcgggagactgaggcaggagaacagcttgaacccgggagacggaggttgcagtgagcggagattgtgccactgcactccagcctgggagacagggcaagactccgtctcaaaaagcaaaaaacaaaaaacaaaacaaaacaaaaaaactctgcttctatacagctcattcctcctactttcttttattgatgttacaaattacatctttatatattgtgtgctcagtaacattgactaataattgtatttatgcatttgtctcagaaatcatgtagaaaataaaaagtggagttattaaccataattataataattacccatgtatttacctttaccacagatatttatttctttttactttttatttatttatttatttatttatttttgagacaggttctcgctctgtcacccaggccagagtacagtggcaccatcatagctcactgcagcctcaacctcccaggttcaagtgatccgatcctcccacctcagcctcttgagtagctgggactacaggtgcatgggaaccacacccagctcattttttttgtatattttgtagagacaaggttttgccatggtgctcaggctggtctcaatctcctgagctcaagcagtccactcacctaggccactcaaagtgctgggattacaggcatgagccaccatgtcttccctgtttatttctttatacagctttgagttgctgtgtagtattccttcatttctgtatggacttcctctgtcatttcttgcaggacagctctggtgttaataaattcactcagattttagttatctgggaatatctcaatttctggatcacttgaggtcaggagttcaaaaccagcctggtcaacatgataaaaccccgtttctactaaaaatactaaagttagctgggtgtggtggcatgcaactgtagtcccagctacttgggaggctgaggcaggagaactgtttgaactggaaggcagaggttgcagtgaaccgagatcacgccactaaactccagcctgggtgacagagtgagactctgtctcaaaaaaaaaaaaaaaaaaaaaaggccgggcacagtggcttcatgcctgtaatcccagcactttgggaggctgagagagctgatcacgaggtcaggagatccagaccatcctggctaacgtgccgggtgtggtggcgggcacatgtagtcccagctactcgggaggctgaggcaggagaatggcgtgaaccgggaaggcggagcttgcagtgagctgagatggtgtcactgcactccagcctggatgacacagcgagactcctctgtctcaaaaaaaaaaaaaaagttaaccttcttacttagcaattctgtttcaaagcaagctgaaagatggaaataaatatcagaacataaatcaatgaaaatagaggccgagtgcagtggctcatgactgtaatccctgcactttggggggctgaggtggatggatcacttgaggtcaggagttcgagaacagcctggccaacatggtcaaagcctgtttctactaaaaatacaaaaattagccggccatggtggtgtgtgcctgtagtcccagctacttgggaggctgaggcaggagaatgacttgaacccgggaggcagaggttgcagtgagcagagatcatgccactgtactccagcctggaggacagagtgagactccatctcaaaaaaaaaaaaaaaaaaaaaagaaagaaaattgaaagcagaaaagatttagaaaattaaactaaaagctagttctaaaagatcaataaaatcgacaagcttctagcatgactgacaaagggaaaaagagtgaagaaaaaattaataggagttatcagtacagagcgtgcagacatcaaaaagataaggaaatactacaaacacctgtacaaacataatttgacaagtgagatgaaatggacaaattcctcaaggcaaagcaagacaaaacaaactcccactacccatctataatgaaatagataatccaattaatcatataactattaaagacattgaatttgtagttaaataatttttgaaatagaaatccacatccccagatggtttcactggataattctatcaaatgcttagataattaacaccaattctatataatctcttccagaaaacggaaagcaaatcacttccaaatttattttaaagttaagaaaaaatagtacatgctgggcctggtggctcacacctgtaatcccagcagtttgggaggctgacgtgggcagatcacttgagctgaggaatttgagaccagtgtgggcaacatggtgaaacaatgtctgtacaaaaaacaaaaattatccaggcatggtggcatgcacctgtagtcccagctacttgggaggttaatgtgggaagattgcttagacctgggagacagaggtttcagtgagctgagatcacaccactgctctccagactgggtgacagagtgagactctgtcttaaaaaaaaaaaaaaaaaagaagaagaaaaaggaaaaggaaaacaatacaaagaaagaaaactatagaccaacatgagtcatgaatatatgtgcaaaaattcttaacaagatatcataaatggaattcagcgatatataaaaataattatacaccattaccaagtggagtttatcccagaaatgtaaggctggttcaatgttcaaataccaatcaatgtgatccaccatattaacaagctaagtaagaaaaatcacatgagattatcaattgaattctgcagaaaaggcatttgacaaagtccaacacccattcatgataaaaaccaccagaaaacttagagaggaatttcttcaactgaataaaaaatatttaaagaaaaatcatgtggctatcatattcaataaagactgaatgctttttctctaagatcaacaacaaggcactcattactactattcaacaaaacactgcaagttctagacagagtctcactctgtcacccagtctggagagcagtggtgtgatctcagctcaccgaagcctctgtctcccaggtctaagcaatcttcccacattaacctcccaagtagctgggactacaggtgcatgccaccatgcctggataatttttgttttttgtacagacattgtttcaccatgttgcccacgctggtctcaaattcctcagctcaagtgatctgcccacgtcagcctcccaaactgctgggattacaggtgtgagccaccaggcccagcatgtactattttttcttaactttaaaataaatttggaagtgatttgctttctgttttctggaagagattatatagaattggtgttaattatctaagcatttgatagaattatccagtgaaaccatctggggatacagatttctatttcaataaggaaaaagaaatcaaaggtacaatagccaagatttggaatcaacctgtgtatcagcagacaaatggataaagaaaatgtgttatatatacatgatgaagtacttttcagccatgaaaaagaatgagatccagtcacttgcaacaacatagatgaaattggagaacattacgttaaatgaaatagggcaggcatagaaagacaaacttcaaatgctctcactcatttgcaggagctaaaactttaaataattgaactcatggagaatagaatggtggttaccagaggctgggaagagtagtagcattggggttggggggagtgggaatggttaatgggtacaaatttagttagaatgaataagatctagtatttgataatgcaacagggtaactacaatcaataatagtttattgtacatttaaaaataactaaaagaggccaggcgcggtggctcacgcctgtaatcccagcactttgggaggccaaggtgggcggatcacaaggtcaggagattgagaccatcttggctgacagggtgaaaccccatctctactaaagatgcaaaaaaaattagctgggcatggtggtgggtgcctgtagtcccagctacttgggaggctgaggcaggagaatggcatgaacctgggaggtggagcttgcagtgagccaagattgtgccactgcactccagcctgggtgacagagcgagacttcatctcaaaagaattaaaaaaaaaaagagtataactgaaatatttgtaacacatagaaatgataaatgcttgaggtgatgatggatatcccatttactctgatgtgattattacacattgaatgcctgtatcaacataaatatatggaccccataaatatatacaccttctatgtcctcataaaaattaaaaataattaagtttaaaaaagagtctaggcacggtggctcatgcctgtaatcccagcaccttgggaggctgaggctggcggatcacaaggtcaggagttcaagaccagcctggccaacatggcaaaatcctgtctatactaaacataccaaaattagctgggcatggtggcaggtgcctgtaatcccagctacttgggaggctgaggcaggagaatcgcttgaacctgggaggcggaagttgcagtgagctgagattatgccattgcactccagcctgggcaacaagagcaagactctgtctcaaaaaaaataataataataataattaaaaggcatactaatcagaaaagaagaaaaatttgtccctattttgagatgacgtgatttaactatatggaaagcccaaaggaataaaacaacaaaaacaaacaaaaaactcctaaaaaactaataagtgaatttagcaaggttgcaggatatatcaacatatcaaaattaattgtatttctatatactagcaaggaacacgtgggcactgaaattaaaatataatactatttataattgctccacaaaaatactttggtgtgaatctgccaatacaggtgcggaacttacatgatgaaaactagacaatgctgatgaaagaaatcaaacaagatctaaataaatggaaaggcatagcatgttcatggactagaagactcaattgtaaggacacccgttttccccaaatggtacacagttttaacacaattactatcaaaatccaagcaactttgttgttgttgttgtagatgcagacaaacttatactaaaatttgtttggaaacatacaagccctagaatagctaaaaagttttgaaacagttctgaggtgggaattaaagaaagaaagaaaaataaaattaaaaagagaaaaatatgttcaaaaaaacaagctttctgtattaggctggctcatcccaaagtcagtaacaggcaaagcccagacccaggcaaagtctcgataacattatctaagaagccagggctcaaaggaatgtgctctggagactctcccagcactccctccacataaggagaagaaaaacaaattttccttattttcctttcccctatggtatgagtacatttatgactttatagattcccgttttcttttcttttgttttctttttctttttttttgagatgaagtctcgctctgtcacccaggctggagtgcagtggtgcaatctcagctcactgcaagctccgcctcctgagttcacgccattctcctgcctcagcctcctgactagctgggactataggcgcccgccaccatgcctggctaattttttgtatttttagtagagacggggtttcaccttgttagccaggatggtctcgatctcgtgaccttgtgatccacctgcctcagcctcccaaggtgctgggattacaggcgtgagccactgcgcctggccagattcctgttttctgtaactagtaacctcaagtattctgttttttatccgagcagcacagcaaaggtcatgagacatgcctgagcaggcataatctaactgtcatagtttgattaactgcctttgttctgcttctatacacttgctttcacaccactacacttcgcatcactgtaaccttgtttcaaactagccaaccccttttcagaagtgtgtataaaagtcaagttctgtctttgttctaggcccggtctttggatgttaatccactaggccagagtgcactcaataacatccccctgttctacctattggtctctccagtctcctgattcccacaacagttccactggatctttcactgtctttgtagttttaccttttatagaatgtcacttaggtggggcgtggtggctcatgcctgtaattacagcattttgggaggctgaggcgggtggatcatttgaggtcaggagttcgagaccatcctggccaacacggtgaaaccccgtctctactaaaaatacaaaaattagccaggtgtggtggtatgcatctgtaatcccagctattcaggaggctgaggcaggagaattgcttgagcctgggaggtggaggttgcgataagcagagatcatgccactgcactccagtctgggtgacagagtgagaccctgtctcaaaaaaaaaaaacaaaaaacaacaaattgtcacttagttggaatcatacagtatgtagccttttcaaattggcttctttcacttagcaatatccatctaaggtcttccatgtcttttcatggcttggtagctcatttcttttcttttcttttttatttttctttgagatggagtctcggtctgtcgcccaggctggagtgtagtggcacgatctcagctcactgcaacctcaacctcctgggttcaggcaattctcttacctcagcctcgcaagtagctgggattacaggcacgcaccaccacacccagctgatttttgtatttttagtagagaaggggtttcaccatgttggccaggctggtcttgaattcctgacctcaggtgatctgcctgtcttgacctcccacagtgctgggattacaggcatgagccaccgtgcccggcctgagccactgcccccagccggctcatttcttatcattgaataatattccaatgtatgaatgtgtcagtttgttcattcaccaattgaggggatatcttgatttcttccagtttttgcagttttgaataaagctgctataaacattcatgtgtaggtttttatgtgtatataagttttcaactaattttggtatatacctaggagtgaaattgctgggccatatggttaggctatgtttagcttggaaggcactactagatcatcttccaaagtggctgtattctcaagagcaatgaatgagaattcctgtttttctatgtccacatccttgtcagcatttgatactgtcaggtttttggattttagcctatctaataggtgtatagtggtttctcattgttgtttttgttatttatttatttatgtatttattttagagatgggttcttactctcttgcccaggctggagtacagtggtatgatcatggctcactgcagcctcaaactgctgggttcaagaggtcctcctgtttctgcctcctaagtagctggactacaggcatatgccaccatgcccagctaattctcattgtgttctgaatttgtaattccctaatgacatatgatgtagagcgtcttttcatatggttatagccatatgtatatcttctttggtgagctccgttcagatattttgtccatttttaaactggaatgcttattttcttatttttgcattttgggagttattcgtatatattggatacaaatcctttatcagaaaagttatttgcaaatattttctccaagtctgtgggttttcattctcttagcaatgatgttctcagagcagcagttaaaaatttctgtctagattcttttttttatgtttgcatgtgtaaaatgcaaaacttcctgagtagaagggactacaggtgcatttattagagcagtatttattgaaaagactaatatttttctattgaattgcctttgttccttcatcaaagatcagttgatttcatttgtttgggtttatttatgggttctctactccgttcctttaccaatgtcacactgtcttgattactgtagcttcatagtaagtctcaaagttgagtagtgtgagtactctggccctgcttgtcttcaatattgagtgggctattctgcatcttttgactttccatacaaactttagaatttgcttgtcaatatctgcaaaataacttgctggaatcgttattggaattaaattgaatctataattggtaagcgctaacacattaatgttgagtcttcctacccatgaacatggaacttatctccatttattaatttagattttttatttatttcatcagagttttgtagtttccctcatataaagcttgtatgtattttgttagatttatacctaagtattttgattatttggtgtttatgtaagaggtattaaattttcaatttcaaattccaattgttcagtgttggttaaagaaaagcaatcaacttttgtatgttaaccttatatcctgcaatgtaactataataacttactagttctcagagttttttgttgattctttgggattttgtacatagatagtcatgttatctgcaattttttatactttatttccttcttcctaatttttatacttttatttccttcttttgtcttattgtattagctaagacttctagtacaatattgaataggagtggtgacaagagacatccttgccttttccctgatattaggggaaaagcatataatttttcaccattaagtagtgtatgatgttagccatacatacatacatagtggaattattgtagatgttcttcatcaattgagaaagttcccttctattcctagtttgctgagagtttttatcatgaataggtgttagatttgtcaaatgcttcttctaaatgtattgatataatcatgattttcttttttaacttaattgatgtgattgattacaataacttatattcaaccattaaacaagtatgcatatctggaatacatcccatttggtcatgttgtatttttttcatacaatgttggatttgatttgctaatatttttatcatggataaaaggggcattactatcgggtaaaattcagcccccgatatttcacctgggtccttttctattttccctaagtgttggctggtctgagaaataaagggaaagagtacaaaagagaaattttaaagctgggtgtctgggggagacatcacatgtcggcaggttctgtgatgccccccaagccgcaaaaccagcaagtttttattagtgattttcaaaggggagggagtgtatgaatagggtgtgggtcacagagatcacgtgcttcacaaggtaataaaatatcacaaggcaaatggaggcagggtgagatcacaggaccaatgcgaaattaaaattgctaatgaagttttgggcatgcattgtcattgataacatttatcaggagacagggtttgagaaaagacaactggtctgaccaaaatttattaggcgggaatttcctcatcctaataagcctgggagcgctacgggagaccggggcttatttcatcccttatctatgcccataaaagacagacgtccccaaagcggccatttcagaggcctccccttagggatacattctctttctcagggatgctccttgctgggaaaaagaattcagtgatatttctcctatttgcttttgaaagaagagaaatatggctcagttccacccggcccacaggcagccagactttaagcttatctcccttgttccctgaacattgctgttatcctgttcttttttcaaggtgcccagatttcacattgtttaaacaatttgtgcagaaaacgcaatcatcacagggtcctgaggcgacattcatcctcagcttacaaagatgatgggattaagagattaaagtaaagacaggcataggaaatcacaagggtattgactggggaagtgataagtgtccatgaaatcttcataatttatgttcagagactgcagtaaagacaggtgtaagaaattacaaaagtattaatttggggaaccaataaatgtccatgaaatcttcacaatttatgttcttctgccatggctttagccggtccctccgttcagggtccctgacttcccgcaacacattacatcacagtggaaagtgagatagtaaaggaatattatgaagtactctatgctcaaagggggcatgatccctatgacaaagggatccattcttcgagaagacataacaggctgggcatggtggctcatacctgtaatcccaacatttggggaggccaaggcaggaggatcatttcagctcaggggttcgagaccagcctaggcagtgtagtgagatcccatctacaaaaaaaaatttaaattggcctggcatggttgtgcctgcctgtagtcccagtacttacgaggctgagctgggaggatcacttgagcttggagggtaaggctgcagtgagctgtggtcacaccactgcactccagcctgggtgacagagtaagactgtctcaaaaaaaggggaaaagacatgaaaattactatatttcactgaagatttatgaattgcaaataagcacatgaaaagatgttgaacatcattaggtattacggaaatgcaaactaaagttacacctgtcaacatggctaaaattaatagtgacaacaaatgctggtgagcatgtggaaaaacttgatcactcatccattgttggaatgtaaaatggtacagctttgtggaaaatactttgtcatcttgaaaaaaactgcacttgcagctaccataagacccagtagttgccctcttgggaattgcttccacaaaatcaaatgcttatgttcacacaaaaaatttaatatcagggcttaactgtaatcaccaaaaattgaaactagccctgatgtcctgagcagatgaatggttaaatcaacagtgcagcaaaaccatgaaatactcattagcaataaataaaaactaatgaagtaataatatacacaacaacttaaattaactccagataattattctgagtgaaaaaaaaatccagtaggttaggtaagcatgacattgacataacattgttgaaatcaggaaattacagaaatggaaaacagattggtggttagcatgggttaagaaagtggaatggtgaaagggaagtggtgtggccatacgtgagcaacacaaccccacttaggtagaatacacatcttctcaagtagacaaggaacattctccagggtacagcatatgctaggttgtaaatcaaaccttagtaaatgtaaaggatagaaataatacaaagtatttttaaaaacacaacggaatactattagatcaataacagaaagaaagtcgagaagttgggaaacccacaaaggtgtggaaatttaacagcacactctaaatgaccaatgggtcaaagaagaaatcaagagggaaattagaaaatactttgtgggccgggtgcagtggctcacgtctgtaatcccagcactttgggaggccgaggcgggtggatcacgaggtcaggagatcgagaccatcctggctaacacggtgaaactccatctctactaaaaatacaaaaaattagccgggcatggtggcgggcacctgtagtaccagctactcaggaggctgaggcaggagaatggcgtgaacccaggaggcagagcttgcagtgagccaagattgcaccactgcactccagcctgggtgacagagtgagactccatctcaaaagaaattttataaaaaaactttttaattaaaaattaaagaaatactattatatatagagaatgagggtttaaaaaaaaaagaagaaatactataaacaattgtagcttagatgaaatgaacaaggccgggtgtggtggctcacgcctataatcctagcactttgggaggccgaggcagatggattacctgaggtcaggagttcgagaccagcctggccaacatgatgaaactccgtgtctactaaaaaaaaaaaacaaaaaattagccagtcgtggtggcaggcgcctgtaatcctagctacttgagaggctgaggcaggagaatcacttgaacctgggaggcagaggttgtagtgagccaagatcacaccactgtactccagcctaggcaagaagaatgaaactctgtttaaaaagaaagaaagaaagaaagacagacagacagacggaaagaaatgaatgaacaaatttctagacagacacaagcttccataactgactcagaagaaacagacaatccaaatatgcctataataacaaataatgagattgctttagtaataaaaaaaaactacccaaaaaaactgcgggcccaaatggctttactattgaattccaccaaatattttttttaaataccaattcttcacaaactcctcaaagaaaaatagaaaaggagggaatacttcccaactcattcacggattctataaggcaacatcaccctgacaccaaaaccaaagacctaacaagaaaagaactctttagacaatatattttataaatgtggacccacgaaaaccctgaaaaatacaatgacatgtaaaagtattgtataccatagccaagtgggatttatctcaggaaggaacagatggttcagcataaaaagtcaattaggctgggtgcagtggtcacacctgtaaccccagccctttgggaggctgtggcaggaggatcacttgagcccaggagttcgagaccagcctgggcaacatggtgagacctcacctctacaaaaaaaatcacattagcttggcgtggtggcacaagcctgtagtctctgctgcttgagaggctgagcaggaggatcatttgagcccaggaggtcgaggcggcaactgagccatggttgcaccattgcactccagcccaggtgacagagcaagaccctgtctttaaaaaaaaaaatcagccagccacggtggctcatgcctgtattcccaacactttgggaggctgaggcgggtggatcacctgaggtcaggagtttgagaccagcctggtcaacatggtgaaaccccgtctctactaaaataaatacaaaattcagccgggcatggtggtgagtacctgtagttccagctacttgggaggctgagacaggagaattgcttgaacccaggaggcagaggatgcagtgagctgagatagcatcactgtactccagcctgagtgacagagcaagacaacatctcaaaaaaaaaatcaattaagtagaattagaagggaacttcttcaacctaataaaggacatctgtgaaaagcacacaattaaatataatacttaatggtgaaagactggatgctttcctcctgaaatcagtattaagacaaggatgcccactcttggcacttctattcaacattgtactaaagggtttggccacagcaattaggcaagaaaaaaaaaaggcatccaggtaggaaaagaagtaatactatctctattcacagatgacatgatcttatgtaaagaaaattctaaagagtccaaaaaaaactattagaactaataaatgagttcagcaagattgcaggatataagatcaatatacaaaaatcaatgtatttttatacacttgtaatgaaatggaagtgaaattttaaaaacacttccttagccaggtgtgatatgtggacttggtagtcccagctacttgggaggctgaggtaggaggattgctggagctcaggagttctagacgagcctggacaacatagcaagattccatcttttgaaaaaaccaaacagctccacttacaatagcatcaaaaagaataaaatacttgggaatgaattttacaaaagaactataaaacttatattctggaaacttcaaaacattgttggaagaaatgaaagaaaacctaactaaatggatagatgtttatgttcattgattggaagacctgatactgttaagatagcaatctcctcagattaatctatagatcatcacaacccctagaactgcagctgatttctttctagaaattgacaaattgaccctaaaatttataaggagactcaggggccccagaatagcaaaaacaaccttgaaaagaacaattacattggaggactcacacttccttatttcaaaactttctataaagcaacagtaatcaagacagtgtagcatagacatatttcaacacaatacaactgagagtccagaaacgacccaagtgtctctggtctcctgattttcaacaagggtgccaagaccattcaatggggtaaaaatagtctttcaacaaatgatgctgggacatctggatggacacacgcaaaataatgacattgaactcttcacataatatacaaaactttactcaaaatggatcagagtattcaatgtaaaagctaacattatgaaactcttaatagaaacataagggtgaatgtgtatgaacttggatgtggtagtggtttcttaaatatgagatcaacagtgtgagcaacaaaagaaaacatttgagatagggccttagtctgtcacccaggatggagtacagtggtgccatcacagttcactgcagactcaacttccggggctcaagtgatccccccagcttagcctccctagtagctgaaaccacaggtgtgtaccacgattctggctaattcttttattttttgtagagatggggtcccactatgttgtccaggctggtctcaaactcctgggctcaagtgatccacctgccacagcctcccaaagtgttgggattacaggcacgagccatggcacccagctgataaggaatattttttatgcagaatagataaaaactctcacaaactcaatgataaagacaatccaattgaaaagttggcaaaggatctgaaaaataagacacacaagtgactaatatgcacatgagaggttgagcaacatatcagtcactagggaaatacaaatcaaaaccactctgagatatcatgttatacccactaggatgcctttacttaaaacaacctgataggctgaatgtggtggctcacacctgtaatcccagcactttggttggccaaagcaggaggactgcttgagcccaggagttcaagatcagcctgggcaacagcgagacccccgtctccataaaaaagtataaatatacatacatacatacttggtaataggaaatgttggcaaagatgtggaaaaattggaaatctcatacactgctgatatgaatataaaatggagcagccacactggaaggcagaatggtagtttgttaaacagttagttatagagtgatcatacggctcagcaattccactcctaggtctatatattatatatccgagagaaatgaaaacacatttccacataaaaacttgtacgctgatgtttatagtaccattatgcataattgccaaaaggtggaaacaatccaaatgtccatcaacagatgaacaggtaagcaaaatgatgcatacaatggaatattatttggtcataaaaagaagtggaatagtgatacatgctacaacatggatgaaacttgaaaatattatgctaagtgaaagcagccagacaagagcaatattctgtgattcaatttatatgaaatgttctgaataagcaaatctatagagacggaaagcaggttgatggttgcctcagaatgatggggatcggggatagggcatgataaagtgtatggggtttcttactgaggtgatgaaaagattctaataatggctgtggttaaagtgtatggggtttcttactgaggtgatgaaaagattctaataatggctgtggtgatggctgcacatatgatgtgactacactgaaaatcattagattgtaaatcgcatgctgttaactatttcagtaaagccgtttttttttttttaagcaaaacatgagccatccttttctttttttttgagagtctcgctctgttgcccaggctggagtgcaatggcatggtctcggcgcactgcaacctctgcctcctgggttcaagtgattctcctgcctcagcctcccaagtagctgggattgcaggtgcgtgccgccatgcctggctaattttttgtatttttagtacagacagggtttcaccattttggccaggctggtctcgaactcctgacttcaagtaatccgccggtcttggcctcccaaagtgctgggattgcaggcgtgagccactgtgcctggccataatcttttcttttttgagatggaatcttgctctgtcacccaggctggagtccagtggcacaatctcagctcactgcaacctctgcttcccaggttcaagcgattctcctgcctcagccacctgagtagctaagactacaggcacctgccatcacacctggctaatttttttttttttttttttttttttgtagttttagtagaggcagggtttcaccatgttggccaggctggtctcgaactcctggcctcaagtgatccacctgccttggcctcctaaaagtgctgggattacaggcgtgagccattgcacctgtcctgagccatcctcctgaggaaaacgtactccatcttgagaaaaaccaacagacgtaggaatagagtacctaggttatagagcaagtatatgtttaattctatgaggaacgatcacactgtttatcaaagtaactattcttcctaccagcaatgcatgagagttccagttgctccacatcctcactaatacacattattgtctttttaaaaaatgtaagccattctaatagatatgtgttgttactgttatttcttttgctgtacagaagctttttagtttgtctaatttgtctacttttttgttgtatttgcttttgagtccttagtcataaattctttctttctttctttttatttttttattttttttgagacagagtctcactctttcgcccaggccggagtgcagtggcgctatcttggctcacttcaagctccgcctccctggttcacgccactctcctgcctcagcctcccgagtagctgggactacaggcacccaccactgcgccaggctaattttttgtatttttagtagggacggggtttcaccgtgttagccaggatggtctagatctcctgacctcatgatccgcccgcctcagcctcccaaagtgctgggattacaggcgtgagccaccgcgcccagctttttaaattttttttgagacagtctcgcactgtcacccaggctgaagtgcagtgacgcgatctcagctcactgcaacctgtctcctgggttcaagcgattctcatgcctcagcctcctgagtagctggaattacaggtgtgtaccaccatgactggctaattttttgtttttgaggcggagtttcactcttgttgcccaggctggaatgcagtggtgcaatcttggctcactgcaacctctgcctcccaggttcaagtgattctcctgcctcagcctcccaagtatctgggatgacagccatgtgccaccatgcctggctaattttgtattttagtagagaggaggttttactatgttggtcaggaaacagtgtgatcattttgggtcttgcttttattttttggtaggtggatctgaagcagtgctgccttagtctccttggactctcagctccatttcctcagctcaagtagtccactgggctctacctcagttctgcctcctcttgctgtggcctagaaattctctctggatatcagaaaacaaaggacagtaatccctgccaagatgggatacaaacaaggtgagccccatgattgcccaagcgtactacctggagtgtcttcttctgtttttttctttttcttttttttcttcaagatgggatcttcctgtgttgcccaggctggagtgcagtgccatgatcatggctaattgcagccttgaactcctggcctcaaatggtcctcccacctcagcctcccatgtagctaggtctccaagcgcatgctactgtgcccagcatggtatccagtgtcttgaaaccaccattgcatgtatttttgacgggctcctttggttgtttcaggtagaagggtcaacctggtccctgttactccatcttgtctgtaagttgaaggccttgatgttttctgcttatctcttcatcatctccaaacggtggtggtaaagtcactcacgactgctgtttccttcaagggaggaaacgtgcgaagactttgcccacacaatctcaatttgtcctcataacgttgcagatttttttttttttttttttttttgagacggagtcttgctctgttgccgaggctggagtgcagtggcgcgatcttggctcactgcaacctctgcctcccgggttcaagcaattctcctgcctcagcctcccgagtagctgggattacaggtgtgtgccaccacacccagctaatttttgtatttttagtagagacgggggtttcatcatgttggtcaggctggctcgaactcctgacctcgtgatctgcccaccttggcctcccagagtgctgggattataggtgtgagccactgtgcccgaccccagtgcagatttttttagtctcaatctctatttgacagctaaaaaactgaggcccagatgtttgctggtttggagcccagacaggcctgttggcatatattgcttcctggagctccacaaagctcgcaatgtcttgctgcatagttgctaagggagctgcctcacctgcacagcaagtctctggctcttcattccttaagagtcccacttgcagcctggctttttatgtgtacacacacacacactcacacaaactatcctggctttatttggcatgaacacatgcctgggtctcatccagccacttgacatccgagtgagacatggagtggaatggctgctaggccagagatcagtggtcagttaccccggcctctgactccaagtccaaggctccttctccaggctcagacccacacactgggtggtggtgacaaagatcaggacccaggagtgggtggtactcagccctcactgtgcttaaagattctgtgattctgtttcttctcctgtagatcaacgtctggatcactttctaataaaattccaactttgctgataattctccaatatacccaagactgtaaatactgatttcctttcatgaaattgtccaaacagctgcagcccttggtgcacagtatgatctggacctggggcacagcaagaccagaaccatgaaccaccatgaaccatgactcctcacttgtgagatgacgtgtgcaaggtgacctatggtgcttcatgaccacagaagtgaccactctacactgtgaaatgaatttctgcatggggggtatattagggttctctacagggacagaactaatagatatatatgaaagtttattaagtattaacttacacaatcacaaggtcccacaataggccatctgcaagctgaggagcaaggagagccagttcgagtcccaaaattgaagaacttgggagtccgatgtttgagggcaggaagcatccagcacgggagaaagatgtaggctgggaggctaagcaagtctcatctcttcacatttttctgcctgctttatattcgttggcagctgattagatggtgcccacctgattaagagtgggtctgccttccccagcctgactcaaatgttaatctcctttggcaacaccctcacagacacatccaggatcaatattgcatccttcaatccaatcaagttgacacgcagtattaaccatgacaggggggaatgagatgacacaaaggatcccttctggctctcatgttctgtcaccatctacttcaggagagagatgcactgtgtggggaggatgaaagttagaaggaaaaggcaagagaaatcaggagggtttggtattcaatgcgtgttcatttattttacacttacaaaagaaatcgcccacccctttgccccattcccccaaaacagtctctttttacaaacatttaaaaattaaaaccaaatgaagatagacaagttaatttcagtacaattatttttcagtgtagctgtcataattagagtttaaatttcctacaagtgaccaatgtccaagtgacttatagggaaatcctgattatcggccaaaggaaattcaatattacaagttagcaaattctagtacaaaaatagtccgtgtgttggaacagctttccttttacataggtcttaggtcagtctgctgtaatacctaacgcttccggattctctctcacaaatggctcaatcgtcactgctgaagcagcatggtgcctgcagcagcaggggctagtgtccaccttggggccgtgctggagacggcaggcctgggactgccttgctggccccagggcacctgggcagagctccagccctagctccgcatcgggggcttggagggagggatgagcttccccctcctgaggcaatgtcagacccaggacacagggcacatctgcccagggagctgggctggcgctggtgcaggacagcacatctcctgccagtgtctcctccccctacagcctggtcaggtgagaggcggtcctgcatgtcatcagcggcgagagtgtggccctgcccttgctgcagccagggcaggctggggcaggctacttgtccctcaggatgtcgagctgttcctgacactcggtgaagaggcgctggaatcggaggttctgcccgatgactggtagcagctccttcagcagctccctcttccgcagaccctgtggacacagagtgacagctgagtgcaagtgtcagtgaagagacctagattgtggggactttcctggcctggcagagaaccttgtgtctgctcacgggagaaggaaagaacaattcctctgcaggtgagaaactgtgagagagctgtggggcaaatgtgcaggatgaagtggcaggtggaatgggagcaacacagtgtggggataaaggaggatgaggccaatgcagggtctgctcctccatccgtgggcacagccactgctgaccttatagtgactgagcagttccctgaccatccagggcaggatgagagtagaacaaggctgagggtcaggtggctggccattcaggaggggctgttccctcatgctgatgtttgccaggggtttgaggtcaagccccagggcaaggatgcacctggggggcagtgactggctttagttttccagcaacacaaatgaggtgccagtatcccctgatgtggaggatgttcggatgctgaccaaactatgcttagttgcctaaacatcctccacgtcaggtcatattggcaccacagtctgaaacaagcattgccagttggggtctctgctgcacagaccaaaagagcagactcctgagcagtacggctgctccaaagggaaaactaccagccagacaactttaacactggacgagaaggtctaagatcttgaattaacggtgacagatatacctgcaacaagtctagaagtgacagtaaagaataagtgtaactattaggtttgagtaacacagaagttgttagagatgggataagcaggagaatggctgctgttggcgaccaagtttgatggaggagcagcccacactccaacagggaggctctgacaccagagtgccatagtcagaacagagatggtatggatttgcaaaggctgaaatgtttactatctggtcctttacagaaaagtttgtcaactcctaaaatagatcatgttttctaactaaaataattgagtaaaactcataggtcaaaggggaattctaattaagtgaaattaaaaatgacttgcaagagaatggtaaaaaaaaaaaaccaacacaaaatactccaaaagtggtaagattcagcaaaagtgggcactttagaggcatttagaaacaacagcttatactgtattagagaacatgaaagaatgacaagccaagactccaacctaaagccatcaggggaaaggaaaaaaaaaaagactaaagaaaaaaaggacatgagaaaaaaacattttttttaaaaaaaggagataataaaaattgaaataaataaaatagaaaacaaagatttaatagagaagatttagaaaaacaattttattttatatatttttttgagacagggtctagctctgttgcccaggctggagcgtagtggtgcaatcacagctcgctgcagcctcaacctcccaggctcaagtgatcctcctgcctcagttacccgagtagctgggactataggtgtgtgccaccatgtctggctaatttttatatatttagtagagcggggtttcaccttgttggccaggctgatctcaaactcctgagctcaagtgatcttcctgccttgttctcccaaagtgctgggattaaaggcgtgagccactatgcctggcaaaagtcatttcttgaaaagactaatggacaaacgtctggcaggattaatcaagaaagagagagaaagcttaaagaaataatattagaaataaaaagagacataactacagatatagaagaaagaaaaagatatgattactatcaactttatgctaagaaatttgaacatttagagaaaatggagaaattcctagaaaaatataatttatcaaaactagctcaaaaagaaatagaaaggaaaagttaattattaccataaagaaaacatcaggaatactattttaaaactgacatcaaggatgagattttctttgtctttcctttcccacagtttgactaatgtgtctcagtgcaggttcctttgggattttcctacttagagttcactgaggctcttgtattagtagacccccgtctttcctcaaatttggaaaatttccgccagtatttcttcaaataagctctctactcctttctctctcttacacttctagaactcccattatggattcatgggtatacttggatggtgtctggtaagtctcttagactctgtttgcttttcttcattctattttctttttgctcctcatacttgataatttcaaatgacctgttttcaagtttgctgatttacccttttgtctattcgagtctgctgttgaacccttctagtgaacttttcaattcagttattgtatttttaaactccagatttctgtttagctctttttttggaatttctatctccttgttgatactctcattttctttttttttttcttgagatggagcctcgatctgtcgcccaggctggagtgcagtggtgtgatctcggctcactgcaagctccgcctcctgggttcacaccattctcctgcctcagcctcccgagtagctgggactacaggcgccggccagcacgcctggctaatttttttgtatttttagtagagatggggttccaccatgttagcaaggatggtctcgatctcctgaccttgtgatccgcccgccttggcctcccaaagtgctgggattacaggcatgagccactgcacccggccctcattttcttcatatatagttttcctgattttgtttagttgtctgtattctccttgagcattttttaagacatttattttaaagtcttatgtctgatgggcacagtggctcatgcctgtaatctcagcactttgggaggccaaggcgggcagatcgcttgaggccaggagttcgagaccagtctggccaacatggcgaaaccccatctccactaaaaatacaaaaattaggccaggcgcggtggctcacgcctataatcccagcactttgggaggctgaggcggctggatcacttgaggtcaggagttcgagaccagtctggccaacatggcgaaaccccatctccactaaaaatactaaaattagccagtcctgacctcaggtgatccacctgccttggcctcccaaagtgctgggattaaggcatgaaccaacgcacccggcagtccttttacttttaagccattgtgttattacatgtaagctgggtttcttataagcagcatacagctggttgttattaattctaatctgataatctatgccttttagacctatatttaatgattattgatatattagggtttaaatctaccatcctatgtatgtttttctgccttcttttgaatgaatgtattattttctatcattcaattttatctatttgttagttttttagctacgattctttttactgctttgggatttgtatgtgtatgtgcatgagttttattttttggttttggtggttgctctagggcatataacatacagtatatgcctttacttatcatagtctgtcttcaagtattatatcactttgcataatgtgtaaaaatcttttaatggtatactttcatatccccactcctggcgtctgtgatactgctgtcatgccacttcacttctacatatgttataattacaaactacattttcattatttggcttaaaaaggcagaactttttgactttttttttttttgagacagggtcttgcgctctgttgcccaggctggagtgcagtggcgtgatcttggctcactgcaacctctgcctctcaggttcaagcaattcttgtgtcttcgcctcctgagtagctgggactacaggcatgtgccaccacacccggctaatttttgtatttctagtagagatggggtttcgccacgttggccaggctggtcttgaactcctggcctcaagtgatctgtccacctcggcctcccaaagtgctgggattacaggcgtgagccaccgcgccgaacgagaacttttttacattttgacatttagatgaacacttttgacatttaattcttaaccctttggaggtatatttttatgaactgaagatctgcttttacttagttacatataaataaccagtttcctaaactccatttattgaatagccccccctatttttcccactgtatctgttttgtcttctctctcatatagcaaagtatctaaattactccggcttcataataaacccaaatatctggtagcatagtgaatgtcttaactattcttggctttttactgctccatataaattgttgaattagcttgtcaagtttcattgaaacctctagtgggcatttgattagagaggcattgagtcagtaggtctgtttagaaacggttggcgtcttttactgtactgcactttctcatcgtttgtccaggttttctttaatgactttaagtaaacgtttataattcttagcatataggctatgtacatcctttgttagatttattcttagatactttataattctcaaaagagacaatcttgaaagtggcaaaaaaaaagtgactcatgagagggatttgaagtttgtgaagaactacacgcacaattgctggcttaaagatggaggaggcaggtggaaagctaacaaggaaatgaattctgctattccaataacgactgagcttggaagaggaccttgaaccctaggtgatctcatctggccagtaatttgagtagagaattcaggaaccactgcaaaagcacaccaggaagaccgaaagaaatcacagatcctttgaaagaagtggcaggctgctgcaaattccacaagacaggtgaaaaactctggtgctctctcaaaagtgccatctcctggctggaggccaattaactcaggacattacagcaattcataacagaacaaccctgctccaaggaaggagaaaaacaacagctaattccactgcctgcaacatcctttctaaccagtggtcctgagtgtgtccacatgatgacttcactggtagcataaccagcatttgagaaagcctgcacactaaacatatctacaaacaaggactctcacagagtctacgccattcccctggcaccaccaccacagcaggtgctggtatccacagctgggagatctgaagatggatcacatcaccgggttctttgcagacgttccccagcatgggcccagagcctggtagccccactgggtggctagacccagaagggcaataataatcaccgcagtctggctcataggaatctccatccctaggggaaggggaagtgcaccaaatcaagggatcaccctgtgggacaaaataatctcaacagcagcctctgagttccagatttttccactgaactagtctacccaaatgagaagtaatcagaaaagtaattctggcaataatgacaaaacaaggttctataatacctccaaaagaccacactagctcctcagcaatggatccaaaccaagaataattacaaagtacattttcattatttggcttaaaaaggcagaactttttggctttttctttttcttttttttttgagacagggtctcgctctgttgtccaggctggagtgcagtggcgtgatctctgaattgccaaagaattcagaaggctgattattaagctactcaaggagataccaaaggtgaaaatcaacttcaagaaattttaaaaaatatataggatatggatgaaaaatgctccagagaaatcggtatcataaagaaaaaatcaaaaaatcaaaaatcaaaacttctggaaataaaagacacacttagagaaatacaaaatgcactagaaagtttcaacaatagaatcaaagaagtagaagagagaacttcagaattcaaagacaagactttgaatcagacaaaaacaaagaaaaaataattttttaaaaaaatgaacaaagcctccaagaaatttgggattatgttaaatggccaaacctaagagtaagaataaatggtgttcctaagaagagaaatctaaaagtctgaaaaacgtatttgtggggatagttgaggaaagcttccctgaccttgctagagatctagacatccaaatacaagaagctcaaagaacacctgggaaatttatcacaaaaagatcatcacccaggtacacagtcatcaggttatctaaagtcaagacaaaggaaagaatcttaagagctgtaaggcaaaagcatcaggtaacctatacacgaaagcctatcggatttttttttttgagacagagtcttgctttgtcatccaggctggagtgcagtggtgcaatcttggctcactgcaatctctgccgccctggttcacgcaattctcctgcctcagcctcccaagtagctgggactacaggcccctgccaccaggcctggataatttttgtatttttattagaggtggggtttcaccgtgttggccaggctggtcttgaactcctgaccttaaatgatccacccaccttggcctccctaagtgttgggattacacgaatgagccactgcgcctggccagaatacctatcagattaacagcagatttctcagcagataccctacaagccagaagggtttgggttcctatttttagcttcctcaaacaaactaactgccagccaagaatttagtatccagcaaaattaagtgtcatatatgaaggaggcataaagtctttttcagacaaatgctgagagaatttgccaccaccaagccagcactacaagaaatgctaaaaggagttctaaatcttgaaacaaaaccttgaaatacaccaaaatagaacttccttaaagcataaaactcacagggtctataaaacaataacaaaatgaaaaaaaaaaaaccaacaaaaaaagaaggtattcaggtaaaaacaagcatggtaaataaaacagtacctcacatctcgatactaacattgaatgtaaatagtctaaatgctccacttaaaagatacagaatggcagaatggatacaaatccaccaaccaaatatctgctaacacatatggactcacataagttgagggtaaaggggtgaaaaaagatattccatgcaaatacaaaccaaaagcgagcagaaatagctattcttatatcagacaaaacagactttaaagcaacaatagttgaaaaagacaaaaagggacattacataatgataaaaggatcagtccaacaggaaaatatcacaatcctaaatatatatgcacctagcacgggagctcccaaatttataaaacaattagtactcaacgtaagaaatgagatacacagcaacacagtaacagcggggacttcaacactagacaggtcatcaagacagaaaagcaacaaagaaacaatggacttacactataccctagaacaaatggacttaacacatatttacagaacattctacccaacaactgcagaatatacattcttttcatcagcacatggaacattctccaagaaagaccatatgataggccacaaaacaactctcaataaacttaagaaaatcgaaattatatcaagtaccctcttagaccacagtaaaataaaattggaaattaactccaaaaggaaccctcaaaactatacaaatacatggaaattaaaaaatatgctcctgaatgatctttgggtaaacaatgaaatcaagatggaaattaaaaagttttatgaactgaataatgacacagcttatcaaaacctctgggacacagcaaaagtggtgctaagaggaaagttgatagcattaaatgcttacatcaaaaagtatgaaagaggccaagcacggtggctcgtgtctgtaatcccagcaattttggaggccaaggcaggaggatcacttgaggtcaggagttcaagaccagcctggccaaaatgccaaaaccccgtctctatcaaaaatagaaaaaaattagctgggtgtggtgacgcatgcctgtagtcccagctacttgggaggctgaggcctgagaattgcttgaacctgggaggcagaggttgtagtgagccgagatgcaccactgcactccagcctgggcgacagagcgagactccgtctcaaaaaaaaaaaaaaaagatccaattaagctaaattagaaacaaaatgaaagatattacaactgataccacagaaatagaaaagatcattcaagactactatgaacacctttatgcacacaaactagaaaatctagaggaaatggataaattcctggaaatatataaccctcctagattcattcaggaaaaaatagaaactttgaacagaccaataataagtagcaagactgaaacagtaatttaaaaattgccaacaaaaaaacagtctgggaccagatggattcacagctgaattctattgaacattcaaagaagaatttgtaccaatcttactgaagctattacaaaagacagagaaagagggaatctccctaaatcactctatgaagccagtatcaccctaataccaaaaccaggaaaggacataacaaaaaatgaaatctacagaccaatatccctggtgaacatagatgcaaaaatcctcaacaaaatactacctaatcgaatcaaatggtgtatcaaaaagataatacaccatgatcaagtgggtttcataccagggatacagggaagacttaacgtacacatgtcaataaatgagatacatcacataaacagaattaaaaacaaaatcatatgatcatctcaatagatgccgaaaaagcatctgacaaaatctagcatgccttcgattaaagccctcaggaaaaccgtcatagaatggaaatacctcaaggtaataaaagccactatgacaaactcacagttgactttataccgaaaagggaaaagataaaagggttccccctgagaactctaacagacaaggatgcccactgtcaccactgctattcaacattgtactggaagtcctagccagagcaaacagacaagagaaagaaataaagggcatccaaatatgtaaaggggaagtcaaaatatcgctgtttgccaatgatatgatcgtatacctagaaaaccctaaagactcatccaaaaagctcctagatctaataaatgaattccgtaaactttcagggtacaaaatcaatgtacacaaatcagtaacactgctgtataccaacaatgaccaagctgagaatcaaatcaagaacctcttgttacaatagctgcaaataaaataaaataaaatacttcggaatatacctaaccaaggatgtgaaagatctctacaagaaaaactgaaaaactgattgctgaaagaaatcatagacaacacaaataaatggaaacacatctaaagctcatggtaggtaaaattaaaaatgaccatactgctaagagcaatctacagattcaatgcaattcccatcaaactaccatgattattcttcacagaactagaaaaaacaaccctaaaattcacaagaaaccacagcagggtgtggtggctcacgcctgtaattccagcactttgggaggctaaggtaggcagatcacttgagcccaggagttcgaaaccagtctgggcaacatggcgaaactctgtctctacaaaatatacaaaaatcagctgggtgtggtggctcacgtctgtaatcccagcactttgggaggctaaaatgggcagatcacttgagcccaggagttcgagaccagcctagacaacatggtgaaaccctatctttacaaaacatacaaaaattagccgggtgtgctggcacatgctgtagtcccagctactcaggaggctgaggtgcaggatcacttgagccttggaggcagagtttgccatgagccgagattgtgccactgcactccaacctgggtgacagagtgggaccctgtttcaaaaaaaaaaaaaaaaaaaaaaaatcatatggaacaaaagagcccaaatagccaaagcaagataaagctggaggcatcacattacccgacatcaaactatactacaaggatatagttaccaccaaaacagcatggtactggtataaaaataggcaaacagaccaatggaacagaatagagaacccagaaataaagccaaatacttacagccaacagatcttcaacaaagcaaacaaaaatacagagtggggaacaaacaccctattcaacaagtggtgctgggataactggcaagccacatatagaagaatgaagctggatcctcatctctcatcttatacaaatatcaattcaagatggatcaaagacttaaatctacgatctgaaaccacaacaattctagaagataacatcggaaaaactcttctagacattggcttaggcaaatagttcatgactacgaacccaaaagcaaatgcaacaaaaacaaggataaagagatggcacctaattaaacttaaaagcttctgcacagcaaaagaaataatcagcagagtaaacagacaacccacagagtgggagaaaatatttgcaaactatgcatctgacaaaggactaatatctggaatctacaaggaactcaaacaaatcagcaagataaaaacaaataaccccattaaaaagtggacaaagaacatgaatagacaattctcaaaagaagatatacaaatgaccaacaaacatatgaaaaaaatgctcaacatcactaattatcagggaaatgcaaatcaaaaccacaatgacataccaccttactcctgcaagaatggccataattaaaaaataaaaaaaatagatattagcatggaggtggtgaaaagggaacacttttacactgctggtgggaatgtaaactagtacaaccaccgtggaaaacagtatggggactcgttctggagatggagtctcactctgtcacccaggctggaatgcagtggcacgatctcggctcactggaacctctgcctcctgggttcaagtgattctcctgcctcagcctcctgagtagctgggactataggcatgcgccaccatggttggctaattttttgtatttttagtagagacagggtttcaccatgttggctgtgctggtcttgaactcctgacctcaggtgatctttccgcctcagcctcccaaagtgctgggattacaggcatgagccactgcacctggccagagattccttaaagaactaaaagtagaactaccatttgatccagcaatcccactactgtgtatctacccagaggaaaagaagtcattatgtgaacaatacacttgtacacacgtttatagcagcaccatttgcaactgcaaaaatacggaaccagtctaaatgcccatcaaccaatgagtggataaagaaaatgtggtatatatacaccatggaatactactcagccttaaaaaggaatgaaataatggcattcacagcaacctggatggagttggagaccattattctaagtgaagtaactcaggaatggaaaaccaaacattatatgttctcacttataagtaggagctaacctatgaggatgcaaaggtataacaatgatgtaatggactttggggactcagggggaagggtgaagagggtgagtgataaaagactacacattgggtacagtgtacactgctcaggtgatgggtgcactaaaatgtcaaaaaaagaaaaaaagcaactcatgtaaataggatattcaataagattatcagcatagtcagtgggatgacatattcaaaagaaagaaagaggccaggtgcagtggctcacacctgtaatcccagcactttgggaggctgaggtaggtggattgcttgagctcaggagtttgggaccagcctgggcaacacagcaaaatcccacctctaccaagaaaaaaaataaaaataaaaaatttgccaggcatggtggcgcacatctgtggtcccagctactcaggaggctgaggtgggaggcccacttgagcctgggaggtggaggttgaagtaagtcgagattacaccaatgtactccagcctgggtggcagagtcagactctgtctccaaaaatctacaacatcgtggaagttggaaaacacactgttattttaaatttcatgtatttttataaaaacagatggagttggttgggtgtggtggcttacacctgtaatcccaacactttgggagcctgagacgggtggattgattgagcctaggaatttgagaccagcctgggcaacatggagaaaaccccatctctacaaaagatacaacaattagttgggtgtggtggtgcacgcctgtaatcccagctactcgggaggcagaggcaggaggattgattgagccagaaggttgaggccacagtgaggggaaaaaaaaaaaagagagagagagagagagtcttgctatgttgctcaggctggtctcgaattcctgacctcaagtgatcttcccacctcagcttcccaaagtgctgggattacaggtgtgagccaccacgcctggctgaaaaaacacactattaaacaaagtgagacaaatgaaaatgaaaatacaacataccaaaacttacagtatgcagtgaaagctgatctcaaatcaataatctaacattacaccttaaggaactagaaaaagaactatacctaaagctagcagaagaaaataataaagataatgggacaagataaatggaaaataatagagataatcaatgaaaccaaaagttgattctttgaaaagatgaacaaaattgacaaacttttagctagactacataataaaaagagagacaagatccaaataatgaaaatcaaaaatgaaagcagggacattacaaccaatgccacaaaaataaaaaagattataaataagagaacagcatgaacaactatatgacaataaatctgataacctacataaaatggaaacaacttaccaagactggctcataaagaaattaaaaatctggacggatctctaatgagcaagaaaactgaatcaataaaacaaaccctctcataaagaaaagcctaggatcatatagcttctctgatgtattctaccaaacacttagagaattaacaccaatcctccttccaaaataggtaggaacacttcctatttcattctatgaggacagcattaccctgacaaagctagacaaagatactacaagaaaactattagatcaatatcctttgtaaacagtgacccaaaaatcctcaacaaaatgccagcaaacagaattccaaagtacattaaaagaattatacaccatgaccaagtgggatttattccttgaatgcaagaatggtttaacatatgaaaaccaatcactgtaatacatcacattaatgaaataaaagaaaattttaaaatgacacgatcatcttaatgcagaaaaagcatctgagaaaatgcaacattctttcttgataaaagcactcaacaaactaggaatggaagaaaactatctcgacatagtaaagaccataaataaaaagcccacagctaacatcgtacttaatggtaaaagactaaaagcttttcctttaatatcaggaacaagagaaggatgcctgcttccagcactaatatttaacgtagtattaagagtcctagacagatcaattaggcaaggagaagaaataaaaggcaaccaaattgggaaaaaagaagtaaaattatttctgttcacagatgacatgatcttatatatggaaaaccctaaagattcagcgaaaaactactataaacaaagcaaaacattctgcctgcctgtggtactaggaagaagctgcaagaggacttgccctctggcctgaaggcaatgtaaagagcagccaagtattattgatatttcctcacccttcggctctcagtaaaggatggtttttccactctttcaggatgcgatgtatagctctttgtacagcctgcaacacacaacttaatcaccacctctctggccactgccacaggtcttacagcagcagtccccaaccttttcggcacccaggactggtttttttttatggaccagtgggggaggggaagacggtttcaggataaaactgttccacctcagatcatcaggcattagattctcataaggagcacacaacctagatctctcatatgtgaagttcacaatagggtttgtgctcctatgagaatttaatgttgctgctgactggtctgtggcccagaggttggggacccctgtcttacactgaagaccacagcaaagggaggcttcctaagaacagggcctggctggggaggctggagccagaacaaagcccaggaacctgaaaggtgtttgcttagtgccccaaccttctgcttctcattttcctcccatgcacactgaaccatgcaaaggatccttgaagttgaaagaaatctgaacctttggtgtccctgtggtgcactggcagctcaaatcagagtatataaagagctcctataatatacatagagttcctacaaaccattgagaaaaacaaatggcaacaagtatttcaatagatagttcaaaaaagggaaacacaagcggctcttaagcatgtgaaatgatgctctcctaacaagccttcttgggagggctgctgagtcagcatggctggttggaagtccaccctccaaccacagctatattttcccagttatttgaaggatcagttccacttgaatgaccaattctcaccataaatgttgataaataaggccaggcacggtggctcacgcctgtaatcccagcactttgggaggctgaggtgggccactgcattccacactccagcctgggtgacagagagagacttcgtctcaaataaacacataaataaaataaaagagtgttgataaataaacccaagaagagcacagaaggctcatgctcactcatctcctctgccccaacatctagatgaaaagacagtaaacatacagaaaaaaaggaacaaattcagaatagtgttgagatcaggagaggacctggcagaagacactgggattggctatgtctacgtctgctctaaatcctcttctcttacatattctttgtacagagggagaaaacctgctcattttcccagcctcccttgcagcagaggtgggtgcccaagtgatttaatggttgcctgtgaggcacagactagtttctgggagagcgtttcttttctgatgagagggtgaatgttgctgttgccagatttctcctgttctctctccttccctgatcttggacatggaagccaccttgtaaccatgagggaagggctaggagacctttacagagggtggtaagcgggtggtacatactgacaggtgactctgggaggggaaccacagattctcttaggcagagcctcagtgaagtgtcctgtttggagttggtaagaataatcagcaggaaggaggggagaagaagaaatcatggccatcaaatggtagcctgtttgtggctccttctgtctataccaccacggcccagagtgcttactttcaggctgagaaagagaactactatggtgagctttggcgggcatcttgggctaaggctgacagaatgaagctccacaacctgcccatgagggggactcactgggcaggtttctgcctgcctcccactctagtagatggctcatcggcctgtcctggaggtgagatgtgctaagctgtgctaagcgaacagctgtactcttgaaaaggaaacctgaggccactatcaatctgggttcttcacttgtaactacaacctgataaccaaggatttccacatagggtaaaatgtcctcaagtaaagaccgcaatgaacaaatcaaagattgaacccagaaaagccagataattcagggaacaaattattttagaaaatgttagcatctgcagctgatatctgagaagatatcacaagcctttccttccattaatagaccatgcaattcagaacagccttcctcactgacaacaaagaaaaaaaggtggacaaatagcagcaaacttctgagagctaatgtgttaatgataaatgactgagccatgctgtggggaagacagagatccaaagagggatgcctttgctttggaaatatttatccatgaggaagaagctaggcagaacttctaccaaacttgagggcctgggttgggagcggtggctcatgtctataatcccagcacttcgggaggctgaggtgggtagatcacctgaggtcaggagtttgagaccagcctggtcaacatggtgaaaccccgcctctactaaaaaaataaaaattagctgggtgtagtggtgtgtgcctgtaattccagctacttgggaggctgaggcaggagaattgcttgaacccaggaggcagaggttacagtgagctgatattgtgccactgtactccagcccgggtgacagagcgagactccgtctcaaaataaacaaacaaaacaaacaaacaacttgagggcctagggggaccatagcaggggctagggccctgttaacttacccctcctttgtcctggtattccaaaggtacgcaacctagaataagcgtcaactggaagtaaactagcctctataccagctggcacccagctttgagttccaggcagcctagaaaacctcagtccctgaacgggatcatggagtccctacagtgctactcccaagaagttggcagaagcaaatagaagtgttctgtagaagaagataacatcatcttaggcctcaaactatttctacaataaatttttcaaatactatgtccaccagatagtaaaaaataaccaggtacataaggagataagacaatctgaatgagaaacagcagaaatatttataggcaacggaaatagatctgcaaaggctcctgatactagaattatcagacataaaactttaaaataactaagattattatgctaaagtagataaaagcctaaattaaaaatctggtgaagaattgaaagcatgaaaaatgatacagctgatttttttttttttgagacagagtctcaccctgtcgcctgggctggtgtgcaatggcgcgatctcggctcactgcaacctccgcctcctgggttcaagtgattctcctgcctcagcctcccaagtagctgggattacaggtgcccgccaccatgcctggctaattttttgtatttttagtagagatggggtttcactaagttggccaggctggtctcaaactcctgacctcatgatccgacccccttggcctcccaaagtgctggaattacaggagtgagccaccacgcttggcctttttattttttattttttgagatggagtttcgctcttgtcgcccaggctggagtacaatggcgtgatcttggctctgcctcctaggttcaagcgattctcctgcctcagcctcccgagtagctgggattacaggcacatgtcaccaagcccagctaatttttttttttagtagagtcggggtttcaccatgttggctgggttggtctcaaactcctgacctcaggtgatccgcccatcttggcctcccaaaaggctgggattataggcatgagccaccacgcctggcctgatacttgattttacttttttttaaattttccttttcttgagacggagttttgctctgtctcccaggatggagtgcagtggtgtgatcttggctcactgcagcctcctcctcccggttcaagcgattctcctgcctcagcctccccagtagctgggattacaggagtgtgccaccacacccagctaatttttatttttagtagagacgggatttcagcatgttggccgggcaggtcttgaactcctgacctcaggtgatccacccatctcggtttcccaaagtgctgggattacaggcatgagccactgtgcccggcgatacagctgattttaaaaagagaggatattacatctctcagatgatggggaaaatgaaagggaagaaataatcaaataggaaaaccgaagaaaatcactggtctctgtctctgtttctacagaatgaatgagctttctgaatcttcaaaacaccaagataggatcccaaagtacttacaaagcaatggaaattagatttacaatagatttttttagcaataacactggatgcaaagtctatggaacaatgccttcagggacttaaggggatttgactttgaacccaggattcaaagtacctagtcaattaaggtacaccacagtcaaatttaagaatggaataaaaaattaggcctctgtacacaccaaggcctgtgagggctgaccctctggccttttgatgtcaactcctttcacccttctgctaccatcccgttgggctgttccttttaaactccaagctctcccacctcaggcctttgcactttccctctgcctggatgttcttctcccaaatatatgcatggtttcatccctcaccttttctggtctctgcttatctgtttgtttggcctttcctttttcttttctttttttttttttgagacggagtctcgctctattgcccagactggagtgcagtggcgcgatcttggctcactgaaagcttagcctggcctttcttaattgcccagcatgaaatagcagcctgccagtattctatatctccctgcccttttaatttttttcccatggcatccatcaccactcaagacactacagatacctcttctcatttgcttagtctgtctctctccataagaaagcagatccatgaatgcagggactcagtctgccttattcactgctgcctgccccattcactgctgcctgccctatgcctataacatgcctggccaggggaggtgccccatcagtaattgctcaatgattgaatgaagctgtgagctaactcttagatccataccttctcccatcccccaccaacctgttaccttcttgatttaatgaatggttctggcatccattttttgcagctgaacctggaggtgccacatgttcattatgctttttccttccacatccaaccacccatcaaatcttattggttctgcctccaaaatacatcttgaatctgtctcctttcccctctccatggccaccacactgatccaagtcaccttcatctcttcctgggactgttacagaagatactccctgactgtttttctattttagttcatgacacctctgtgccaactctgccaagaagaaaacgctagctcctgtaaaggtctctgtggtccacctcctgcctcatttcacaccaccctctccttttgccttctatgtgccagccacagtggctccaaacagatcaagcactccttgcttttactctcacttctactaggaaacactttctccaggtctctgtatggctgtctcactcttctccttgggtttcatccgcagtgtcctctcacaaggccttcctggtcactccttcccaggcactctcatctgaagaccctgcttacttccttcttagtctgaatctagtctgaaaatattttgttgacctaactgcctccctgtttatgtgtgcatccctaccagaccgagctccacgaaggcagggaagtaccttccgtcttttgtcttcacaaccaagcccagagcccctgcaggcagcctccctcagcacaggcacgtggcggagcactccgtggctcctgatgtccagggcccagctcctgccaggttgtggagggccgtcggcatgtcaccctctcactgatgctgggacctgaggctgggtgctggagaagtctaacgggacacaatttcaaagcactttggcttatttaaaaaatctccaccttcatgtttcaagaaagaattcttgcagcaacaatgaaagaagcacctaccactactgttgactcccactggcttccagtggagtagtgaaccggacccagtaagtccttgcatatttctcgaagtcggtattcaaaccctaattacagaaaaacaaacaaacaacaacaacaaaaaacaaaacagaaataggaacacattacaaaaagaaataaaatcaagaatatgttgttgtgtctatcaaatcagaataaacacatgcgtattttattgcctactatgggcaagacgcccctgcatgtctctcagcggggggcactgagacccataatcacagattttcactcacttgctcactcccctgacatctgtagtgcctcctctgtgtgttgggcccagaggaaaaacgagatatggccagttctgtgataaactccttaaggtgatgggaagatatgggaaattgtgggctggtgagatctgtctttgagaagatgcgctggcagctggtgttgaggggaggtcaggagggtgggacggccagcccgcaggaggtaagagatggcaaaggcatgactgaagaggggcaactgagtggagggggcataggtccattaactcaagggttatgggcaccacccagtagggctgctagaaaggctggaggtagagtgtcggggtttgtcagcacttggggcagctaaagcaatagggaatggattaaactgtccaaagaaaagggtggagtaagagagatgaaactggaatctgaggaattttggaagtgaatggggtccacttttatactagattcctccttttacagccaaggaaacaagggacagaatggagggtgggtaactggtgtatggacactagaacaggcaggtggaagatggagaaagagaagcaagcagcagaagtcatcccaagatgggtggcggggcggagaggaggtggggacttgatgcagggcatcagagcaagtcccagtcaacacccaggatgaagcaaaccagagtggagtaagaggaggggctcccagggaagacgtgactagagcaccacaggagaggtatgagagcctgggaaggctgagtattcagaaaagctggggaccacacataatggcaaccacatagacctggtgggaagagtaaacatcaaattcatcatcgtggtctgcagggagggaggggaggcttcaagttgatcagtaatatttgctgtcgtttacaagtgtatgtacacacacacacacatacactcgtatttacacagccagaggcacatgtgacatgttagttctgggaattacatccgtgaaggtctgattatgattttctctgtcttttctgtacttaaatttttttctaaattataatcaaaatggggagggtgatgacaaaaataaagcaaaaagcccaggaagctgcacagagagagctctgggagggcctgccccatgccgcaccctgaaggctgcactcaagtgggaggaaaagttggtaaggctattggagtcactgtgaggacagtgcagccacctcttccagcacacctggctttctgcaagggaggcagcagagtgagagctctggcgggaagtgccagaaatggagggcctcagtaagtgcaggacatcaggcaagcctgtccagggcaggaagggctgggaggaggaagagaaccactgctacaagatgccctcactgattagcagcactgccaagttgtggtgcagggcaggagccagaacatagaatctgctccttcagaccatgtctttccacccaggcatctattcctccgtcctgctgcctgtcctgctgcttctctgcgggaacaccctcagggtcactctattcagagcctcagagcctataaggggctgggtgcctgctgagctgccttgactgcagctcaggctgggaggtagaggctgctgggccatcacatcttttccctgatttcacagggactaagtgaggcctgggaggatggaggggcagaaggagaaggctgctcagggctgccaggagcctcaccttcgtttacgaggtaccgtgcgtagacgaggagccaatggcggtactcgtggctggactgcagggtgagtgctgctgccacctggttctctaggtaggccagggtggtctcttgctgcaccacatgaggcacggagaagagccgggcagcctgccttcccgagctgcagagaccaggagagtttccatgatggggcagcaggcactacacagagtcaggaactgcccccgtgtgcaacaggcaaggagctggcaggaggcaggcaccagggctgccaaggcctcccgtccactagccagtctgttggcagatgccagatctgttgtctgcccatccccacgccccagccatgtgcctcctggcacccttggggtatctcacccagcacctgccatctgggcccctgaagtgacagggccagtgattgctgcccccaaccccaagatattacctgatgcaggaccactaccctcagcacccctagtccgtcctgcccagcctgcctgtgctgaccagcacctggggcacaggggaagggcaggtggagaccaggcctgggcagggactgtgcgtgcactgacccaggcacttccccagggcaggactaaggacagtggccatggcattcaggtcacgtacttggaggtgcggccctggattatggctaacggtcctgagcacagcatggcgtcctgggatggcaggctgctcctaaagtctgcacactgagccagtgagtcctgcttgtcagaaaccaggttcctggggaggcaaaggcaggagcagagctcaggaaaaccaagagatctggttggcctctttgccaaccagagaaggctggcaaagaggccacagagaagcagcccctgccgacacagaaagccagtagaggctgagcgcccctgcacttccgcacaggcgcctatcactgacaggtttcatggtaatgggtctgatagatcactgttccaaaggaaaaatgagtgaagtgaaggctgtggatagggcccttgctgggaacacttcagctccatatgttggttcctgatgactgcaggcctctgtgtgcagtgtgctctgatgctcagctcaaacactgccatggtctgcccacagggccacatggcctgggccctgtagctagcgagcaatgccaggcctctacctgcctgtatttctacaactatcccagactggcagtccttccaccttctctggacccttctcatccttgtgaagaagactcttcacacacttttagaacagctagatgtctttgtaaatgtgtccaaaatacaaagatgcctacagagagtcaatatttctcttcttaaataatcagcttatttccattattacagcaatcatatataatagacaacattttgcaatttgggggagcaggcagtggagattttttttttcctttgagacagggtcttactctgctgcccaggctgaagtgcagtagtgtgattacagctcactgcagcctcgacctcctgggctcaagggatctcctgcttcagcttcccaaggagctgggactacagatgtgtgccactgcacctggcttatttaaaattttttttttttggtagagacagggtctcactatgttgcccaagctggtctcaaactcatgggatcaagcaatcctctcagcctcccacagcgctgggattacaggtgtgagccatcgcacccagcagattttttttttccaaattcaagaaagaagtctcagtgtgaatgtagacttctgcatggcagttcttaacagaaaaggggctaggaggtagcaagctttggttcttaaggaccaaaggtatagacagaagaaaagaacttggagtggctggaacacaacgtacataattcacgtgtctgggttaagagctctgatgtataaattattttgcaagtacaaaaaagggctccaaattcctgagtggacagaggaaaagtacagaccatcatgcctgggtaagtggataagcatccttactaattcactgaggaagtctgaagtgcttactaagctcacagaaattgactagtcctgttaaggctcctgtaaagcccactaacctatgctcatggtggctaagggggccacagcaaaaaccataaaaattttggggctttttcaaaaagtgcctcctgaaaataatgcaggaggacagtgctcctgcacacaggctctgagggcagaggccataggctgcagtgtcctgctgggacaggggagcatgcacagatagtcaatgcagcctgcactccagggcctgactctcaggaaaagcagggctaggcagccctgtaggccacgaccctttgctctgctgtctagagcagacagacactcttccagggaataggactgggggtcagcttgcttaccatgtggaaagtgacggattaaagcagtacgccttcccatcggacaggttcattactgggattccatgctgcgtcagcaagatctgtgataccgtcatatcacttcctgaggacagcatgggaatgagttctgggtgtgctctgatcagcaagtgttttcaaacatatcaaaggagaaatctgtactctaggctcccacagtcccagcagcaaatgcatcaacactgccttggcaaatagggagggcaagccattctccttgccacacaccaggcttttgtcacctcttggggacccattcaaacatgcccccaaaaagtgtgtgtctcctgcagcgtaaccacacctcctgcctcactgagagccctgggctgaggccagagcctggctctctgagcggggcccttctgcagcatcagacatgaacttgggcccccaaaagagtagggacagcctgttgcctgcattacctgccaggatggagtgtagagactcttctttcaccacaaccacctgtctgtgaacatccctaggagggagacagggaacagtttactcaccaacccaggtaaacacatcagagtgtgccttggctgctcagacaccctggccctactgcatgcgaccctaaccctggcctctcctagtgagaggggctctgggctacgagtggcttctgctctccatgtgccactacactccctctgcattaaggctgcagcacaaagcccaggcaacagagccatggggaaccctcagcgcccacaccactttgggggaagccaggccacagcagccacatcaggaacatggccacattctgccagctaagactccatttctgatgaatcttgcataggaccctggcagtgcaactggtcgcatgggctgctccagtaaggaaataatcgagcaggcaagctgcctccatcccccttgcacactacccctcagccctcagcctacccagggcacccaacacaagcaatatcactaactgctcagggcctcttctggggcctgatggccagccttgtccactgccttccctgcccctgcagtgaggtggggcctacacagccctgtcctgccctggctgaagcccaccccaccctgtgcctgcctctcaccagacagagagtgtggctgcagcggtgagcgccatgacgtaggagcctgtgcaatgcaaagtagagatcggggatggcaggaggatgggagagaggagacggcgaccacaggtggagaacactgacagcatccttttttcacaggcgacacacaccacgtcactgagaaggcagagtgggggcaggtgtcatgggggctgagtgctgcagccaagacagtagccctggaagtgtgggccttccctctgcctgggcccaacaagggcctcccctgagcaggtacagccagaagggaaggtggattgggtcagggtagggctggtggggctgttggagcctccctgagatcttggatgaaagaggcttctgtcctatttccacaggctgcctgcgctttcctgagctcatgctgatgctgaccaaggggtgtgggggctttggagagccaatgcctctgatgatcacccaggaaacatgccttgctcatcagataaggccacatagtacccacaggacagtctcctggctgcaactagtcagaccagtcctgagaaggtctctaacaaggcaggctaagagaagtatggggatgacagcatgcacctctgtgtccagggggctgtctggctggcgtgggagatgtgtgtcgctcccaaacaaggagtgcgttacagaacagtctggacactgtccagcttctcccgagtgaccaccaggcccctgggtgggccctgcacgagcaggctgctgccttcccagacagagccccctaaggcacagccacaggcccagggtgaggctggagctcagacgcaggcaggggtagcagatgtacagccagtacagtgagatcctggccacagtaggccacccagagccctgctttgtgtcacttctatcctggtgagccagtcactccagcaggctcaaggaggtcagttaaggaaggagctctgccaactgccttcctaatgagccactattgctactggctccaaaaagggagaggcaagtgagatgcttttgtttacaaatgtttacttggagagtatgaatcagagaacactctaagcagcacgggcaacaaggagctctctgcagtgctgtgactgaattcttattttttctgagacagagtctcggtctgtcgcccaggctggagtgtagtggcgtgatctcggctcactgcaacctccgcctccccagttcaagcgattctcctaccttagcctcccgagtagctgggattacaggcacatgctaccacgcctggctaatttttgtatttttggtagagatggggtttcaatatgttggccaggctggtactgtgactgaattctatctgcccatctctggtggtcagagcctggctcaagccagcccactgcaaagaaagccatcatttttgggctgtaacactggggaacaggtctgcaggctgggcctgaactgggcaggactaagcaggaggagaggtcccacgtggtccagcaggcttgccccacagctgccatgtcactgtgggagaggctgtgccgacaccccttagccctcagctgggcaagccacctgccttgaggggagggacagagagtgggagcctgtggaagcatctgatacacaggtgcctgggactgggaatttaaatggctcatctggagggggaatttgagggaggaacagaacaaacagtggggtcccctaggcctaaaaacacaaaactcactcagggcccacgagaattgtggtctaagacctaaggccatgtgctttgacacaagtaaaagcatttacatgggacctcatggcagatgattaagggtgtaattatgatgactgtatctggtcctgactgggatgctacatcagacaggaacctgaggagaaacattggttccccttccacattgaacacaggtagggacagggctcacgtacagttctaggaacccaggggaagatactgggtgactaatcactgaatcaaggtccccctcacagtgcagaatctggcatgggctgggatggggacttcagggacagtcagaaatccatcctgaccaacttggatggaaatctgggatccaaaaaaggaaccagcccaggtcaaggtgagccaggcacacctcagtgtggaattcgagactttggggatctggctggacaagggaatcaggccatcaggttcaaagcttggcctgggtaaccctcaagggctcagtttccccatctgtaacacggggatactgatgctgaccttgctgggtgctgcagggactgagatgacaagcacatatgcttggcctggagtgaagcctggtgtgagtctctgtgggagctggtgctcccagggtcatgcacctcccctagacaggcccaggcccagaatgatggcatgtgtgcctgtgtcacctgggccggctaaggacctgcccacccttaccagctgcccgcagcagtgaggatccggctggtgagtaccgtctcccactccttcccttcccggttgcacttcaggcggctcagcttcacgccccccaccactgtcacttcattctccacctcaatgtacatggaaggatcggagctgacctggatgaagtaaacacacgggtctgctcagacaagggccgcagcccaggtgacatgctccaaggctctgtagcctggggccccaaggcagcagcaggatacagaggcagactggctggccaagagaggagagggagggcaggtagggcaaaggggctgagcgggaggcccagagggccagacatgtggcccccaaggcagggagaatgctgggagctggtttctaccctgtcatttgtgtagttgaacagccagagaagagaagcagtgccagggttaaagaccccaaagtctcccaaccctgccacttcatctcacaagggagtaacgtgcccaaaagcacactgcaaaggaccgagctgggagtgagacttgggtttctagcctcctacttgaagaatcttcaaagatggcagtgtttggcaagattagagaccatgtcagtgcttggagggaatgtttagaaaacccccaaaggggctctccagttcctgtggtggtgagacttggtctgctcaactgagactaaactggcaggggtgtttatggcacagcatgtatgaaaagcacctaattcagtgtctggcaccaaatgggctcagccacacgcgtgtgtggggagctgaccaacagattttccctgtggtaaaataggcagaaccaccaaacagtctgtgcttgtgtggccactcaagtgggtgagctgggccgagggctgactgcccccttcacagacccagaaatgacagtcccaagcagtgcttggagggcaagatgcctaggggaagggctggaggagtttgggagagttctgtgctgagaagcagggcacccaggagggaacctaagtcagaacacctctgagtgcaagagcacgtctgaacgctgctgaccactggagggcccctgcctccgttcacaccagcaataagaacaaaccctatgggttcctaccctttggcttccctgcttcattcctctgcactgtggcccagaaggacctatggtaggaagggctgacgcctgctctctggtgccctgtgaggaccaacctgggctcagagcagtgtgtagccagtgggaagtgacccgcaagcagggtccaagaaggctgctcgaggacacgcacctgagctgaggtacaagggtatgcagagaggcagcagtgtgtgtgacggcaccatggcaggagaggcctagatactatgctgggccaagtgaccaggagggctctgggtataaaggattatttactccagaattgtgttttggataaccacatgcttacaagcttccattccaagagctcaaacaactctgatgattgactgtgccagacactgagaagacaaagctagcaggatggttgggagatagattatgaccacacattcccacagacaccaagcctgaggctgcccagggctgtgtgtggaggtggaggtggcttccagccaggacacctgagaggagtcctgaagagcaccagaacatgtggtggtaatggcagccccagcagctggaatcccaagggcaaagccagacagaggctatgggtgagtgagagtggaggctggcaatttcgctaagagttggtgggtaccccgatctgctatgacttctcccagaaggtgatggagagccactggaaaccaatctccaaggaagtgacaagataggatttgtatgcagtaggggacagagaatgtctgggtgtgcctgagggagaactggcagggtcctagaacttacctggagggtgaatgctctctgggggcttggaattggcagcttcagtgcaagtgctggtgcagacagacacatggcctccttctctgcggttagggcagctggagactggaagagccagaaacgttcctgagccttgctctaacactacggggtagcatttggtaaaggcaggtcacccagaagtgaggctgagcctgcgaccagagcatttccaccctgggagggaggaagcagaggggaatgctacaaggatcctaacctcatggacaagccagttgatgccagggaacctgctcaagggccctgggtgagtcaagggcacatctgagggagagcgtggcctccatgctacattccaggggctgcatgtctaagccagctggttcccaaggtgacccacccagctgaggcttaccatgcacacagggccttcaagctctaagtacagaaaggtgggctaaagaaggcaggatgggcccactggcctcacctggacagacagagacacaggcatgagacgagagtccttccgaggccgccctttcttcttcttctctactgtctctacctcaagctcaagttttcgcttggacagtgaggaagccttagccaaagggactttctcatcgctgtcactgctgctctccaggaggtctcggggcctcagctctttcacaaggttctgctcttttaacctgcacaaaaacattacatcacacttcccttcagaaaccattcatgcaagaaagagtgaagtgaaatatttaaagtgcttaaacaaacctcttgccaacctagaattctgtgtccagtgaaattatgcctcaaaagtaaaggagaaataatgactttgtcagacaaaaataaacaaagagacaccggaatctgttgccagaagacctgccttgcaagaaatgttaaaagtctttcagagagaagataaatgatgcaggccagaaactcacatctgcatgaagaaaggaagagtgatgttagagaaaaaaaacaatgaacataaaatagaatcttttgtatttcatattcccaactgatctgagagacaactttctgttcaaacaaataacagccaccatgtcttgaattactatagtttatgaatgagtgaaataagtggtaccaatgtcatagggcatggaaggaaagagtggggaactctttctactacccatgaagtggtataatattatttgaaagtagagttaggttataaatgtttattgtaaactctagagcaatcactaaaaaaaattttttaaagcataattaataatgctgagaggagagaaaatttatttttattttattatcattttttttttggagatggattttcactcttctcgcccagcctggaatgcaatggtgtgatcttggctcactgcaacatccacctactggggtcaagtgattctcctgcctcagtctcccaagtagctgggattacaggtgtgtgccaccacgcctggttaatttttgtattattagtagagacagggtttcatcatgttggccaggccagtcttgaactcctgacctcaggtgacctacccgcctcagcctcccaaagtgttgggattatggtcgtgagccaccatgcctggctgagaaaactgaatcatataaaatactcagctaaaaccagagaaggcagaaaaagaagataaaaagaagtgaagattaaaaaaaaagaataaggccgggcacggtggctcacgcctgtaatcccagcactttgggaggctgaggtgggtgaatcacctgaggtcaggagattgagaccgtcctggccaacacggtgaaaccctgtctctactaaaatacaaaaaattagccgggtgtggtggcgtgtgcctgtagtcccagctactcggcaggctgaggcagggcaattgcttgaacccaggaggcagaggttgcagggagtcaagatcgtgccactgcactccagcctggtgacaaagtgagattccgtctcaaaaaaaaaaacaaaaaaaacaaaaaaaagaaatgggtttatgtttttaaaaatttaattttaactacaaaagacaaagacagattaatagtaggtggacacagtggctcatgcctgtagtcccagctacttggtaggctgaggcaggaggactgctcgagcccagaggcttgagagcagcctgggcaaaataatgagaccccatctctaagaacaaaaaataagtaaataaataaatacaagaaaaggggtgattctaactatatgacaacctggaacaggcaaaaccatggagacaataaaaagatcagtggtttccaggggttggggaaaggaaggtaactatatgaagcacagaatttttaaggcattgaaactattctggctgggtgtggtggctctttcctgtaattcctacactttgggaggccaaggtgggcagatcacttgaggtcaggagtttgagactggcctggccaacatggtgagaccccatctctactaaaaatacaaaaattagccacgtgtggtggcatacacatgtaatcccagctacctgggaggctgaggtaggagaattgcttgaacctgggaggcggaggttgcagtgagccgagatgcgactgtgccaccgcactccagcctgggcaatagagcgagactctgtctcgaaaaaacccaaaaaactattctgtaagatatataatgatgaatatatgtcattatacattggttaaacccgtaaaacgtacaacatcaagagtagacccaaatgtaaactttgggtgacggtgtgccccactctggtgggggatgctgaaagtgggggatgctatgggtatgttggggaggcgggcatgtgggaactctttgtatttcctgttcaatttagctgtgaacctaaactgctctaacaaataaagtctattaaaaaaaaaaagcgaggactggagaaagacatgccatgataacactaatcaaaaaaaggtggtgtagttacgtaagcaaagcaggcatcagagacagtaaagttatcaaggataaagagggacattacacagtgataaagatgaaggagtcaattcttcaagaagacagaacaattctgaataagtacacaggcataccttgtgttattgtgctttacttcactgtgcttcgcagagactatgttttttttacaagttgaaggtttgtggcaaccctgcatcaagcaagtctattggcgccatttccccaacagcaggtgctcatttcgtgtctctgtgtcacattttgataattctcacaatatttcaaacattttcattcttattgtatctgttttggtgatctgccattagtgatctttcatgttagtattataactgttttggggcactgtgaaccacacccatgtaagatgctgaacttaatcaataaatggcgtttatgttctgactgctccaccaactggttgttctcctgtctcccttcctctccccaggcctccctattatctgagacaaaacaatattgaaattaggccaatcgataaccctataatggcctctaagtaagtgttaaaccaaaagctaaaaatgattaagcttaaagaggaaggcacattgaaagctgagacaggccaaaagctataccttttgcaccagttagccaaggtgtgaatgcaatggaaaagctcttaaaggaagttaaaagtgctactccagtgaacacatgtttgaaaagaaagcaaaacagccttattgctaatatggagaaagttttagtgctctggatagaagatcaaaccagccacaacactcccttaatccacagcctaatccaaagcaaggctctaactattttcatttctatgaaggctgagagaggtgaggaagctggagaagaaagtctgaagctagcagaggttggctcatgaagtttaaggaaagaagctgcctctataacataaaacggcaaggtgaagcagcaagtgctaatgtagaagttgcagcaaggtattagaacatctagctaagatcatggatgaaggtggtaacactaaacaacagattgtcagtgtaggtaaaacagccttctatcagaagaagatgtcatctaggactttcctagctagagaagggaagtcaatgcctggcttcaaagtttcagaagacaggctggttatcttattgaagtgaatgcagctggtgattttaggtggaagtcaatactcattaactattccaaaaatcctagggcccttaagaattattctaaatctataaatgcaacaagaaagcctagatgacagcacatctgtttagagcatggtttactgaatatttgaagcccaatgttgacacctactgcttggaaaaaaagattcctttcaaaagattgctgctgactggcaatgcacttggtcaaccaagagctctgacagagatgaatgttgttttcataccaactaacacaacacacattctgcagcccatgaacaaggagcattttcatctttcaagtttcattatttaagaggtacatttttgcctgtggtcccagctacctggaggctgaggcaggaggactgtttaagtccagaagttctgagttatagtgcgctatgccaattgggtgtccacactaagtttggcatcagtatagtgaccttctgagagcaagagaccacaccaggttgcctaaggagaggtgaactgcccagtttggaaacagagcaggtaaaaactcttgtgttgataagtagtggtactgtgcctgtgaataacactgcactccagcctgggcaacatagcaagacactatctcttaaataaattaaaaataataattaaaaaattttgtgggccaggtgtggtggttcccgcctgtaatcccagcactttgggaggctgaggcaggcagatcacaaggtcaggagaccgagaccatcctggataacacggtaaaaccccgtctctactaaaaatacaaaaaattagccaggtgtggtggggggcgcctgtagtcccagctacttgggaggctgaggcaggagaatggcgtgaacccgggaggtggagcttgcagtgagccgagaccgcaccactgcactccagcctgggcgacagagcgagactccgtctcaaaaaaacaaaaaaacattttgtaagctatatcagattcctctggcagatctgggcaaagtaatctggaaagtattcaccattctagatgtcattaagaacatcagtgattcatgggatgtcaaaatatcaaccttaacaagagtttggaagaagcggattccaaccctcatgaatgactttgaggggttcaagacttcagtggaaaaagtcattacacatgtggtggaaacagtaagagaactagaagtaaagcctgaagatgggactaaattgctgcaatctcataaaaaacttgaacaaatgaggaggtgctagttagggaagagcaaagaaagtagtttcttaagatggaatctcctggtgaagatgctgtgcatattgttgaaataataagggatttatttatttttattttgagacagattctcattctgttgcccaggctggagtacagtggcacaatctcagctcgctgcaacctccgcctcctgggctcaagggattctcatacctcagcctccccgagtagctaggactacaggcatgcaccgtgacaaccggctaattttttgtatttttaatagagatggggtttcaccatgttggccaagctggtcttgagctcctgacctcagatgaaccacccacctcggcctcccaaagtgttgggattacaggtgtgagccactgcacctggcctttattggcatacattgaaatatcatgccatcgaaatcctttttgtaaggttggtactaatgcctcctttcatttctgattgtatttatttatatactaatcatactttaatacaactgtatgtcgggcttttttcaaataacattccatctgaactatttttccatagtacagtcatcctttggtatctgcatggggattgattccaggacccccaggagatatcaaaatccaaggatgctcaagtcccgtatataaaatgatttagtatttgcatataatgtaggcacagcttccaatgtaccattttttttttttttttgagacggagtctcactctgttgctcaggctggaatgcagtggtgtgatcttggatcactgcaacctctgcctcccaggttcaagtgactctcctgcctcagcctcccaagtagctgagattacaggcacgcaccaccacgccccgctaatttttgtatttttactagagacgaagttttgccatgttggccagggtggtctcgaattcctgacctcaggtgatctgcctgccttggcttcccaaagtgctgagattacaggtatgagccactgagctgagcccggccagcctcctatatactttaaataatctctagatcacgtatacatagtacaatgcctaaaaataacttcatttgcatggattcaaagtagtacttggcatgtagcaaattcagtttttgctttttggaactctgtggaatttcttttcccaaatatttttgatccatagttggctgaatccatagatgtggaacccatggatacagaggggcgcctgtactttggtccttataaacattaaagagaggcacaacataatgaatagcttacttcctcaacacctctcttttgaagaagttggtaaatgtttctcataatgctgtgttaaacatctctaaatatgacagactccctggatcacaggtgctatcactgatcttatttcctcaaggagttcaccatgagtgaactcctgtctagtatccaagagccctcatccctgcctgccttcccactgctaaccagcctctggcctgttagcccctcctctgggcactgtcttcagctgttttccctgctagtcacctgggtcaaagaaatgtgggcagatacacacaccagcgtgtagaatcctggattcttttcatttgtatccatgtgaaaaactgggaagacaagaggcccatgacgctgctctgtgaaactgaagtgtctgttcccctttcttctaatgtcctacaacagggcaaagcatccatctgtgggtgtagcttaatattctggaagtcctgagtcagtgctcctcaaaatcctttaaaaatttttttttttttaaatgtcagacatttgcctcttcaaagagcttgttttactatgttgtaaaaatcagatcatgtacattttcatattaaattttttgttaaataagcttttggaacagtcaaaaatgctttctctcagatgttctgaatatggaaatggaatattagcttgttctaattttttctaacatgaattttcctggttcagactgatctgaaagggtttcatgtattaaaatgagagaatcctattgtgaaacatggaaaaaaagtcagacttttatgtaactatcgttttgtaaaatacagcgagaatgtcacagcaacgtccaactatcatctaagtttctaaggcgggcggtggcttcctgagctcaccacagcactggcccatgacatacacttgcttggcactgccgagctccagctgctccaccctctctggttgggacccctgagagcccttaggagtctccccacctcctgcctctgccagatgccccattcagggactctggggccagtggcccactgggaactgcacctccccagcctgcatgtgggcttgtatcagttgttacaatatccctgggagcaccaggtaaatcgatctacagcagttgcccaatgggtctagacatctgtgaagcaagagcacagctggccagggctgccccccttacaaatgggctccatcctaggttctgtctgctcaggcctacttgccctgtagtcacttacctcaggtccctacgtgcttctgcctgacacctggccttaggagagggtggagcagaagacccacagtttcacccagggctgctaccctgtacctgggatgctagcatttggctcccaatccacctgaggctcttggctaggaagtgccagtcaggttgcaggggtctcactgcccaaccactgtgacgcacaatgaaggaacaacagcaggagctgacatgtgctgctcaccgtgaggcaaggaccaagatacggctttacaggcctaaggttaagggatacctcctatgaggagagttttcctgggaggtccattctgcctgagaggagatggactcagaaagaccatgtgtctcaagattatccctcctccctctctgaggaagtgggggacctgggcctaacttgcaaggtgtattactttgcgcaccacccctaaccactgcatgacactgtgcctcaaagaaaatctccactgaaggccaggtgcggtggctcacacctgtaatcccaacactgggaggccgaggtgggcgcatcacttgaggtcaggagttcaagaccagcctggccaacatggtgaaaccccatctgtactaaaaatacaaaaattagccgggcgtcatggcatacacctgtaatcccagctactagggaggctgaggcagaattgcttgagcctgggagacagaggttgcagtaagccaagactgcgccactgcactccagcctgggcgacacagcgagactctgtctcaaaaaacaaacaaacaaacaaagaaaatctccactgatgggtgttttcttgtttcgttttgtttttgttttttgagacaagtcttgttcaggctggagtgcaatggtacaatctcggctcactgcaatctctgcctcctgggttcaagcgattctcctgcctcagcctctcgccactacacttggctaatttttgtatttttatagtagagacggggtttcaccatgttggccaggctggtctccaactcctaacctcaggtgatctgcccacctcggcctcccaaattacaggcatgagccaccacgcctggcctgttttgtttttattcttgttttgagacagggtctcactctgttgcccaggctgcagtggagtgatttctgcttactgcaacctctgcttcctgcgtttaaggaattctgctgcctcagcctcctgagtagctgggactacaggcacgcaccaccatgcccagctaatttttgtattttcagcagagatggggtttcaccatgatgaccaagctggtctcaaactcccggactcaagtgatccacctgcctcggcctcccagaatgctaggattgactacaggcatgagccactgcaccaggcctccagtgatgggtgttttaaagggctcctcctggttttcattgagaatcaatacaagaaaacagccacatcaagaaagtatctgcattttctgtaaggcctttgttaaagatactgggacttgttttatttcattttcctcatataaggatccaacccaacctgagaattcagcaccaggctcctagaagctcactatactcattctggctggaaagcaggaagctcagccccaagtgaatgctcactcactgccactttcaagtgagaaactgaggatgacaaatgtgatggtggccccttattatacagatcttgctacagctgtatttatggctggacggtcttgtgagaccctgtggacatagctgctgaggaaccaacccttgtggcaccaggacccaggatatacagtcaagattctgtctccagaagccaatctaagggctatcctcctggcttctcattcagggtatgcactacatgagagataagggccacagaaagccacaaagcaaacatgagtgtcttcctcaataagcaggactgtctgtggcacactgtagtttctctcaggtggggaattcattttatttattttgttcagaacttgctccatttcaaaatctgaggtttcttcaccttctggtaagcctcttaactccctcttgacaactaccccgcagcacatcctcctggggggactcctctctattgccctgtcttcagctccacctcctcacctctgtgccactctggccaattttgtagactgaatgttcttttcagctggttctgatctgctctctgaaatgcttgttgacttttaaactgcaatgattattatttttcttttctaaaagtattttttttggttcatttccaaatctggtttttttttgatagtgtattattcttttaatttttattgagatatatatatcataaacttcgccactttaaagtatagaatcattagcttttagcatattcataaggttaagcaaccatcatcactatctaatgccagaacattttcataattccaaaaacaaactctgtacccattggtactcactccttatcctccctccctcagaccctggcaaccactgttactctactttctttatggattttccattctggacatttcctatcaatggaatcatacaacctatgatcctttgtgactggcttctttctcttagcataatgtctttaaggtttatcgttattgtagcacatgtaagcattccattcctctttattgttgaataatattctattgtatgggtaaaccatattttgtttattcatcacctgatggacttttgggctatttccactttttggttattatgtacagatgtgaacattcatgtatgagttattgcatggatatatgttttcaattctcctgggtatgtatctaggtgtgggaactgctaggtcagatgataactctatattttaccatttgaggaacttccagactgttttccaaaggtgctaaaagactttacattcctaccagcatgtatatgagggttccctttagagctaatttttgtttacagaatagagtattaatctttcctcacattttgttttagctttcatgtccttcaagacttaagcatactttatagtgccatctgacaattctatgatcacaggtttataggaccaacacttattatctgactatctgatcttttaattacagacctccaaatgggtatgaagtatttcattgaagttttgctttgtatttccctgatggctaatgatgttgattgaatttttatgtacctgtgctttgtatatattctctgcagtttctcttcagatcttttgctcatttttaagctgtgttattcgtctttttattgttgaattgtaaaagttatttatataatttaaattctggactttaattagatgggatttgcaaatattttctcccattctgtaggttgtctttcaattctgatagtgctttggaagcaaaaaagcttttaattttttttttttttttttgagatggagttttgctcttttgcccaggctggagtgaagtggcgtgatctctgctcactgcaacctctgtcccccgagtttaagtgattctcttgtctcagcctactgagtagctgggattataggcgcctgccaccatgcctggctcatttttgtatttttagtagagatggggtttcgccatgttggccaggctggtcttgaactcctgacctcaggtgatccacccacctcagcctcccaaagtgctaggattacaggcgtgagccaccgtgcctggccaagcttttaatttttaacatggttttgtaaagatgaggtcttgccatgttgctcaggctggtctgaattactgggccttctgtctcgggcttccaaagtgctaagattataagcatgagccattgtgtccagccaaaagttttaaattttgatgaagtccaatttatcgattccttcctttagttgtttgtgcattaggtgtcatatctaagaaacagttgcctaatccaaggtcacatagatttctatctatattttcttctaagagttttatagtttttgctcttacatttagttctttgttcccttttgagttaatttttgtttatagaatacagtattaatctttcctcattttgttttagcttttgttccaattttgttttagctttcatgtctttcaaaatttgttccaattttgttttagctttcatgtctttcaagacttaagcatattttatagtgccatctgacaattctatgatcacaggtttatagaaacctaagtctcccagtaagtatgtctcctgacatttgtgcatgacaggctctttcttcttgtgactgtggattttatgatcatctaaacagtgctttatcagtggtaatgctgtacaccctggcccaaggaatgtcactgcatggtggatacgcatctctgccaagtgcctctgaacgtcaattagaccaggatttcgtttgtgttcatttctcggcttggcgatttctatacaacacaagtagtattaaactggccctgaatccacatgagggcagacctgtggttacacagtctcaagggaagactgttatcccaacccaaaaacaggctgagacattccaacttctctgctagttcttgtgctgtcagttgggttttcccaggtctgcctcagtccttttttaagcagcttgactttatgctggtgacttaattccaactcctacatggcttagaccccaggccttgtctcaagtcgatgtggtcattaaaactcaaggtcctcagtcaagacccctagccttgcacccatggtgcagttctgctcactgctctggcttttttgttcactcttagattttagactctgggtactgctctttcctgtgaactagttattcattttagggacgagggttgcatttaatccagcatttcaaagtatttagaagcatggagaccgcgcgcggtggctcacgcctgtaatcccagcactttaggaggctgaggcgggtggatcacctgaggtcaggagtttgagaccagcgtggccaacatggtgaaaccccatctctactaaaattaccaaaaattagccaggtgttgtggcaggcgccagtaatcccagctacttgggaggctgaagcaggggaatcaatcaaacctgggaggcggaggttgcagtgagcagagtggctaggacaatagacataagccacaacacctggataatttttctggtagagatacgggtctcactatgttgcccaggctggtctcaaactcctggcctcaagcgatcctcctgtcttggcctcccaaagcatttgggattacaggcatgagctatcgcatgtggcctgcattgagttaattatgaaacaagcatgattagattacagagcagactacaagattccacaccaagtttatagatacagcatcaaacttgcagaaagggtcctcccatgctagcttccaggaactgttttccaaggagaataaatcctgtccagacatgcagttctggacagggcttttcataagcaaagccccagaggtagcatgctgtggctttagctccaaatcaccatctactgcaaggacaggtcacatacaaatgctcctttcattgggcacctgctggctgtgtggctactgcaagtttctgaccagtgtccttgtacttggctgatggtggcacaggctagggtgtgtctgcccagggctgctgagccctataaacctcgcagtggggtgcaactcttaagggacagctcttaagcccccaaagtccagcccacatctgcctctcctctcctaggctctgactcactgggatgtgaacttagctccttgtcaagctaggcttggagggaggggccctctcaggaggcagagaacttcagtgccaatggcagaggctgcagacattcgctctggccacctcaggaggatgcactactgcaaaactccaagaaataaagaactacaacctgcgtgatgtcacagctgtgtttgaggggagacccagagaatggataagcagcatagtgtccacaagagctcagaagccaatctgacttgacaaagacctcacttacatcatttttattgcagctctctacctctggtcagtttctgagtggaaggccgtcacttccatgatgtatcaatatcagagtcttccacctctccaactaatctcatgctctcttccgtgcaaactctgggctccatccaaacaccattattctcagttcagcctctgcactgaccaatccttgtgcctttgaccttgtggttcttttgccgcgtcctcccccatgactccttccagccaccttcccacttcaaggaaccacctctttctcctggtggctcactaagggctctgcagtcttgctcccatgtattgagtggctagagtcttttccccaacaggaaggcaggttgcttggtgggaacactgccactgtgctgttgacccatgcctgcaccctgcctggtccttcagggtcctgcagctaccacctacctttccacagctgtcggagtcatgctggtcagggcaggagcacctggtgtggctttggaccgctctgtgaaccgggagtcaaacgctttcatgggttcgatcttggacggggtcgttaacacagaaggtgacaatgcagcaggagtagaggtagcattcatactggggtgaagaagaggggaggcatgtcaagcgcaatcctgaaaggatctggaggtctagtatttgcattatttggagcctactaaaaaaggcacaaatatcaaacttccataaacacaaaaaatgtcaagatacaatctactactcccatttctttaaaattttcatgtgtcaaaattatggacacctagaaggttgtgagcaaatgcattcacatttccccctttgcactgttctgagagcttttgcgggtagaatgaggcctagaacatggttcttacaacccttttctctagtcacactgccctatctccacaacttaaatacagcacctctaccccaaaccactccagccactcacctttcccactttgacaatgagtctcatgagataagcctgcacctggggtcctgaagccatggtctgcttttacccttagtcaggcatcctccatcctgagcggcccctcccatatctccctgtgacagtgtcacattcttagcattatgctccaagtgctcatcacacaactttcatcttctattccacagagaaaggagaggccaggcagaagcctgcctggtccatccttcatgtccaagcccacaccacacgctttgggaccatggccactggacctcctcctaagcacacccaggctaacaccttccactcctatctgcccagacaccacaccacatgcctggtagtcaccctggacagccccattcttctcctccatgatctgtggccactagaatgggccatccccacagagttctcagatctggcatggtctgtccttcccaggctcccttcgtcctggcatgctttgcttcctcactggtcttgctgctcagtcttctcttcctaccctctcagggtccccccagggcagtgacctaatgtttgggcatgccttcacagccatggtgctagcacccagaagtaggaggctgaagtaacataagactccattccaccaatggagaattgctctgacggtatcagctgtatcccagaagcagggggctgcagtaacacaagactccattccaccaatggagaatcgctctgacggtatcagctgtatgtgccagggagtggcctatttggggcaccaccgcctaacagagtcactttcctaaaatggagatctcaaagccttctacgtctccactctggggaaaagcccagactacctgatccagcacagacaccttggccttctccctcttcttggccttcctcaggggactggggggctgctgcccctaatccccaggcctcatcccctggtaggcctgtatgagtcctgtggagggtaccctctgaggcacctccctgatccctgagataccagcccctctttggatggctagccatttctatccaggggacctgaggggccacctgcaaccctgtggctacctctcccccaccagcctacacactccctgaggatgaggacccacccattaagcccctgcgatgcctggggcctagcagggtgtataacccagagcaggtgctgagcaaacgttcactcctggctttcatttgtgcttgcctggttctttctgatttctaatttggtttccaagtaacaatgggtgaggacacaggctctgtgagtgaatataattctgagagtataaggggagtctgtgccctcccacaggagaaccctgcctaagatgaatgctgtgtgatgtgctcagcagagtgaagtggaagctgaggccccagaaatgtgaagcacctccagtgtagagctgccaggtggggctgaccctgcagcacgtagcatttcactggtagttcccacccttagcagcctgaccctcggtcagccttgatacactctgtgaaatcctcaacagtcctgtgcatcagagactcactgaacaagtcctcccctctgagaagtccccatttcaaatcacgcatttttttctttcttttttgattgaaggggccacaaagtgcaaacagaataaaattctctgtcctcaaaactatgtgcaaacctgaactttccccagggacaggaacaagccttggcacccactaacctgtctttattgacagaatcgcctgcaggtctggcactggcagccaccacaggctctgtgcaaggcttcgaggcgccgaaggagttaggggtactggagtccagtggcagtagctgtggactgctatgagaagagagcatggtgcccgccagggagcccgagagggggatgctgttaaagaatgccgtggagaagtccctgtcatcaagtaagaacaaaagtcagccttgaaagtcaggtgccacatccagtactttatacattcaaataacttttttctaggtccaaaggcagtatgttttcatgatagaaaatctgcaaagttacagaaaagtaaaaagaaaattaaagccacttaatatactatatttaattgaatctaggatttacaggttctatatgtactactaagaaagaaaacaatgctactaattgtcagatgccattgactgtacaacacacccaaatctcagaggtgttaaactgtgcaaacacatgtcttaggaggaatgaaatgcagcaatacagaaagggcctccctttcatgaagggccatggggcatgccactagatgggtgtgccataatatacctaacccagcctctactgagggaccacaagactgtctccagctttttctagaacagatgctgctgcaccaggaagcaaggtattgcagtgtcagaactgaggattctgggacagccaggtctgactcctctgccatttgttagcttgtgacttgctctaactactcttgtgcctccagtcatgtctgcaaaatacaaagtgccaggactctccccatggggttgctgtcaggactaaagcagttggtgtaggacactcttagaacacacattggctgctcaaagaattatgaaattctaataattgtcattacacctaagattcacataatatatgggataaattcttagaagtggaattgtagcagcaaatgaaatgttcactgatgatttggaataaatatttctaaagtgccctcctcagaggtttaaattacaagccatgtatgagagcgcctatttctccacataggtgcttagtaacacttttatcaaatttcttgacacttaacaatctgacagaagaaaaatggtatcttattttgatatgagtgacgttgacattttttctttttcttttttttttttgagacagagtctctcccgccgcccaggctggagtgcagtggcgcgatctcgcctcactgcaagctccgcctcccgggttcacgccattctcctgcctcagcctcccgagtatcccgccaccatgcccggctaattttttgtatttttagtagagacggggtttaaccgtgttagccaggatggtctcgatctcctgacctcgtgatccgcccgccttggcttcccaaagtgctgggattacaggtgtgagccaccgtgcccggccggcagtttttcaaagtagaaatacttgatttccggccaggcgcagtggctcatgcctgtaatcccagcactttggcaggccgaggcgggtggatcacgaggtcaagagttcgagaccagcctggccaacatggtgaaaccccgtctccactaaaaatacaaaaattagccgggcatggtggtaggcgcctgtaatcccagctacttgggaggctgaggcaggagaatctcttgaaccagggaggcagaggctgcagtgagttgagatcacaccactgtactccagcctgggcaacagagtgagacttcgcctcaattaaaaaaaaaaaaaaagaaatacttgatttctttttttttttttttgtgaactgcttgttcatatgctttgtctactgttttgttattggtctttattactgatttgtaaaaatcatttacatattaaaaaaattccttatatggtaggaaatattttacctgggatgttgtgtttcaactatttatggcctttttttttgagacgaagtctcgctgtgtcgccaggctggagtgcagtggcgcaatctcggctcactgcaacctctgcctcctgggttcaagtgactttcctgcctcagccttccaagtagctgggactacaggggcgtgccaccacgcccagctaatttttatattttttagtagagacggggtttcaccatgttggccaggatggtcttgatctcttgaccttgtatccatctgcctcagcctccgaaagtgctgggattacaggtgtgagccaccacgcccagacagcctatcttttaaatgcactaaaattttaaaatttttgtgtactctaaattgtcatttacagaaaacacttttttgacctctgagattataaaaaatattcttccagggaatcttctaaaattttaaacaaaaatattttaaataacaatttaaaaagaaacaaactataagctgtttagaatgtatgtaatgataagttatgaggctgggacccaacattgtttctaggaggtgccatgtagtcctgtcttccatttaccgaattagccaatgttttatcactgatgtgaaatgctacctttaaaattcccataaatattcgggcctgtttcctcatattctatcatattccactgcactatctactcatgtgtcagtatctcactgttttgagttatgacagcttttaagtcttaatttctggtggggctagtcttccctggctaatcttctttttcagaaatatttcggccattcctatttatttttccagataactttattttatttatttatttatttgatacaaagtctcactctgtcacccaggctggagagtggcactatcttggctcactgcaacctcccaggttcaagcaattctcctgcctcagcctccaagtatctgggatacaggtagtagctacagtagctacaggtgggcaccaccactcccagctaatttttatatttttagtagggacggggtttcaccatgttggccaggctggtctcaaactcgtgacctcaggtgatctgcctgcctcggcctcccaaagtgctgagattacagttgtcagccactgtgcccagtcgatttttccacataactttatagttaccttgtctgattcccaaaattcctacggttatttgtactggttaaatttataggctacaagagagctgacatctttatgatgccatcctagctaatcaatggtatgaatttctagttatttctttgagttttctttgaagcctctcagtagggtttttaattttttcttcattaagatatgcatctctggttgcatcctagttattttatttgtgaatatgacttatttctttatgtgctctgagggtagttggtgctacctgacttcatgttgattgtatcctgccatgtgactatcttctttcattgcctatggcagcttttccagttgattctcttataaaccatatcatccttaaataattatcctttccaatttgttctttcctttgactaactacatgggctaggacctatagaacaatgttaaattatagttgcaagagtaggcatttgtttagtttttgaacttaatttgaaataagataatttatcaagttaaggaagcatccacctattcccatttaactgagttttaaaacaacgttgaattttaccaaaacgcctattaagcatcgatgagagatcatataattttttttcttttgatctactgatacgtagaattaaatagttacctaaaatttgaacctccttactttcccaaaacaaacctcacttggtcatggtatattagccttttaacaagcagtaaggttctgtttgttactattttacttaggattttgcactgacattcagaaatgagaatgatcttgaatttattatgttttatccttgtaagattttgatatattatgttcatttcaaaataaaaatttgcacatttcttctccatgcactagaatatttaaaatggtattaacagttacctgagttacctgttccttaaaagttcctgaagtttccctgtgaagccatcttagtccggtggctttggtggggttaactctgtcctctatttcttccacaataatttttcacttttagtaattttattttcttcaaaaaccatccactttctgtgcaaatttatttgcacagagttcagcaaagaagtctctcatctttttgatttgtctattatttctcacttatacctactttgtatatttatgctttttctcttctttcttgattagctaagctaataaggacctatcctgttgctacgtgttagaacgtgggaatcaggagggcaaaaagcttttaataccaaaaggatcaggtcctgatgctagaaatatgcatcctatgtcagaaagttggccccagaccagttaggaagccacctacaccttctcaccaggtaacgcctggaaggatccacagaacaaagtgtcaccatcaccaccaccacctccccatcccacaggcccagtatgttcagagctcaaccacacactgggtctcacttggtctcaataaaaggtaggtaggggcattaccccctacagggtcacaataggaaaaagacttagtcaaaagaaaatgagtgctctgtggggagccagcagacctggttcttgctctactcgtggggacctcagagcctgcacatctaacatgaggagactggatctgtacactgtacgagtgaaggtttctttagacaccaaggaagatttggaatagctcgtggatggacaactgcaaaacgcagaggcctaaagtgtgtggcctccatgaagggcttacaaatgccctgagcagatagacggaatgagaataaaacccagagtgaactgccttgacagtgggggtctatttctttcacacagtgctttatcatttttctttctttttttttttttttttgaatcaacacacatcattttgggaagattaaccaattcaaaaacaatcttcactatatacactgggacaacagcaagtggtgaatgagtctcttcccccttctctgtcccccacagggaaatatgtttgggagccctactctctgcccagtaattccacttctagaagttatcctgagagaacaaccacaggtgagctcaaagactcatttataatcacgagaaactggacacaaacacaagtctacagtgagctggctaagcaaatcctaggatgggaatctggataatcagatagcaaacacctcagaggactagttattaaaatggatgaatgggcatgaaacagtaacgagtggggaaaaaaaagactggaaatacagatataaaaacattaacagtgactgtatctgattatggataatgtttttttcttctttgggcttttactattttctaaatttaaccatgtgtaaatatacctttcataatcataaaaataactttatgaaagaaaaaaaagaaaaaaaaaatcagcctgactgactgctttccttgtgcgtcctctggtgccctggcaacagtgaagtgcagcagatgtgctggccgccttagcactcccacccctcacatgattcaggtgtgcacaagggctccaggaggagtatgggctttgagactgcgggaagctgagcttcacttccttgcttccatgttctaccagtcaggttgtgaaggacccgtgaagatcctcactgtgaaagtgttaaccgctgaaagaagacaggaagatctcgccagataagaccatgaaaggggaatgaaccagtacccagtgtccagctgtgctatgcagagaggcgtgattcttctccggccatctgctgtccgagtctcaacttgtttcttcaaaagattctggcaaagcagagttacataaatgaatgcaaaagttttggccaactatttccaaatattaaaaaataaagtctctttttttcctggtgataagaacactaagcataagatccaccctcttagcaaagttttaagtatgcaatatcatattgtgaactgtaggcactatgctgtaggggagatttctaggacttattcatcttctataacttaaactttataccctttggctaataactcccattttcctctgaccccagtattcaccattctattctctgtctctgtgagtttgactattttagattcctcatataagaggtatcaggcaggccaggcacggtggctcacgcctgtaatcccagcactttggggaggccgaggtggacagatcacaaggtcaggagatcgagaccattctggccaacatggtgaaaccccgtctctactaaaaatacaaaaattagctgggcgtggtggtgtgtaactgtaatcccagctactcaggaggctgaggctgaggcaggagaatcgcctgaaccagggagtcggaggttgcagtgagccaagattgcgccactgcactccagcctggtgacagagcgagactccatctcaaaaaaaaaaaaaaaaaaaaagagagatatcatgcggtatttgtccttctgtgtctggcttatcattaatttgtacacactaagtatgtataactttttatatgtcaattgtacttcaacacggtaggtttaaaaataataaggcttctaaggaaatgtattctaaattgccctcctggtacaactaaataagacacccaagcaaagaacaagcagtgggtacatgccacactggccgcctcgcacaacagccatgggaccaatgaaagggctaaaggactgagctctgtacccgtgaaccacacatctgtcactaagctagggattttctttctttcttttttttttttgagacagaatctcactctgtctcccaggctggagtgcagtggcgcagtctcggcacactgcaatatctgcttcccgggtttaagcaattctcctgctcagcctcccatgtagctgggattataggcatgcaccaccatacccggctattttttttttttttaagtagagacaaggtttcaccatgttggccaggctggtcggaactcctgacctcaagtgatccgcctgcctcagcctcccaaagtgctgggattacaggggtgagccactgcgcctggcctgaggtagagattttcaaactgactttcaaaatagaatccttccttccacagaaagcttgtaactaggggttttctctcatactttatatctgaattgcctggaggaggtttgtcagcctacacaggctcctggagatggtttatactccccaggcaataacgttccctacccttttcccgccccatttccaaccccttcccatcaaacatggcttccagatgaagaagggggagcccatagaagtctcctaagggcagagcctgaaatccactgttgttagcatctaggatttttagaaagaccagaaggataaaattcgtaagttcttacaagagatgacctcctctgggctcctggggataaggaggcctttgataaagaggatccaggccccattactgcatcatgcagcagtgggcaaggggccaacaggcccgaggctggctaacccacagatcccgtaccactctaaacaaaccccttccttaccaccactggtgtctgcccctcaccctgtccctgggcatatgtccatgtctttagcgccaccaggcagggctctcaccttcctgatatcttcaagactctccccgttgacaacgcctgcgactgaggtggctgagcccatctccctggtcgcagcactcttctggtccagctgctgctgctgctgccttcgctggtacttgagcatctcagggttctcaatgacggctgtggagagctgggcctcggtcatgatggctaggctcttgccataggtggactggtgaatgcggctctggggaagcaaggagaggcatgacatgccagcatgagtgccagtgtggccagtgctgcccaccagcaggcaaactacagcagggctctcctggctctgagtggagaagggacccaaggccaactccccatcgcctcccatcctattctgcctgtccctcattcgacagctctgttgatgtctcatgcccacccttgatttttatggcctcccttgtatctgtagctgggatgacagtaaatgagacagccaacaagacaacacctgccccacagtctggtggagaacaaatgacaatccacagtgcttcagtggaaaggaagatactcaaggtgctaacttaaggctcttaaatcactcctaggacccaaatgattttgggaatcagatcctagaacaaaagtctactttcacagctcatctgcagccataagccctgtggttggaagtccccattggcctgcttagtgtctctaagagtatgggaaggcctggcacagcagggctggggagcctcctttactcccacccctcctagtatgtcatcatactcccctccttctaggccctcatagtcttgtgccctaacaagctagacaggagcctcatgagagcagagatggtgtccccagcacactgtagtgactgctgtacatgaaagtgcatgaggaacacacttccatgggatgtgcaaatgtccaatgtgggattctgctcaagaacagggactgtggttaacaggacatctgctttacagcagagcatgggttgagaggcagcgttccaagagaggtgccttgggacctgctcctgcagggcttgaatgtggccaggaacctccttttcttgccatcttggctcctgcccttctctcctgagtctatcccctggaatctcgaagcagaattcagtgtttggccagggtttccctagtgttcctccaacatggagtcccagcctgacttgggaaatggtaagcagatgggttattaggctcccagagtgactccaagggagtgcatagtgatcccaggtacctgatgacagtgacaaggttggaggaggacctgaggcctctgagatactcattccttcatggaaaaatgatggggtggcaggccccattctaagtgtagtcattaaggcagacctctcccccaaaggggttcacattttagtggggaggtcacactgtaggttaagaggaagcttccaccagcaaataaggtcatgaggagagctgccagcctgctctgggctttcacagagctcccttcagacacatacacacaacccaccaagtgggggcaggtttctaagcctctggtaggtgaagcagggcttttctcaaagcctggcagaagggcagagagaccccatcaccccagcagagcacagaggggaggcagcctggcccagaggcagcaggccttgttcactcttctgacctaagggtcacatacagtctgggcaaagagccatgctattttctgaggcttagtttccatatccacgaaatggatgagccttgccttgaagggttttgtgcaatttaaatgaaatcatatgtgcaaaacacattcccagagcctggcagacaatgcgttctaagaaatgaccaatattactaccatgaaggtgaaagtgacatgagcaggggcccctgaggagtcacttcagctctttcccagggcaaaaacctcccagtggatggcctattatcagctcaaaaagagatgcctaaaatagttctactcttaactccaggacttatttctgaaatggggactcgttttttaattaatctattttgtaaagaaggattacaagatataaaagatgaataccccattacatgttaagaaatgacttgtctgtgtatctcacaagaagagggtgtagtcaaaggggtctctcagagctattgtggcaatggccacagagcacccagcagcacaagagccgtcagcctaccttctcctcctcgctcaggggatcgccaagctcatcctgggagaagtcgaggaatgccacagagccgtccatagagcataccaagatgcccagcccattcagagtcctgaaagacatggccatcagcagcctggtagcaagagccccaggcagacacatgtgccgcagtagctggcctgtgaggatggtgggcagtgttctagggagatgctggaaactcctggttcccttctgtggcctggttcccttctttggcctgggcgggggggggagggggcgacaattgtatcccaaagggccctggtgttctttagctctaagcaggtgtacaaaatatctcctttaccatatgttctgtaagaattttcaattttacttatcttacttttgaaactattaaaataaaaaaaacttgacaaagtatacatataaatcaggtcactgagaagcagaaagtgtgcttctgactttggttcatgcactgacggagtaaagtggaacatactaggatcacgtcattctcctcgtcttagacaaatcctgaaaaggcattttccagtggcaaattctacacaggcaggacattctcgcagcagcaggtacaccgctgccagttcccaaatcacgtgcaaacagcactcttggtctgcgctactatgacacctggggaggggccactggccacctgaccctagtcacacccagaaggcctcatgttccaatgtgtggcttctcctttcttaacctattcctgtaagtagaatccaccttaccaggaaatatccatgatggatttgtcaaacagttcatggatgaccaccagcggccgtttcagacatgtgagctggaaggaaagacacagtcaaggttaatgaaattactgaaatccccttctgtattcagctcagttaacataaccaacctagaagcctgggtcaaagtggctgctgatatttaaggcatcttcaactctattcaaactgcagctgcagagatcccaaactgtgggaaccaaagcctgccaaaaatgtgcatgctacctagagtggaccctgcctccagggcttgctgtggtctgacaggggaaatagctttatacacagataactagcaacagagaaggcagagtgggagtgggtttctgaagggctatggtcggaggagagggacagccccagggtggacctctgagagggtctatggagcaggagacacgatgccaaagcctagacaggggatgaggcaccctgagagagaacacaacacatcttccctgggcccaagggactctggtacacatttatccaaggctcattctacactatgtgtaggtagtacagaaatacacacctgggcccttaatctgggcctagttaccgactattaatactttgatgaattattatcttctattttgtgcaaatatttattttattcttcaaagtaagaatttattttattcttcatagttgtgtctgttttttcatttaacacacaataagtatgtcattaaatatcctgtaaaagtctcttctggatgactgcatagcatgcactgtgcatattctctatcgagtcactcaattgctggcatacactctgactccacgttcccacaactatggtaggcctttccacttgtgcacaagtgcctggctaccctgctggctggccctgaactgcaggacaatgggcagggaagaaacacacttcctcacgggatggtgggctcccataggtgctgctgcagcttctgggaggctgtggggctgagcgtcccagtgcagcctgagactgctatgtggggaaggagaagctgtgtctaccctagtggtggagagggggctgaagtctgaacgatctggaacccacattaagaatctcgcctccaccttaattccacttctagaaaaagctgccttgtccctcctctcataaatgtgcctacagacccctcagaaatctacaggccgtgtgactgcctaacctgagcattctaagaaatatgggcatcacagtcagtgatgttttggttgcagcgccacaaacagggcctctggctgggaggaaacagggaaggtcccctgaacggcaatctgtggtactgtggttcaggttccagaatgggtgttaagtgaatacttggcctaaaaaaaaaaaaaaaaatcacaacgcacacagtaatatatttctctataccaaactaataaatgcagccagaggataaccttcaaacccagaacttccaacttgctctgcttatagggacacttttttacaaaatgaaaaaaaaaaaaaattaatgtgtgtgcactttgctttatcaaactttaaatatattggcaccttgatgctcagcaccaagactgctccctgcactgcatgcggaggtgtctcttaccacacagtcaggtcacagcacaccagcccctggcagtgagaaacttaacccttcaggagccctcacttagaaaccgccacagttcttacccttgggttctcactcgccaactaccattgagtatatctgctgagaacctgctctgtagagggcactgagttaggaaggtgaggggaacaatgaaactgaagacacatcgggctgggtgtggtggctcacacctgtaatcccagtactttgggaggccaaggcgggcggatcacctgaggtcaggagtttgtgaccagcctggacaacatggtgaaaccccatctttactaaaattacaaaaaaattaaccgggtgtggtggcctgtaatcccagctattcaggaggctgaggcaggagaatctcgctcgaacccaggaggcagaggttgcagtgactcaagaagccaagattgcaccactgcactccagcctgctgggcaatagagggagactctgtctcaaaaaaaaaaaaaaaaaaaaaaaaaagaagctgaagacatcgcctcatctcaggggatccagcgagtgaggagtactaggctcacaaccttacccatcacagcatcacccaggggtgaaatggactaataaaggcgtcagctttctgtgtgtctttttctgtggacataagcacttatctgtcttggttgtatgcctaggagtggaagtgctctaggtcatatgcttagctgtggtagaaactgccagacagttttcccaagtgctcatgccagcgtaaacacctgtcagcaacacgtgtcagcaatgtatcagttccagcttatcatgtccttgctgacacttggtactatttttttgtttttttttttaattttagaactctactcataggtatgtactcataaatgaaaacgtacatccacataaagacttatacaagaatgttcatatcagctttagtcataatatctcaaaactggaacaatcttaatgtccatcaacaggagactgtataaacaaattgtggtgtattcatacagtggaatgctacaccgaaattataaggaataaaatactgttaagtgcagcaacatacacgaatctcaaaaacactgtgccaagcaaaagaaatgaagacacaaagaagcaagtaccacacaattgcatttatatgaagttcaagagcaggcaaaactcatcagtgtaacagaggccattagagtggttgctttggtggtgagggaggtcttgactggggagggacaaagggacaaaaaggagtgctctaggcagtgatgacactggtgtgtaaacatgtatgacaactcaccaaactgtacctttcaggtgaatacactttatataaagatttttctttttcttttttttttttttttgagacggagtctcgctctgttgcccaggctggagtgcagtggcgcggtctcagctcactgcaagctctgcctcccaggttcacgccattctccgtctcagcctcccgagtagctgggactacaggcgcccaccaccacgcccagctaattttttgtatttttagtagagacggggtttcactgtgttagccaggatggtctcgaactcctgaccttgtgatccgcccacctcggcctcctaaagtgctgggattacaggcgtgagccaccgcgcccagccatataaagatttttctaataggaagcaagcccaacatgctgctcatggcattgaccactgagggtgctgcctgagtctggacacaagagctggtctaggtgggggtcaaggtggcctctcctggctgggcacagacccagtcttcagcacttccttctgggagagcaggagagcctgtgagcttccaaggaggggctgaccccaggtgcagaatagaaatacactcttagcatcacccaaagcaggtctctttcctccacttgctactttaccaacctacacctcccgtcctgcaacaaaagctcaggatagcaggctcacccagacagaaagcgagcggtccttgctgccaacagcacagcagcagtacgggcagctaggcttcgcagaactcccattcttctgcttctttttgaagatttttgggttgaatttctaaagccaaataacagatgttaaaaataattaatcaagcatcaggcatgtcccctgtgcccaagtcccagcccactgaagggagtctcccacagacattctctgagcccaggcactgagcatgcatttcatcttcccgaccacctatgaggcatctggctgatgatggaaaggaagcttagggaggtcagaaagtatgtgcggaggcaccaaatgagtaagctgggaaatgcagatttgaaactagagctaccaaactctccatttctggagcttgccaagtagaagggatgcgtagctactgaaactagccttctcaattccctctggccaggcagggccagccctaggacctgcagaaaagctgagcctgcaagggggcttcagaaacaaagacctactcactccctatctcctaagggaggccaaggggatgggcaggaggggtgtgaatctctgaattccttattgcctcactgcatttgttgttcagtcataaccgtctagcagagatctgctcagtcagagagtcatttgtgatctccctgggccagtgaccatggcaatatcacacaaaggtgcttggttggctgcttagtccagggaactaccccgagagtaacttgtctttgtttctgcaaaggatgaaagcactcactgagctcccagacaccctcctggatttaaaggggtgggcgctctgggaatccccaacctaggacaactgagggcagaagaaggagggttcctgaaagcctggtgtcaggtagcctagagatgttttaattccagagggcaggcaggaatggccggggtgcacagagactggagaagatggaactcagaggcgtgtccctgggcttgctgtctctaacaccaatgaggctgcagggccttaggagctctgtgagccataggcaggcgtcgtgatctcccagagctgctaataaagtggttgtgaggactgcatgggagaatcacgtagagcactaaccatgaagcactgatttccaaagactttagcaacaaagctctggttcaaacaaaaccctacatgaactccaaaacaaaaaaatttaataagtaatattttattcatataaaatttgtgttttaaggtacaatatatgatacttattatctttttttatttttatttttgagacggagtctcgctctgtcgcccaggctggagtacggtggcgcaatctcagctcactgcaacctccgcctcccgggttcaagtgattctcttgcctcggcctcctgagtggctgggattacaggcgcatgacaccatgcccagctaatttttgtattttcagtagagacggggtttcatcatgttggtcaggctggtcttgacctcctgacctcatgatccgcccaccacagcctcccaaagtgctgggattacaggcatgagccaccgtgtccggccgatacttattatctatttaaacacgggcaaaagtgagtctattttcatcagggtcttggatgatccttcacttttatcaaccttagtccaccaatctgtttattttatttggctgcccagtgttgagaaaatcctggttctcacagattattcgcaactacttaacagcttgccttgggctctgtcaggacactatttaattaaagtcatggagaagcataagacgagtggccagacaactctcatgcctaaggactgacagcagttcacgcctctgagctcttcacctgccgcagcaagatctggcagcagctcccaactcagtgatccatggcatggccttgcacctgtggttgatgctgccaggtgtggggacaagcacagtgcttggtgggtataccagaattgtacctgtattcactggagccaggtgagggtggcaccgtgcttgggcaccccaagcatacctgagtgtgtaaaaggctgatgtggagctacgatgttcctaacccaagactgattttggtgatgttcacatgtaaagtttgccaataaatcaaccaagtacatactctattttgtaaaattagcttttaaatatttaagtataactattcaaaataaaccaagaattaatatttgctgaatcttggagcccatctccctttagttccctgggcactcaccacgacagtcacagctttccggtgcccaacaaagtccatgttggtcttccatccctcccgttcgatgatctgggcagtggggcctgagttgttcatggcatgggcagacaccaggtaatgcccatcaggtgaccagctgagccgcaacacatgggtcgttcctccacactgaaagaagcatctgcacttgaaaggagctcaaggccacctttgtgaccaaaactctggcctcgaggataaagttaaacttcaatttataaatgtgtgatggtggagcatgcaccccaagcttctggctacactgacagcttctgtctcaccagatggcccaaccaaaaagggctctgtgaaatgaatttggaaactgcagcatcctacactcccccagaggagctgaacaaagaaatatagtacagaagtgtatgccctgaggagatctgcaggaaggctacctgtttgaaccatagcctctgcatgggccaaatctctctggccactgacccaattcttctgtgtagcacctgttaacccacagcatggcatctgcacagcatcctcaagatatactctggtggagaaaaagccctttttaacccaggagcctggcagaagcctgtgtctgtaatgtagctgatgactgtgaggcaccacctactctcttgagcctgttgcctcacccaaagggtggtgaggatacccgcaagggagaagaggtttgtaacatccttataaactataaaaggaacagtagaaaggcactgctcccccagtctggactgggggctgaggcagagcatccctccacattatccctcctgcaaaaagagatgacatgggtccagagccagctccttgaagctcaaggtgggcccagggcagctctaaagacttaagggttaagatcatgacctcacagctctagagcaggacatgacaaaccagagcctgagtatagtgaaatcacccacctcagctctcagcctaggtgacagaaccaccccctacctggaaggatgggcccacccagtagaggctgaagagtactaccacctcctgctggtactcaagacactcctaaagccgtccctaggagtccacctcatgggaccccactgcctggcagtcagagccctgaggaactccagaaggagcaaaagctccttagggcaagactaagtaaggtaaaaaccagtactcatatacctagcccaggagctggtgttgtgcgggaagaactgaacatatgactatcactttacttttgcagccatcctgaccagtgggcaaatgcgtgctcttcctgcaaaccttccctcatgtgtccctcgctctgtgaagtctttcctgatgcactcacctctcctgggctgtttctgcactctggacaactccattatcatgcaactaatgggaatgcctgtctttcctatggggctttaagcttcaagaggagagactccatctcaatccacttttatttccctgtgcccagttattgccttctatacagtagacacttaataaatgtctaatgaacaatggtgatcttgagctctcattccatttgaaatcagaactcaaataacggaagagagattaaaataccagagaagctactgcagtctgatctccaaacatgtgcaaactgtactgctaactccagccaggaaaaaaggcccctgaactgcagggtgcatatcaacaagcacagcacagtcgaggatggcacaagagtctcctccatcctccccaacaagctgctctgcgggaggctcagagtaaactccgcactataagaagcagttttatccacgtctgtgggagtgagctgggtgacagaatgatgtggagacatctctaaggttcacttcaactttaaacctataaatccgggccaggcgcagtgactcatgcttgtaatcccagcactttgggaagctgaagcgggtagatcacctgaggtcaggagttcgagaccagcctggccaacatggcgaaaccgcatctctgttaaaaatacaaaaattagctaggtgtggtggtgggcacctgtaatcccagctactcaggaggctgaggcaggagaatcgcttgaacccaggaggcggaggttgcagtgagctgagatcgtgccactgcactctagcctgggcaacaagagcgaaactctgtcgccaaaacaaagcaaaaaacaacaaaactataaatcccttttatttcaaagttggaaattaaacagcgtctcagaaatgaaggattctgtattatctgactcttagggccagagtcccaccccagagagccttggtgaatccgctcaggcccccggactctgtgcattccccaggtggcctggcccatggccagctccctctctgtacacagaagtcaggaagaggctggggcagctgcgggggctcagctccctgagctgtccccacttacctcatcaaaaggcttggtgatgctggtctccaactgccagtccagcgtcctccacacctttaggctgcggtcatcagcttgagaagctatgtatttaccaacagggtcccatgtcaaccctttgaccaagccagaatgacctctcagagtagctagaatttctgtgaagaaaaaaggaatgtggagaggtgttgtctgagggaaacatgacctgcaatccatgggccatgggatggatatgcaagagaggggactcagcagtctgccatggccagcccccacaccagacagaagcagaagggcctcctcatttgatctccaccaaggcaaaagccaattgaagaaatgacagcatcaaggaggcaggcaccaaggggctagttctgatccaggtcttatctgtatctagcggccctgcctatggctgcccttcctgggctgtgacaccagcacttctgacgttagcctccctggtagctccctgataaggaggaggcctactagctcaaagggcctgactgtggctgagtcttttataagttatggctgaagacaaaggtgtgtacgacggtaccccatatagatctgtaatccaaatgctactccggtctctaaagcttccctctccatagccagactgagtgtttccacacatgctggtggctttcaaagagttaaaatgacctggatccataaggaaagcatacttcaaatacagagctgaaatatgagaagaattttactagttataaactgcagcactgtgccaggttatgccatctgttgtgactttaaacacaatgaataagaaaaatcaatcttttgcaaaactgggtttgtgttagcccgtatctgctcaagggtttcacagaggagatggtgactgagctgagcccagagcccagtggtgggggtgcacacagcaggtttaggagcatcagggtccccaacaacagctgcccatccattaccctcctgatctgtggcatgccatgctagcactcagttaccatttttcttaagcatgaatctctttttaaagcttaaacaaatgtaactgacaaagaaaaactgacaagacacataaatcctaggccactgtgacacatctgttgccaccaagactaaggagacagcccaacccctgctccagaaactgacaggcagtactgcttgctgttaaccagtcagaggaggccccagacctgggaactttacagcattccagatgacgacagtgttatccacgctgcatgaggctagccaggcatcgtggggagaccatgctacatccatcacatctgaaagaagacagagggttctggtgagatctcttacctggtgatgcccttgtctattagcttggccagtgcccctgggacctgggaccatcataaccactctggtattttttaaccaacctgaaaaaactccccccagaatttttcaattggtcataaatttaaagcatctaaccgaccccagtgcctcactccttttacagacgaagcaactgagggcgtggttcagagcttgggcaccatatggcaccacacccatgcatgagagcctgctacttcgtgggtctgtggcctggagcatgctcctcagccctgctgacttgctttgccaatcataacagggccttcctccgagagccttctgagcatgagacacagtgggtaaagcacatggcagaatgcctggcacagtcagaactccagggctgctgacaactgaacacaagtcatcttgaggccctcgtctggttcatggactgggtctcatctcccagaccctgacaggagtaccccttcactatggagcctccaaacagaattattcacattcacttctttgtgactccattttatcatttgttaagtgcagattaaaaaacaaaatctaggccaggtgcagggactcacgtctgtaatctcagcattttgggaggctgaggtgggcagatcgcttgagcccagaggtacaataccagcctaggcaacatggcaaaaccctatctctacaaaaaattggctgggcttggtagcacatgcctgtatccccagctacacaggaagttgaggtgggaggatcacttgagcccagggaggttaaggctgcagtgaccatgattgcaccactgcactccaggctgggcaacagagtaagaccctgtctcaaaaaacaaacaaaaaaaccaatgaaacaaaaaaccccaaaacctatcctcatagggtcactgtaaggattaaatgtgataaactgctgcaacaccatgccaggcacacaccaaggcatcgatgagggtccgctgtgacgatggtgccaaccttgcctatcctgccatcaggggtgaagggcgcagtcttagttatttctctaacctcagcgcctggtgcagtgctaggtatacagaagaatgattggtgagttgaagaaacaaacatagcagcaaggtaatagctatcaagtcctttctttgtacaagaggtttaagcaaaatattccaaatatctattgtattttttccagttaaaaaaaaactatagtaacagcttaacaggtttttttttttttttcaaattgtctcacatgctgtggttcacattttgtattctaaatgcctatgtgatcttcacagcttctttccttttttgccctgcattctatgtggttgagagtattcactactattaattgacctaatttaacactgaagattaactggattctggttttttgggcccgtgtgtatttgtcactctccatactccagattattactctgagacgcataccctagagtgggaatcctgggcagaatatctgagcatcctcataggtctggattctcataaaactgtagactgcttttccaagatccctgtggttttacatttctacatgcagactgtttgcttcaaaactcccttattagcattgaggatgatgactttttccccttccgacttatttattcaatacaattttatatttaaaatttttaattagattattagtgaaagcgtttgtctcttatctaatgtgtttttggactgatttgctgacttattgtgaccatttactgggaagtgtttcgggcagtgggtctaacaacataaatgcagtgcctacaaaaatgaagaaaacaacaactttctctagtaactgagagtcctggaggggcacacatgcaaacgccaggacagcaggggagtgcccacatcctagaacagagaatatgtggttaggtgggagcccagaaaggagaagggattttcttagcaatctccacagacacatataatgcagctattaactgcaaatttcacctctctacttttttatactgtagtagttttatggagtaaagtctgttattctcctttgtgatttcttctattgccttgttaaccttgaaaaatattctctctgctagaggtctggtaaatattcaattctattttttccttgtgtagttatttagaatgtttctctctttagtatctggtttggtgtgtgctgtatttggtgaggattgaaattaatttctcctcactaactgcttaacagttactatgctccatgtgaggaagaatccattttgataagcgatgcctcctttcacaacacaccaacttcttaggtatactgtagcctctttcagtgttacgagtttaccctcaaacccatgatgtttctatcactggaactttgaatgttttcatccgtaacattcttatccttccagatacgatcctttagaatcactgctgagtaaatccacatacatgacataattttctcctaaactcccagtttggagtttctgtcttcagactatatagcacctcctttttatggtgcatctacacacacaggagaccctcccctcacttgtagatttacatttctggccactgttctcaccatcattcttggtgactccaagaggatgattcttctaacactccaggctcttggttccttaaattcctccttcccttctgatgaccgtggcttccactactttcaccccacggtcatgtccagaggccttccatgacaaatcactgcaatctgtctcaattccaaccttcccacaggccaaccatcagccccgtgctcctagctcaccctcagctccaacagcactttcacgccaccaggaactccgatctactgatgctgccgtcccctcaccacttgccaaccacctggtccttacctctctcctccagctgagagcccaccaccactcccccttttcttctcctccatcttcctacacgcctgacaaagctcagctcctctcctagtgttttttgagtactctccaatgacacctttggcccaatgacaccacatgaatattgcacttgcctaggcccccagcaccctccatgctgtcaagcccagcagtctatccttggtcttcactttgcccctcagcaataagcaatacgctgcctgttcccctctccttcaaatactctcttcactgtccgttttgttgttgttgctgagacagggtctcgctatgatgcccaggctgttgagctactggcctcaagtgatcctcatgcctcgcttcttttcactgtcttaactggcctctccttctagcttctttttctggtttcagctctccaatccctaggctcatccttggactctgctcatacccagaacctcatatttccaagattcatatttccaaatgtctacacagtatgtccatttacactggcaaacttaacatatccaaaaccaaactctgaaaacacttcccttaacaaacatttctgtcccacctgcagacttcctgcttcaggttacagccactgcatcctttccactgtttggaccatagtccgggaagccatcctgactcctctgcttatctcacatcccatattcaatgcaccaggaaatccgcctctgatcacttctcaccacttctgtgttatgactccaaaccaccattgtctctcccttgtttttcggagcggctcctttactagtcttcccagtgcagccctgagacccccatggtagaatccacactgctgccacaggtctcaactcctctgcctagatccctgcggagacttcatattcttgctcagagaagagcctctgccacggtctcaaaggcacactgcctcccgcaccctcctcccccgccccagctcccaggggttcactgggcacagtaagcacatgtccatgctccaaggccttcgcactggctgtcccctcactgccgtccagtcttccctcaaatgtcatctcctcactggcccccagcactcatcttccaactccttacaggactctgccttctaggctcatcttcaaatctcctatactactcactcgtctgtctcttttacaagaacaaatctccttgagagaagaacagtgcctggaacatggcaggcactcaataaatgtttggtatgtggacaagtaaatattaatttgggaaaaaatgtatttcatctagcctttcaatttaggaagccattttctatctctcaatgtcattttgtatcttaaaacgtttgtgatttaagtcttacaaaactaattcatttcttggtaagattacttattcctggatatttataacttttgatcccactctgtataattctctttttatcattagatattctaattggctattagtagcaaaagaccaataatttaaaattgttctgttatgaggccaatataaagactcattttattagttctaagtatttttcagtgctttatttgttccaagagctttatccccctatggtttttcctaatatgaaataatgtcaccttcatttcctttttgccttattttccagtttctatttaactgtgttgcagaaattccagagcaacaaattaaatgacagcacccatcattgtcttttcttgatataaaccgcaaccaggcttaactgtgaactgtaatatttgccactggtttgaaaaagactaaggactctaccatgttaaggaaatagctttaggacaggtgtggtggcttatgcctgtaatcccagcactttggaagatgcaggtgggaggatcgcttgagcccaagagttcaagaccagcctgggcaacatagtgaaaccccatctctacgaaaaaaaaaatcagccaggtatggtgatgtacatctgtagtcctagctactcaggaggctgaggcaagaggatcacctgagcccaggagttcaaggctgcagtgagccgtaattgcaccactgcattttgcctgggtgacatagtgagacacagtctcaaaaaaaaaaaaaaaaagaaaaagaaaaagaaatatcttcctatgggcattttaaaaaaagcatttttaataggaactgatgttgaattgtctaatgttccttttaaaacacctaagatgactgtagcttttcccatctaacttcctagtatgtaaagttatattaatagattcccttgtactacacttacaagtcacatttaatcataataaattactattttctggccggtcatggtgactcatgcctgtaatcccagcacttcgggaggccaggacaggcagatcacgaggtcaggagatcaagaccatcctggctaacacagtgaaaccctgtctctactaaaaatacaaaaaaaaagtggccgggtgtggtggcacgtgcctgtagtcccagctactcaggagtctgaggcaggagaatagctggaacccgggaggtggaggttgcagtgagctgagatcgtaacactgcagtccagcctgggcaacagagcaggactctgtctcaagtaaataaataaataaatgagtaactgctttcaagtgttattatatttactagtattgtttctgatttttctatctttattcatattattctatgcttttgttacattatttttcttaggttttcttgtattttccagatacaataaccctggcttatatcttcctttcaattataaatattgctattgttctgtataatttttcttaaaagctcaaaacaatgcacctacaactaatttagaaccaagaagcatttctgaagacagcctttcatttcttcattggttactattctgttcagtttttcctaatcctatggtatcaattatgaaagttcctattttctagaaaattattttttagtattttgttctttagcttaatagtacaaacattatattgtactgtttgatgatttttttctgtctgggttaaatgtttttctagatctttaaactctaattttgtctaggttttttcttcccaacccccaattaaatataccaagtatatatttctcacactttgcttttcaaagatccggttctttcttattcatttacttctgcttttcattgatttttcttcttgaatggttctgcctgcacctgctaccaggaccagtgagtaatgagtgtcaggtccccagctgaaggtggtcaactctacttgtctggtaaaggagccccactgggcggtgggtaggaaagagaatgcaaggctctggttagggccttgtaaaagtcctcacttgaggcctaccccacacttgggcaccctcatagacatgtgcaccaagttccagaaaagtccaactagacttcactgttagtactgtgacacaagtaagggccaattacacaatttaattatcaaacaataacacaacactaaccgtttcagctttcacaaatgtggactcaatctatggccgccaccaagatgggtttgttctccttttaacagtctacagggaatctgctaagcatacactaacaatggattatagctgatgccacctcccacacctctcactcctgccctgtcctcgcccagagctccaggctcaatttgaaggtttcttgacatttcttcccctacccctcaagccaggggcaactccattctgaactggtatccgtccccataagcctgttgtccttagggtctcagcagaggtgatacctctgactatctaggcatccagccaagaatctatctcatacctctctgtgccctatcctaagtattcccaaatcaatctcctcttctctacctcaattatcacaggcctagctcaggccctgacagtgtccatctaaacgactggaagaacctccacttcactgagctgtcacaatgacctctctgttgtgcttcaaagcttttagtggctccctatctcttccatgacaagggactccctcagtaacagggagcacaagctttccatgatccgactctggcatacctgaccagcctcactttgtgctgctccctgccttgtctataaagatccagccatggtgaaatgcctccaaatccccattcacaccaagactttctcacttatgctgtaccaccctgcctggaaaaccctttggtccattcctggaccaaacggactcagactcctaagtcaagtctaaattgcactcaacctggtatccttgacacctgagtgtacagtgcatgggcaaccttccccctcagtctaaattcataaaatgtgcttctttccatgccaagtttatttaaaacactgcaaacatactcaaggtcaagttgagaaacttttcaatgggcatctgtgagctgatttctggggaataaacaaagtgtgcttacggacttagtgatccgctgatgaaggtactgattctgttcagcaggacaaacagcagaacgtgggaagttctacattaaagatataaacatataccccatgagggcaagagtggggagactgaatgcagctggagacaggtagtggacccggtgactgcacagatcttaagggacaggcagggtgtgactgattgtgatggggtgggacagcccagacatagggctgctttaaggaccaaacagtcccacaggggacgtggcggtgctgctgatctgagccaggtgtcaggggcccacccaccccaacaggcagtcccactcaccgcctgaatgattccggaggatagagacacaccgccactgctccacattggcaagcttaccactggagccgaacacggtgctggggccgatgtacctgtgtgagaaaggggccaaaaaggcactcatggagtgctctgggcactgcatagaaatgctccctgcagccagcttatcagggcacacagaacaaagcaaaaacaaacaagaactggaaagcactgggttgttgaataaaaggggctggttaggtgaattatgatccatgcacttgatgaaatactacacagccattacaaatcttgcatgggaaaacgttcacaataagtgaaagaagcaggccacaggacatcacatacaatatgatatcacttatgtaaaggaaaaaaaaccacatgacatggatagcatctatgcatggaaaatggattagaaggacacacatcccaaaatgtcaaaatattaactgtagctttctttaggtggtgtgatgagggatattttttcttttgtatttttagttttctaaattgtatactaaatgttacttatgttggctatttaaagaagcaaaatcaacagtattttatttttaagcatctcacaatgaatcaaatggctttgacatctgaggcagagaaaccacgcgatctataggtactagcccccaccacaggagccagaggagcatcaatcacctggggcctggtggaggcagtgctgacacaccgatgatcagagcctctgataacaccttttgctcttgtagagctcatcacaaatccacagaaagagtgtgctgagatagccaagtaggctgaagagacagcctctgcctctgctcttgaagccacagccacagggccactcttggtgagcaatggtgcagggtctggtgccccagactgactggcccagagacctgggagcaatagttttccaggtgatggttagctccttttgagagtagagcagaggctgccccaggtggggaccaacagagaataaagtaatggcaaagaggctggactctggatcccctgccccagatcctgggcaagaaccagagcaccctgacttttaaccattttgtatattgggcttccatgtgaaatttcacttgaaaaaacaaaagcaacgaagccccacccacatcggcactagaagagatcagactttccttttcaggtgagagcctgcagtcctgtgagggggcagctgaccaggtctcctgaattcctggtcaggctccacctgctcctgacctacatgcactttccactacttatgaggtcagggctatgggaacttcagtgacagggtagggaaaggtgactttgataaagaccagcaaagcagcttctaaaaataaaatgtgaagaaaggaaaatgatgcttacgtagcccgcttccacaccataatcagtttgtcatctcccccagaagctaaatacatcccactgtttgaccaccgcacacagttcacacatgctgggaagaaaaaaaaataaggtgatgaaaatccagtagtcatgcccatttgctttatgtagagtttggcaagatgtaaagggtttataaaatctaatctatctaatctatttaaggcatctactgtgtgagagccccagaaaaacaattcagtttaagcactaacctacttgtgctataaaaacaaattaccagaacagtctggagggggaaaaatatacattatctgagaatcgttagtgctgaatgacatagtcaatagaaggcttctttctaagaaaatcaaaaaatgataaccaaatctcattatttcaaaagggtcatctattaatgagacacatttctgagtagagattattctcaaaaaaagagtacgtgctaaaaagggtcagatgctttttctagatttttcagatgaacagtctgttacagtataaaactctgacttcatctcatctgtcagagccagccctgtcacattcggattttccaaactcgccagcactgcagattgactgactctgcgcttataagctaagatcagcagaaattcccccaggcccctgatgggccagagcctccaagagcactcacaacttggcctttggaagacctgaaagatggctatcaaagttgtagcccccacatggcccgtgagtaacatgctccaggtctgaagacactgagaggcatgttgagaggacaagaacacacagaggaaaggaaggagctgatgtccaaaggccagtgactgttcattaagcatctcaggggtgggaaactaaggcactacagcaggaaaggaaaccatcacactgtctgatggccaaaagggtcctggcagagagcctcagagtgacacagtaacaacctgagatgttttggcaaattgtctcttgcgcacccttccccagaaccctactgtgtccaggtcgctggccccaaagccccatggaatcaggcagtaacgactcatgagcaggaaatcaccagaggtacctgcagactgtccaaagatggttctgtgggcgggccgagtcttctgctgaataactcacccaggtgtgcagccaacatctgtgccttcagacagcaggccgaggggagttaccgccgcacggggccttatctttctaattacaaacacatgtgctaaccttgggcactctgccaacacgcaaagcctgcaaagggccactctgtaatacctaagtgattgtccatctggcaaagcatcttgggaatattttcatccttctcgtcatcctcctggaggactggagacatattccagatcacaaccttcccagaatcctgccctggaacaaaggagcagaaatggctgaatgtgcaaggagtagaaatttgatattaatatttaatgtcaaattaaattaggagaagtcctcacttagcttccataaacaataattaactagatctaaggagactgaatttaaattactaatttaagttacagaaaagatgataagtactcatggggacgaaacggagcggacttagcagtcagcagaagtcaacctgactttacaaaaagaactttagactagcaatcaggagggaactgagctctgatctggcctctaacacggatccaccaggggtccctaaaaggtcttcatccctgcccagcacctagactccgactccttgactcctcatctgtgaaatgaggagaagggaaagtcaatgtcataagaccttttctgttctgtgtacaccctaaaaagcaaacagaaaagcacaccctagtggggtttccctccccttccaggtgctgcctggaatttaggctgttccagagccgactgttttgagacccaaatgtaccctgaacacaggaaaaatggctcattatcttgttatccaccctttgcagttacctacagacgagagaccaccaaaagaggggatttagggctcccgtggtcatgagttgatgtattgctcggctaaaaaatatacccatgccttttagtaatgatttcttttctttttttttttttgagatggagtctcactctgtctcccaggctggagtgcagtggcacgatctcggctcactgcaacctccgcctcgcaggttccagcgattctcctatctcagcctcccgactagctgggattacaggcgaacaccatgacacctagctaatttttgtatttttagtagagacggggtttcgccatgttggccaggctgattcgaactcctgacctcagatgattcgcctgccttggcctcccaaagtgctgaaatcacaggcgtgagccaccgtgcccagccttagtaatgatttctaagctttccatcactgatatctaacgaagtttagcccctcacttaattttcctattataatagggccaaatccaatgaacatgccaaaattaccataaagcatgtttgaaactgcctcttggccaatatgtaaaagtatttccaaaacatctctgctggaccaaggtggcaaaatgtgtgtcttctgggtacaggtgcgaaccctctgattccttcagctaagtccatgtgttctctctcatgtgctgcacctcctcctctcgggtgcagtccacagcatggaaggagagaaaggcttccctgcccacagcttccctacactcccttccagctccttgattctgggtggaagcatctgctggaaacccaccctgcagcacctggcctgaggacctagagctcacaaaggcactctctaagtgctgcctggggaggcctggttggagggaggccccgctctggggtaaagatgacagagggctgggctctgtggaatgctacattgtgtcactatatatacatcttggtattgtggcatgaagaacagctctgtctttccaaatagaaccatgcaacattgcaaaagatgctggctgaagcataagggcaatactaccaataacagtttcaaatggtgtgggctttcttacttgcccacagtgtgctttctctttaacctaactgaattcctttgacgagaaaatgggcctaataactacacgattgctttagaagcttaaattaccctcattcccttttttcagatgagaaaaatgctgacagagcccttgtctctggggctgggctttgcccactggaccacctaccgctctcgatgctctacaagtttggggatacaaactgattttaatattaactcaataaacagaaattagaatgatacatccgctgccaaaatacttacagagagcacactaaagccataaaaggattttgattttattcattcagataacacattataactgtacattttaaacagcgttgcatccatcctgaaaaatagcaagtattccctctacagctaaatggacagcaggagaagagcaaggtggcagggctgttaagctttccctttctttattccataaacataccttgtcctccagttgcgaacttggtcccgtcagggtgaatatcaactgaaaaaatcggcttgcctggaaacaaagaaaaaaaaatacagtatctaaattggcttttattcattgaagtgtatcaaactcaacagattcagttaaagtctaaactgctagaagattctccaaacatcagacaactgaaagtccaacagtgggagaaagcattccatcactgagaatggctgagcccataggatgcctgggcatttgtctgccatcttgtagggatgtgtgtttgtaatggctatgagctgttcatgattgaagttctgagtctcaggtacttagtgaaaagggcacacagctgtaactccagacatctccctattgcatggatctgcacttgactggcagcctagacagaaggactgctatttgtcttttctggctgacagctgagcaggaccagcgctggctgcaaccaaggagcattgcttcgcttgtcatacttctgcttccaaacagccctcttttgtttgtgctgtgaagttcccataccgtctgccatctcagcatctcctctggctgaacctccttcacagtttgtactctatgttaaattagctgttcaattcctccaggagaaaggactgtggctattagttcttagaagccccaaagagcccagtatgggcctaggcttgcactaggatcccatgaagctagctggctggctgggtgggtggatcagaccggcaaaagcactgtaggagcttgaaacccagcagaccatagaaggcactcacgcctggtgggcatttgtccagctccctgcttctaggacaaaggtttaagagctacaagtggcatgtcagttgctgttgagttcatcacatcttcagcctctagcacagtacccagtgtacagtagcgcagtaatatttgttcattgacaaaggagatacatgacaatgatctgagcatcaacaattgctgatatagatgggctgttgccaagagtctcttaattgaacatgttctgtctctgtcacccaagaggaggcaatgtggacacagtaccagagtcaccagccctagaatcactcagcaagtactgggatcaggagtgtgtgggcaggcagtggctgtctgagaactgtgaagtcctgccagggctcccatgcaagtgtgaaaattaaatgctggtgcccaaaaggcactgcccagcatgggacccaggcagcacccagctgtggagagccgcagccatgtagtcaaatcaagcatgaacttgagataaaatacactttccttcttactggtcactatgtagtataggttgagtatcccttatctgaaacacctgggacccgttttaaccaaagggaaatgacagaagtaatgttgctccagttccaggtgtaggccttaagagtctagcagttcaactttggctctctggagaaacctagttgtcatgtgagaagtccaagtaccctgagaccaccatgttttgaagaggcccaagctggccacatgtagagcatcaaagagcccggacaagtgagaatcaaggtcacagacacaggcctggtgaggtgttctatccccaagctattcgagccatcccagcagattccatagagccaagatgagctgaacctgctaagtcctgacaagctgcagaattatgagcaaataataaaactgttattggtttaagccagcaaatttaggggtttgtcatataagagataaaccaaaatgccaattcatttgcttttctgcttaagccagcttgagctgggcatttgtcattttaacaaaaaatgttctagctgacagctttggtcttgacgggcaatcagggcggaacattcccctccccttggagtgcttttcagttccataagtctgtgagacattgtattacatcagtcccctcaagaagcacaccagaaacccttacctgcaagtcacagttcccctgactacccaagagcacgtacaggctgagccaggctgtgctgagggctcagctgcacaagtaaccaattacagcccatgcgctttagatcatgcccactcacagcatcaactgcatgttttctcactcagtctctgtttgcagatttctactatgtgccaggcattaggctaagcaatgagaaagtaaagatacataatcatacaaactcccctagtaagatgtccactgatggacacttcacaagcagaaagccacctgactcagcctcgggcttcctgcagaaataataactgaattgggtcccaagggttgagtaagagttagccagaagatcgggtgaaggagagggttttcaggctgaggggacgcacggcatggaatcaagaaataggctgatgtaatgttgcagagcagactgcaggtagagagtgtgagaaagaagaggagacagagatggctcagcaagcatcagtaaggagctgagacatttctctaaaggtactttcaaggcagggtaatgccaaggtcagattcacattctggctccacaatagcagtgtggaaaatgggggtgggggcctcaaggctccaggggaaggcagggatggaggctggcaacaagtttgggttttggcattaaacatcatgggctgaatctttagccctgccacttacccagctacaaagccttgagattttattttattttatttttattattttgagaaggcgtgcctggttcattggcaccaggtttcctttcctagtgctatgcagattagatgaaatatggtaggggacctacacagataccagcgcagtgctggctccccgcctccttacagcactaggcctttccatcccaaggaaagcagtcactcacattccattagtgggaatgaaactatttatttatttatttatttatttatttatttatagacagagtttcgctctgtcgcccaggctagagtgcagtggcgtgatctccactcactgcaagctccgtctcccaggttcacgccattctcctgcctcagcctcctgaatagctgggactacaggtgcctgctaccacgcccagctaattttggtatttttagtagaaacagggtttcaccatgttagccaggatggtctcgatctcctgacctcatgatccgaccacctcagcctcccaaagtgctgggattacaggggtaatcccggccaccgtgcccggccaggaatgaacctcttctaaagggctctctgaggtggagctaaggaaagggaccttctggctgagctagttagacaactcttcctgtggcacagcatgatgatgacaaagatgagttcccaactacctccagtgtctggcctttctttgtaatagagacagaaagaaaagacaaattaacacaccctagactctagagacaccaagcaatcacctatccttagatcaaccccagatcagaatgttgtccctgcacacccaatacacagccaatatagtcagccactgtctactgtctggggatttgctgatttgacaagagcagcacaaatgctttccacctggcagggaataaagaatacattaaggaagctgggattatgacagggcatgctcaggtagaatcgtaccctccttcacactaggggaaagattcctagaagaggactaaacatgggaacttaaactctgagcacagagaggtggccagaggcaaagcagagagggcacaatggagagctgctggcccttccctctcagcagtcccacagacctttggtttggctccaaaaagtctctgggcttttatgttctgatagttcattgggtagagctgactggaacacatgtgcatatgtccttttggaatgaagcttgggaaagttgaggcttttgcccagtgaatgttgctcctgggaacacttcctgcactgcccaatagaacttggttttaaccaatgttgacaaatttagaattaaaaataagaaaatgtttgaaacatttattaaatgaaacagttacagaacaatactaaaatataaggtggggccggtcatggtggctcacgccggtaatcccagcactttgggaagccaaggcaggtagatcacttgaggtcaggagtttgagaccagcctgaccaacaggcgcaccattgcactccagcctgggtgacagagtgagactgtctcaagaaacaaaacaaaacaaaaaatatataaggtgggtgcaaacaacacaaacttatttatttatttatttatttattttgagacgaaatctcactctgtcacccaggctggagtgcagtaacgcaatctcagctcactgcaacctctacctcctaagttcaagcgattctcctgcctcagcctcccgagtagctgggactataggtgtgtgccaccatgcctggctaaaaagtgctggaattacaggcttgagccaccccgcccagctacaaacaacataatcttaaatgtagaaaaccctaaaaattccacagaaaaactattagtgctaataatgaattcagcaaagttgcaggatacaaaatcaacaaacaaaagtcatctgcatttctatacaccaacaatgaacaatctgaaagggaaattaagaaaacaattcaatttacaacagaatcaaaatgaataaaatttgtaggaataaacttagcccaggaggcgaaagacttgtacactgaaactataaaatataaaacactgctgaaggaaatcaaagacacaaataaatgaaaaaacattatatatgtactcatggactagaagatttaataactttaagatgttaggctgggcacagtggctcatgcctgtaatcccagcactttgggaggctgaggtgggtggatcacatgaggttgggagtccaagaccagcctgatcaacatggagaaaccctgtctctactaaaaatacaaaaattggccggacatggtagcacatgcctataatcccagctacttgggaggctgaggcaggagaattgcttgaacccgggaggtggaggttgcagtgagccaattttgtgccattgcactccagcctgggcaacaagagtgaaactccgtctcaaaaaaaaaagatgtcaaaactcttaaaagtgatttgtaggcttaatgcaatccctatgaaaatcccaatggtactttctgcagaaataaaaaaaaaaatcgatcccaaaattcacatggaatcttaagggactctgaacagtcaaaagaatcttcaaaaagtacaaagttgaggatctcgcatttccttatttcaaaacttactacaaagctacagtaatcagaacagtgaagtacaggcatagacagacacctagaacaacagaatacagagcccagaaataaactgttgtgtatatgatcaaatgattttgacaaggggccaagaccattcaatggggaaagaacagtctcttttacaaatggtgctgcgaaaactgcacatgcaaaagaatgaagttggatccctatctcataccatatacaattaactcaaaatggatcaaagacctgcatatatatcttagaaggaaacataggggaaaagcttcacaagattggatttggcagtaatttctttttcttttttctttctttcttttctttttttttgagacagcacctcattctgtcgcccaggctggagtgcagtggtatgatcttggcccactgcagcctcaaccttccaggctcaagcaaccctcccacctcagtctcctgagtagttggggactgagggcacaaccacgcctggtgcgcaccaccacgcctggctaatttttgtatttcttgtagagatggggtttcaccatgttgcccagactggtctcaaactcctgagttcaagcgatctgctacctttacgtcccaaagtgctaggattataggcgtgcaccactgcatctgaccatgaatttggcaataatttcttagatatgagactaaaggcacagacaataaaagaaaaataaactgaactttatcaaaattaaaaacttttgtgcatcaaaggaaaatatcaacagaataaaaaggcaacccatagaatgggagaaatatctgcaaattacatatctgataagggattaatgtccagaatatatagagaaatcctgaaactcaacaacgtgactcaaaattgggcaaataacttgaacaggcatttctccaaagaagatatacaaatgaggcacggtgcaatggctcacatctgtaatcccagcactttgggaggctgaggtgggtggatcacctgaggtaaagaattcaagaccagcctggccaacatggtgaaaccccatctcttctaaaactacaaaaattagccaagcgtggtggtgggtgcctgtagtcctatctactctggaggctgaagcaggagaatcacttgaacccagggggcagaggttgcagtgagctgagatcgtgccattgcactccagcctgggcgacagtgtgagactctgtctcaaaaaagaaaagaaaagaaaagaaaagatacacaaataaccaacaagcacatgaaaagatgtcaacatcagtaaccagtagagaaatgcaagtcaaaaccacaattacgtattacctcacatccattaagatggctactaacggctgggtgcggtggctcatgcctgtaatcccagcactttgagaggctaaggtgggtggatcaagaggtcaagagatcaagaccatcctggccaacatggtgaaaccccatctctactaaaaatacaaaaattagctgggcatggtagcgtgtgcctgtagtcccagctactcgggaggctgaggcaggagaatcacttgaacctgggaggcggaggttgcagtgggccaagatcccgccactgcactccagcctggagacacagtgagactccgtctcaaaaaaaataaataaataaaaagatggctacttacaaaaaacctcaggaaataagtgttgatgagggtgtacagaaattgtaactcttgttaaaaatataattaccatatgacctggcaattatacttctgggtatataaccaaaagaaagggtcttgaagagctatttgtacacccatgttcatagcagtactattcactacagccaagaggtggaagcaacccaagtgtcccttgaccgatgaatggatgaacaaaatgtggtatatatccatacaatggaatattatttagccttaaaaaggaaagtagttctgatgcacactacaatgtggatgaacctcaaagacattatggtaagtgaaaaaagacaaatgtcataggattccacttatatgagctatctatgaatagtcaaattcatagaaacacaaagtagaatggtggttgcctacgtctgagttgaggggaaaatagggagttgttgcttaattggtataaaggtttgcaagatgaaaatgttccggagactggctgcacaataatgtgaattgtgacagtactgaattacatacttaaaaatgattaagatagtaaattttatattgtgaatatctgaccacaatttttaaaatgctaataaaaaccaaacaaaaccaaaaataaaaataaataaaatggaggagtgtaggagggaggtgggtgtaattataaaaattgttggcggggtgcggtggctcacacctgtaatcccaacactttgggaggctgaggcgggtggatcatgaggtcaggagattgagaccatcctgactaacacggtgaaaccccgtctctattaaaaatacaaaaaaaaaaaattgccaggcatggtggtggcaggcgcctgtagtcccagctacttgggaggctgaggcaggagaatggcatgaacctgggaggcggagcttgcagtgagccgagatcgcgcctgttccagcctgggcaacagagcgagactctgtctcaaaaaaataaaaataaaaaatatataaaaattgttggaactgttcagcatctcgactgcagtggtagatacatgaacctgcacaggtgacaaaattgtatagaactaaacatacacacgcacaaataagtacaaacaaaactggggaaataaattttaaaaaataggtagcatatgtcaatgtcaactatagttttgcaaaatgttaacattgggagaaactggactaagtccagaagtaccttctcagtatttcatacaattcggtgtgaatctataatcatctcgataagaaataaacacacacacacacacacacacacacaaggcctgtttttaaaaaacgatatatatgtgtgtgtactaatatataaggcagtagaggtaaatatccaaacaccagaggttaggtcataataaaaatgattcttttcatgtgcaggtgacaatatgcacactctataacaagcaatccctctggagaaactcatcagccaaacacactaatgtgacctatatgcaagtaactcctatggctgactgccttctagacacctcaccctgatcttctctataacggtctgatctttccaagaaacctgctctacccactgtctgccccaacacagttaaggccagaccttgagaggagaggccaacaatccttgcacaatggccaccccgcccccacgacttttctgacctcatctcctactaacccccaccatcgctggtcttcctcttttcttggactgtaccaggtgcgctcctatcttgggccttgtactgactcttccttgcctccttcaggtctttgctcaatgtcaccctcacattgaggcctactctaacaactttaatttaaaggattatttccccaatgtggcacaacaaatccccttagtcctgatctatttatttcctcgggaatttcttacatattaatttcctttattgtatgtctgtctactctgcccactagaatgtaaactccagtaagtagatcagctcttttgtctgttttattcactaattcatcctcaggacccagagctgtggcttggcacataacaggcacaacaataaaaacttgttgctgttgaatggctggagaaagctcatgacagaagcactacattcaaacaccttcagtatcactggtgtaacaatctttggaaggcaggctcctgatctactgctgtggggactcagatttcgccaactgcctgcaggtgggaagcacacccttggctggttcacagccatctgctgctgttatctctaccactttcgaccacaaaaacttatccccatcttctttagtaagcatgacacaatgacatctcataggtgtcagatgcctaagagattgaaaacatagcacaggaaggaagctgttgcaccatacaaccattgtgtgtgtgtgtgtgtgtgtgtgtgtgtgcacgcgccacaaactaaagtggaaaagtgtcacaggtatatcatttaggagaccttaatcacttctcctgaagcatctgccaacatataatcaacaaagttttgagattgggcgcagtggctcactcctgtaatcccagcactttgggaggccaaggcaggcagatcacttgctctgaggaattcgagaccactttaggcaacatggtgaaccccatctctacaaattaaaaacaaaaaacaaaaattacccagtagtggtggtgcaagcctgtagtctcagctactcaggaggctgaggtgggaggatctattgagctcgggaggtcgaggctgcagtgagccgtgatcacgccactgcactgcagcctgggcaacaaaaaaaactgtctcaaaaaaaaaaaaaaaaaaaccaaaccaaaacaaaaaacaaacaaacaaacaaaaccccaaaaaacaaaaaagttttgacgaaaggcatttctgtttcttaatacttctttcccccctcattttgcaaaacagaggtattccctaaaaagtatctgcacaggaggattgcttgagcccaggagctcaaggctgcagtgaactatggtcatgccactgtactccattctgagcgacaaagtaagaccttgtctttaaaaaaaaaagttatctgcaagggtacaatgtatattattcaggtgatggttgcactaaaagcccagacttcatcactaagcaatatatccatgtaacaaaactgcacttacatcccttaaatttaacaacaaaaagttatctgcaaaatgtactcctataaatctagtcccttccacctacttccattagaaaattaaaagctacatttccatagtgggaaaaatctgctagctcaacaataaccacaattaagaagacaacaaacctacaatactatttaagtgaaaaatgcacagcaggctgggcgcagtggctcacgcctgtaatcccagcactttgggaggtcgaggcgggtggatcacctgaggtcaggagttcaaaaccagcctggccaacatggtgaaaccccatctctactaaaaatacaaaaaatttattgggtgtggtggcaagtgcctgtaatcccagctaatcggaaggctgaggcaggagaatcgcttgaaccctggaggcagagattgcagtgagccgaggttgcaccattgcactccagcctgggcaacaaaagcgaaactccgtctcaaaaaaaaaaaaaaaaatgcacagcaacattttagctatgccagttatctgtacaatgcaaggtctgtaagggaggctacacaccaaagacattggatttgctatggtgactgatggggatttggttaaagtcttaaaaaaattcagacacttgtataatgtgcatacactaaatgcgtcttctaaaatcacaaaatcacccagttgtttttttccaaatggtttgaaagaccacattaaaagttttaacaatgtgttttcctttgtgcattttctaatttttcctaacttctttcacagtcttactgagctcagtagatagcaactctgcccttagactggaactcatccttctgttctctcttaactcttttgtgtgtgtgtgtgtatgagatggagtcttgctctgtcacccaggctggaccgcagtgatgcgacctcagctcactgcaacctcccactctgggtttcaagcaattctcctgcctcagcctcccgagttgctgggactacaggtacatgccaccacacctggctaatttttgtatttttagtagagacgcatttttgccatgttggccagactggtcttgaactcctaacctcaagtgatctgcctgccttggcctcccaaagtgctgggattacaggtgtgagccaccatgcccggcctgttctatcttatctcataccccatatttgaccctaccttcccaacatacccataacccaaactttcaggagagatgcaaatgttccttaactttatcagggaacaggttacaaagtacattaacttgtcaaaagtcaacacattatacatttaaggtctggacattttatttatacctgaaaagaatgtgtttatatatacacacacacacacacacacacatacacatatatatatatacatatatatattacatatacatataaacacatatatacatgtaatgtattacataaacacacacacacacagagtctcccccaccagctccaaccatttcttgccatcacagccatcaccatcctgatccagaccatctcttgcttggattactaccagtagttggcattataactggtctcctggctcctccctccctctggtcccccacaaccaatctagtctccacgtagcagtcagaaagatctctaaaactcacgtcagatcacagtagtcctctgctccccttgcagtgagaatcaaggccttctagtagcctactaggctctcccaatcagtctgctattcactctctggcctcctctctcacagcccttgccttgctccaaccacaatgacatctgtgctactgctcaaaccctccaggcaagttccagctcttctttctgcctggaatgctcttccctcagatggcaccttcctcatctccatgaggcctgcagcgaatgctgtggtatcatgcccaggtccctaccctccagggactaaagcacactcccatagctatctgtggagtgttggcagccccaacagctccctgtagtcttcctccaggtcagacctgccctcagtggaagcactcttttggcagggtcaggtctcctttccaaaagagcctatatccaggctgtggacacgggagtaaagggccctggtctcccaccccaatccacgacaattctgaagggcctccccagctacagaactcccagcagggctggctgcggctttctctgtgcttacatcatagcttgccttctccctctgtctggtgctgcttccttcactccttcaatggtgtggatcccgagagccctccccaataatcctgcatgcaaaaatctgcagctcagaatctgactcctgcaacaaggcctttgctcaaatgttaccttttcactcaggctttgccaaagcgtcccacttaaacccgtctatcccccgcctctgcctcagcattcctcatctctaagtctgctgtttctccaattcacaggatcttgtttgtgattccgctatgtgtctcaccaggaagctcccctcccacatctcctcttttccacttacacaggaaacccccagcagatcccatcccagtctcactggccaggatgcataacaggctgctcctcaagagcctggcatgctgcttggttcactgctgttttaagagctgaaaacatacacacactgactcacacacatgcatacacacacacacacacacacacacacacacacacacacacacatattttcagctcttaaaacagcagtgaatttatcaactgttttttccatgtgagaccttctgttagaggatgcagcagacctggagtctgctccaacgtaggtctatccctggacctcaaataaggcctgctgtcccttctgtctggtcttcaccacagtggcttttgccagggtagcctcccagggaattggcctaccctaggtttgttaatgcatcgaggcagacaatgcttttaggagcaacaaatgttaatctaaatgggttttctttttgccaggagtgttttaaaaccatttgctatctgtttcatccacttcctttcctaaaatggaaggctctagaagacagaatcatgtaaatgaactccttgggtaaggcttgggcagaatgtttcccctcatcattggaattgccagcagattccactagaaagagccagccaggatgaacaagaagtttatttgcagtacatcaactctaccagccaaggacaacagacactgttagctgcccatccatcagccactttccatcaccaacttccagcactcagcactccttcaacatttactgagtgactactatggtgtgtaccaagtaccattcctggccctgggaaaagggcatgagcaaagacaaagtctgttttccaggagcatatgctcccccagggaggtgtctaatagaactccagttttattcagatatccactctgcccgttatgtaagccagtaggcaacgatgattgatgcaagagagggcacatgacctagttggaccaatcagccaatggggaagacccaaagtccaaggctggggcacagacctctcccttctgcttctcactgaaaacattctcgataccccacaaccagagaactcttgaaaatcaaatgccagaaaaggctcaccaagcacatttcaagagaaacctaccaggttagaagccccaaggcactcagaatggctacagaagcagtcagaggacaagctccagggaccagactcctggtcccatgctgtaccacgtggtttctgaaagctgtccttctgaggaggaaatgggcctgaagctctccaggacggagtggccagcctcagcacaaagaccagtgcttagcaaattagaaagagtaagtctgggcttgggctggagtctaagtgtgactctcaacacatctccatcacatctagtggaatcttggtgccagggggtcacctcatctcactcagcctaagtttccatctgtgaactgtaatgctgcaagtcatagagaatttcgagggtaatcttctatcgtatataacaagtcctgagataggtcagcttcagggtgcattaatttagcaacttaaagagacgtgtccctctgtcttcctctcctgtcatcagtgtcggccctgttccaagctggcttttacacgcagacctagtaaagtccagcagaagagactagcctgtcaagcatctcctcttatttaattccctaggaggtcccagcagacgtcccctcctagtctcaagggccaaaatggcatcacatggctgttcctcaacaaatccttggcatttacccacacatcagcttagggctatcagcaggttggcctgcagaaggcagaccaaaaaaattggggttctgctaacaaggaacaaggcaggcaaccctacaatatttgcaacactccctttgtgctatttgacaatatgcacaatgttcacaatcccactcacttctaggtgttgttgctgactctggcaggatgataaaatgtgctttgcataaatttttggtccccagggctcattccatacctctggttcatgtgctagacacttctgcagtccataggcaaacaccccggatgaacagaacatgctagcaacctctggggaaagggaggggtcaagccagacacagagcatcctcttcctggtcaccgacaggacccaagatcagcacagtggaagcaggtctcctacttggcttcagtggtcaaggccagacgctcctcagaagtccctcccagctgtgtaactatgattctgctcataaagtgaaaatagttttcaaccacttcttagagtaaaacaaatgtttaagaaaatcccatttcctggccttcatccatattctttctgcagcatattaaagaaataaattcagagagaggctgggagcggtggctcacacctgtaataccagcactttgggaggccgaggcgggtggatcacctgaggtcaggagttcgagagcagccaggccaacgtggcgaaaatgtgtattaaaaatacaaaaacactaaataccgaatactaaaaatacaaaaattagccaggcgtggtggcatgtgcctgtaatcccagctactcgggaggctgaggtaggagaatcacttgaacccgggaggtggaggttgcagtgagctgagaccatgccactgcactccagcctggcctgggtaacagagcgagactctgtctcaaaataaataaagaaaatatataagtaaataaatacattcagagtggcccaaatctacagtcacctgcctacatggccaagtcccattaattctacctctaccctgtctttagtgcctctctatttctcacctccatcacctgtgatctccctgtctccctgagcatctcaccaagactagaaattcctaactcctctagggcctgcctaagacacaggttgggtgtttcatccagcttcctcagaagcctcaatgttctcctctctcccctaaccccaagaaggaagttcaagctgctggcaaggctctgcctcccagccccattctccctcttgccctgtttagcctccctcctaacatgttctatgtctttccctaaatgctttcaccctctgggccttttctcctgatggtctcatgtgctgtagcgccttctctgccatcacaattctagtcacgtcaaggttcagtccaaggacacatccacaaacccgactctgctggtgaagtgcccttcctccttgggctatcacgcttattcctctagctcctgtttcccctgccctgcattctagaatacggtttgtatgtcaatctctctcatctatcttccacacagctttctgttcagagagagagccttatttacctctggtccccacagaactcttaccagaaaggttcaatgtttgttgcataaatcagtgaaaaatccacagcaaaatctcacccagttttcttctgactcttcagatgtactctggttattttcctaaatcaacctactgtcttcaggcataagtcaggagagaaattgctgagagaatttgcattttctgagctaccacatggagcaggtgaggcaagaattactgacttcatgaacagattaggaagagatggaaaaactttttatgtcacatatttagtaagcagcagggcacagagactccagagcaggatatctgattccaaaaacagaagacaaaattcttgtcctcaagaaacttacagtctagtcggaactgtaagacaaatacaccaaaaggcaaataacttattcagagcggggtttctcacccttagcactattgatatttggggctagataattctccatgagtgggctgtcctgcatgctatacgatgtttaacagatttgtcccctacccacttgataccagtagcacgtaccctgcccaaccctgttgtgacaaccacaaatgtctctagacattgccctgtagaaccactgatctaaagcaactgccatgtttatctctcaaccactgcaatcatataacctcaccattaggatcctttccctgccaattctcagacataggtctgcagtgccctccggcagcaggctggaccttacccacccactcctaactttatcattatatgattctgcctacattttcccttcaagctgaattatttaattttcatgctgatgtctcagtaggacagcttcaaatccttttcagaatgacacaaggtaggggtaaaaataatccaatcgcaggacaggagaaaatacacaccataaggccatgtgattaccagcaaattaccctgttcttgaaaatttcccaaatcccttttcataacactgccatcaaagtgtgaaccaaaggccaaaggtggacaagagctctttcagtcctggccctcttggttagaactggcttcaccaaagagctgagcataagcgctgtctgcccaggcatgagaattccagaaaaaactcaggagcaaaggcccagagttgggaagagccatgaatctcaacgagattttctaaacatacaaactccatatttctacaaactttaaaaccagaaacctagttgtttttactttctgaccttaacctaacttagaaataaagcttattttggtcaattctaaaataaaatatatagagaatactgtatccaagaacacgaagtaaaatgtgtatgtatgaacaataactgacacatcttctatataaatgatagctattatatttcaatttaacaatcttttatatttggtcccaggataaaatggaagaggtaagtcttattttaccaaggcccagaagtagagttataagtccaagaatttacagctagtaaatgatgcagttttgaacccagtctgattccacattcaaggctcatttcactacaacgtgacaacttcaagattaacttattgataaccttagacaagtgcttctcaattgggggtgattttggctaccaatggacattggcaatgactggagatatttttggttgatacaactagaagttgtatcaacttactctaagaaggtgtttgtgaagtgctactggcatctggtgggtagaggccaaggatactagaaacattctataacatagatgacaatcacacaattttatggcccaaaatgtcaacctgctgaagttgggaaaccctaccttagaggtgtctctattatcagccaagaaaatgaagaccaaagtacacccacatttcaataaatacttcttctcctgttctagctaccctctccactttgaatggattccctgccacaccagagaaaaatgctgagctgtctgctacttccccctttagactctcgaaaaacagaaaaagtatgttcatgctgggtgcagtggctcacgcctgtagtcccagctactcaggatgctgaggcaggaagatcccttgagcccaggtatttgagtctagcctgggcaacactgcaagatcccatttctattaaaaaaaaaagttatgtttgtgcttcacaaaattggagacatgaatatagaacaaggaagccagaaagtgcaatgatggctttacaaaagcaagcacaattttactggccactacccacccctcaggcttccggctgagcagcccctgctcccagcagccaccaatactcctacagtatttaaaggcctgctcggtagtgattcagaccagcatcatctcctccagggcagtggtaatttacctcttgacagtccttctgaacattccatgagattttaaaagaaaggaaatttaacaaagaacaagtttaaaagaagttaaatcccatcctgccagagttgccatatctttttttttttttttttttttttttgagatggagtctcactgtcatcaggctggagtgcagtggcgcgatctcggctcactgcaacctctacctcccgggctcaagcgattctcctgtctcagcctcccgagtagttgggactacaggtgcgtaccaccacgcccagctaatttttgtatttttagtagagacggggtttcaccatgttggccaggatggtctcgatctcttgacctcgtgatccacctgcctcagcctcccaaagtgctgggattacaggcatgtgccaccgtgcccagcctctttttattattacttattatctcagatttctaaagcacttaacagtttggggagcatttttatatctacgctcccaactgagtatcacaagcatactatgaagtggttagagtagatattatcatgctccattctagggctgtagagaggccctcagcaataagggccactgttgtgcttgctctgccaggctgatgcacttggctgctgatctgagtgtagtctcttattcatttgtacctagttcgtcacttaagcatcttgacttacttatgtttacatagcataaaacttttggcctacaaaggagcttatcaaaaaggaacaagttatatgacagtagaagagaggctggagaagggtaggctattcacaaaaactgatttaggtaaagcattttaaaataaaaattctatcagaccttcacacagtaaactagttcataataacatttttcctttcctaatcacaagcatcataattcataattacaatatttgtccagttctccagggaaagatctgcacagtacacatcaggaaatgctcttggagatcaacaggagaaatgaaactaaaactcaaggcttcggctttcatgcacagtaaacctaacttcatcttgataaattatgaaaacctcagctttcttacctgttttagccaatatttatcacatacccatcatgtggaagaggttgttcaatgcagtagggcatacagaagggactgaggcagtccctaccctgggggcatatggaaagtaccctcacaccttccatgccaggcaaaacacacagacagtgatacagcacatctaccggggtaactcaggatgaacagtttcaaaagaaacacgtgaacctagtccctgaaaaatgggaaagatgtcacacaagatggaaggagagagaggtggcaggaggagaacacacacatgatcagttcagtttagttgtggtagtagagagcatcctgggaccaaattcaaaacgaaaaagccacatgttaaaatatctattctcgctcctaaagaaaacggtagcaccctgtagtcgcactgcaaagtagaaatgaggaacaagacagcatcagggtgaccctttgcctgtcaacagtcagacaggccagaatcaggccctgggctggaggagtctccctgggttgatttctgtgctacagtgctgtcagcagagtggggtgggggagggggaggcgcgcttttttcatctacccggggagcaaacaccaactcctgcagcagttctgccaacaaggcagaactatgacgaaactgattaccactagcctctctgtatcagagtcaagatatggggtggatgagtccgttccccaagggtgtgctttggagccactgccacagagctaagaagcccctctgctagaacacacctgtgccctatctgcccaaccctagttcaccctgatgtcccagctcagcattaatcgtggatccttcgcgggggcccggggcccccaaaccctcctatttagggaccacaattccccaactgggggcactgtccccagatccagaggggcagtaacagtccctcttgcagatttcggatcttcatcctgccactgaaaggccacaagggggatttcatcccggtttcaccttcaggaccgtctgagcacttctcgggcgatgcagaccagtggaaggcactggctggcaccaaggcccgctcctgggagccaggccgcggcccctccaaggaccacaggtgggcagcggaagactcagagcaagagccaggggcgaagatggccctcgctgcggtcaacccggagcacgtgctggggctcaccagcctctccgcgctgaggacaaagtccgctcccgccggcttcttggcttgggcaccgggtaccgggcgtcaggggcgagacaggcaggacttgcgcgcgccccgactcgactccagaccccgacccgactccgggctcggcctcccgcgacccctgcgcgcactcaccattgtggttgacccaggtcggcttcaggagcttcattgttcggccgccgccgccgccgggctgaggcgagcgccgggtccctcagcgcgcccgggccatggagccaccgccgccgcttcctcccgcgccacccgccctccggccgccgcccgccccgcgccctcagggccgccgcgccatcgccggcccgcgcccccctccgccgccacagccgccacccgcgctcggccgccgccgccgccaccacagccgcatcccctgcgccgctcctcctcaggcggctcccgggcaacgccggaagtcacggcgcgcacctgccaaatcgccccggcgggaaaccgctccccacgcggactgggccgccccggctcctccgctggcaggggcttcgggtcgggcccgggcgcgggcgccccagaaagggcggttcgcctggacggcggacagcgagcggggcctgcagttgcaacccgggccgcccgcagaggcaggcggggcccaggtggcgtggaccgcccgtcaccagctctgcctcgccagtctgagtccgacttattaactagcttccgtcattcatcaacacgcgctattgggcatcttgcgagcgccgggctccgcgccggcgccggaatgcgatccgggcttcggactcgaacgaatgcgggggacgagccaaccctggtgggggaggctggggcggacgcgtttattagaagatcggggccgtttgcctagacatgaacatttggactcggaggagcagagggacgccccctcggccgctccggctgcactgcggagccgaggcccgcgcgagggcgcagaccgaccaaccggctagggcctgactggctagactgtgcccgctgcagaggcgcgctcccagcacagggcggggacggaagggaggaccccgagccgcgtgaaacgcaaggccctcgtgtgtgcgcagctgacaccctaggcggggctgcgtcgggggcggggacaggcgcgtcccagcccacgcagccggaacgcctgagcgctgggcgcctggtctgccggacctcagcagggggcaccgcgggccggactgtggaggggcgcacgcccggaagcggcgagggtagccatgacggcctccgtgctgcgaagtatctcgctagccctgcgcccgactagcgggtgagtgcggacgctggccggatagcggagtgcccagggcgcgtgcggggtcttcgcgactgtccgccaggactcgcctgtgctccctgctcgcctcccagtccacgaatatctcagggatgagccatctggtcgtgactcttatgcatgaaaatctgagcaccctggcgagcagcggtcctgcttaagtcctctgtggtctgaacgaaagattttgaaaaaccttccacgttgaccttgctgtcatatcaagtagttagaagtgccccgggtttgggagcattgcaattttttattttcctgtgaagtgggagagaatcagatatttatttatttatttgagacagagtctcgctctgtcgcccaggctggagtgcagtggcgcgatttcggctcactgcaacctctgcctcccgggttcaagcagttctgccccggcctcccgagtagctcggattacaggcgcccaacaccacgcccggctaatttttgtatttttagtagagacggggtttcaccatgttggccaggctggtcttgaactcctgacctcgcgatccacccgcctcggcctcccaaagtgctgggattacagacgtgagcaaccgcgcctagcctggagaagcagatatttatacatactcttgtatctttcaggcttctgggaacttggcagacgcagcttagagagactcaccagcgagcgtcattgttgtctttctgggaactcattcccatgaggtaaaactcaatcgagggcctgacctctgggggtaaaggtgtcagtctatgtgtagagaacaaagcaagaatgctggatgtgtggtttgcaaaattaacagcctacaaagtttctcagttaaatttaggccgatgcttttctgtttttccaacattttccaaaccatagattgttgtttgtaatttttaaaatttgagcagtttctcaagaagtaagtattctccttgaagggattcttgtgtgttttaaaggacacagcttaagtttctgtttctccatgacccttcctcttccctgcccattcggaggccctggagagtgtggggaagatgcaagtattaaaggtatttccatctggcactctcgactctttgtagatacttgattcagtcaatcttgatagtaaaggatttgatttttcttttttttttgagatggagtctcactgtgtcacccaggctggagtgcagtggtgtgacctcggatcactgcaaccttcgcctcctgggttaaactaattctcctgcctcagcctcccaagtagctgggattacaggcgcccactaccacgcccggctaatttttgtgtttttagtagagacggggtttcaccatgttggatgttggtcaggctggtctcgaactcctgatctcaggtgatccacccacctcagcacccaaagtgctgggattacaggcctgagccaccgcacccagtccacaaatcaattttaatagtaataagcttctaatctaacagtttggtattttcacttttgagtgtaatcccaaggcacacctgaatcccagcaataaagaggaacacttcccgattttataccctgatgcctcttgttgcttttgtacttttttttttttttttttttttttgagacagagtctcgctctgttacccaagctggagtgcagtggcgcgatcttgtcctactgcaacctccgcctcccaggctcaagtgattctcctgcctcagcttcccgagaagctgggattacaggtgcgcaccaccacacccagctaatttttgtatttttagtagagacagggtttcgccatgttgaccaggctggtctcgaactcctgaccttgggcaatctgcccgcctttgcctcccaaagtgctgggattacaggcctgagccactgcacccggctgcttttgtactatttcttgtaattgatggcacctacacagttctcacaagtactgtggggtggagtacctcctcaccacgctgagctcatgagttagtcatgcacagctccttcccccagtggagaggtcagtatggggtacttaccatcttgtctctcagtaggttcatgagaccaaagaggaaaatgtttaatatttgctttatctattagatcagaacctcttcgaaaaaagaagaaggtagatcctaaaaaagaccaagaagcaaaggagcgcttgaaaaggaagatccgaaaactggaaaaggctactcaagagctaattcctattgaagattttattacccctctaaagttcttggataaagcaaggtaaggatccttctctagggatgaagtcctcaggacaaaggagtaatatcaacttcaggtagttgtgtctgtagttcacacctgtgatagtcattggtcagtaggcttgagctgacttggccctaatgagtccttgctccttttggaagcaggagaaagcatccttgggtggtactcttgaatggctctgggtgggaaagaacctaagacatctaataatccagatgcttaagcactgctctggagttcatgttgttgctgtcatgcatgaggagtcttggctgtttctgatcccttgggcctggagtctgaagccctcgcctcatcctaacagtagaaaacccttggcctcctgttttatcatgcagatatctttggttggtatttgttgggattctactgtgtgcagggttaacagctcctgctgccgttttgtaagcagtgtgcaccatctataaaggggcaggtgttaaaagtcttctctcacccaagggagtatttgcttgggcagaggaagtgctaccagtctcctcagatcatctgttcttttgacagagagcaaatgaccttggttccaagcatcagttgcagctgcagccacattcaacattccatttcttaatttgtcccaaacttgttttatctcctaagtcctgtctgtgtctggcaatgggaatacttgtgtcagttgcagtcacagacttacatgccagtgagattggtaacccttagcttctttgcagagagcggcctcaggtggagctcacctttgaggagactgagaggagagctctgcttctgaagaagtggtccttgtacaagcagcaagagcgtaagatggagagggacaccatcagggctatgctagaagcccagcaggaagctctggaggaactgcaactggaatccccgaagctccatgctgaggccatcaagcgggatcctaacctgttcccctttgagaaggaagggccacattacacaccaccgatccctaactaccaaccccctgaaggcaggtacaatgacatcaccaaggtgtacacacaagtggagtttaagagatagacttgcaggctgctatccttaacatgctgcccctgagagtaggaatgaccagggttcaagtctgctttccacagaatcaggcatgctgttaataaatactggtttaatcaaaatgctcctttgtcttgtgttagaattttttttaaaaaatttttttttgagacagagtctcactctgttgcccaggctggagtgcagtgacgcaatctcggctcactgcaaactctgtctctctggttcaagcgattctcctgtgtcagcctcctgagtatctgggattacaagtgtgcaccaccacgcgtggctaatttttgtatttttaggagacagagttttgccatgttggccaggctggtctcgaactcctgacctcaagtgatccgcctaccttggcctcccaaagcactgggattataggcatcagccaccacgcccagccagaattaaaattaattcaccaggccaggctcagtggctcatgcctgtaatcccagcactttgggaggccaaggcaggtggatcacgaaatgaggtcaggagatcgagaccatcctagctaacagtgaaaccccatctctactaaaaatacaaaaaaaattagctgggcatggtggcgggcgcctgtagtcccagctactcaagaggctgaggcaggagaatggtgtgaacctgggaggtggagcttgcagtgagccgagatcacaccactgcactccggcctgggtgaaagagcgagactacatctcaaagaaaaataaaaagtttattcacctaagatggatggaggtgacagatgctgcccttcgccaggtaatgggaagaagataacaaagacatcaactgctgccctcaaatggggaaaaaaaaatgtgtaaaaagaagatcccaagggtatagtgaaaataccaacaggagtcagagtaacagaggagtggtgggaaaggaagttgccagctggaaaggcatgtggagaagcagggccttcctgatgggaaagaccaaggagccacctttgtgttttcagctggggttagggggaggcagaagagtgtggagcaggccaggaacatactagttaataaagatgctgtggcccccaagagggtgtgaggcctggctggggcagcggactctgtctcaagtgcttagtctagaatgtgaatgtattagtctgctcaggctgccattacaaattaccatagactgggtggcttaaacaaaataaatttattttctcacaattctgggggctagaactcctgagatcaaggtaccagcaggcttgttttctgagtctttctccttagcttgcagatggctgccttttccctcacatggtcgtcccaatctgtttcctaattttttatagacaccagttatactggaatagggcccacctaatgacctcattataactttaattatctctttaacgatgctacctccaaatacctccaaatacagtcacattctgaggtatggggttggggggagtgggagggtcgtatgggtaggacttcaccataggaactgtaggggacacaattcagcctgtcacagtacaagcccagtgtacgaatagagccattttccccagtggcttggatcacaacctcagaaaggattttttttttttttttttttttaccaccttagtgcaggtaaaccagggaaacatttcattggaataagaacttaggttgtcttcctagcgtgtggttcacttttttcccttttttaaaaattgtggtggccaggcaccgtggctcacgcctgtaatcccagcactttgggaggcctaggtgggcagatcatctgaggtcagaagttcgagaccagcctgaccaacatggtgaaaccccgtctctactaaaaatacaaaattagctaggtgtagtggcacatgcctgtaatcccagctactcgggaggctgaggaaggagaatcgcttgaatacgggaagtggaggtagtgagtcgagatcacgccactgcactccagcctgggcaagaaaagcgaaactccccatcaaaaaaaaaaaaattgtggtaaaatacacataaactttactatcttcatcatttctaactgtatggctcagtggtattgaggacattcataccatcagacaacatcaccaccatccatccatctccagaggtcttcattgcaaaactgaactctacccattaaaccataattccctgttcccctcttcccccaagccctggcaaccaccattctaccttttctgtgattttaactattcttaagtacctcacagaagcggaatcatagtgtttgtctttttgtaagtggcttatttcactgagcataatcctcaaggttcatccatgttatatagcacgtatcaaatttccttttcatggctgaattaatgttccattgtacgtacgccacattttccttatccatctgttgatggacacttgggttaccttccgcattttactattgtgaataatgctgctatgaacacaggagtacaaatatcccttcaagactgtgctttcttttagatatacgcccagaagtggaactgctggatcatatggtgagtctatttttaattttttgaggaagtgccatatggctttccatggctgctgtaacattatatattcccaccaatagtgcccaaggattccaatttttctttgctgtttttttggagtcggagtctcactctgtcgcctaggctggaatgcagtggcatgatcttggctcactgcaaccaccacctcccgggttcaagcaattctcctgcctcagcctgccaagctgggactacaggcgtgtgctaccacgcccagctaatatttttttttgtatttttagtaaagatggagtttcgccatgttggccaggctggtcttgaattcctcacctcaggtgatctgcccgccttggcctcccaaagtgctggcattacatatgtgagctaccacacccagccaaggttccaatttttctacacccttatcacacttttttttttttttaatagtagccatcctaatgggtgtgaggtggtatctcactgtggttttgacttgcatttccctaatggtcagtgatgttgagcatctttttatgtgctttttggccatttgtatgtctattcaagtccttgtcttttttttttttttttttttgaaacagtctcaccctgttacccaggctagagtacagtggcgtaatctcggctcactgcaacctctgcctcccgggttcaaacaaatctcctgcctcagtctcccaagtagctgggattacaagtgcatgccaccacacctggctaatttttatatttttagtagagacggggtttcaccatgttggccaggctggtctcgaactgctgacctcaggtgatccgcctgcctcagcctcccaaagtgctgggattacaggcctaagccacagtgcccggccccttgcccatttttgaactttttttctcattgagttttaggagttctctataattctattaatctcttattagagatatgatttgcaaatattttctcccattctgtggattgcctttttattctgtcgatgtgtctttttttttttttaagagatagggtcttgctctgtcacccaggctagagtgcagtagtgcaatcatagctcactgtaacctcaaactcctgggctcaagcaattctcctgcctcagcctcctgagtagctaggactacagacaccaccatgcccagctaccttttttttttttaaacttgtagagatggggtcttgctatattgtccaagctggtcttgaactcctggcctcaagcaatccccttatgtcagcctcctgaaatgctgggattacagacatgatccacggtgcctggcctgatagtgtgttttttaaaaaattttttctataaggaatggaggcagggttttactatgttgcccaggatggtcttgaactcctgggctcaagtgatccttccacctcggcctccaatagtgctgggactacaggagtgagccaccatgcccggccaatagtcttctgatgtgaaatttagtgcctttaattttcatgaagtccaatttatctatttttttctttttaatgttgatgactttggtgtcatatccaagaaactactaccaaatccaacgttgtgaagatattccctatatttaattttaagctcttacaatttcggtcaattttgagttaacttgtatatgacgtttggtaagggtccaacttcactcttggatatccagtttccaggcatcaaccatttgttgaaaagactgtcctttccatagcctgggcgatcctcttacctcagccttccaagtagctgggactactgcttttttcaaaaaaaaaaaaaaacttcgttttaaaactcttatcagtcctggataaaaatgttgcctaaggattctaagtcctttggccccacctgagacaaatgctgaatggaaccacttttcatgacctccactgctgcctctgaggtccacgtcatcgtcagtttttgcctgttctattgcagtggccaactgatctaaccaccccatcccttctccacacagcagccagaggtctctagaaccaggtcaggtcaggtctttggctacctgccacccagagaatcgcatacccagattcctgatcacagctcacagcacccgctctggtcaaaacatggtgtcaggtccctttgcctttgtgggtccctttctctgcctgacaggagttgagcctcttcacccaggtctgggctcagacactgaggccttccccacctccccgcccaaggtaagtgtccagcacaggtgcttgatagcagtgtttttttttaaacagtaggtttcatctgttaggttgtaaaatcagtttggtaggtcatggccgacagtttgttttcaactttttattttgaagtaattatagattcacaggaggttgcataggaggttgtctagggaggtcctgggtacccttgccccagcctcccccaatgttaacaccttatacactacagcacagcatcaggacgcagaaattgacattggtacagtctacagaacatactcagtttccccagttacatctgtactcctttgtgtacctaactctacacaattttaacttcatgtatagccctgtgtaaccaccagtcaggctgacagatggttttcaacaccacaggactccctcgtatgaaccaccccctcaccatccctaacctaaacccctggtaacctttaatctgttttccatctctataattacattatttcaccaatgttacataaatggaatcctgctacatgtatgttttcaagattggctgtttttgctctgaagaatttccttgagtttcatctgagttgctgtgtgtacagcagttactgaaaatggcactatatcacatacagtacggatacatattgttttgtatttcaacaataatatgctatatataacagtctatgccagataataatgtaaaatacttattattaatatggggttttatccaaaacatttatttttatttttaaaacatttatttagagatggggtcttgctctgttgcccaggctggagtgcagtggcacgatcatagctgactgcaacctcaaactcctatcctcaagtgattcttctgcctcagcctcccaagtagctgagattacaggtgtgagccaccacacttagcacctgtccaaaaagtttgaaagatattgctcttattacagtatttgttttcttcataccaccaccataaaataccaaactgcttcagaaattaccaccattttatttttatttattttgagacaggatattgctctgtcacccaggttgaagtgcagtggggcacaatcatggctcactgcagcctcaaactcctgggctcaaacaatcctcctatctcagcctccgaagtagctggaactacaaatgcacgccaccatgcatagctcatttattttttgtagagatggggtcttgttacgttgcccaggctggtctcgaactcctgggctcaagcaatcctcccacctcagcctcccaaagtgctgggataacagccgtgagccaccacatccagccaccgttttaaattcctatttattgatgtttaatgtctgtcttttacccaaactacaacagaaactctttgaagacaacttgtctgtttcaaaactgtggtcttataagcctcaaaccctgtccaacatgtggacactcagatgttgtgaagcaattgacatagaaacaaatgcaggaacatcctgtccagagagattatctgttgatgtggaacttgagtagtgaaggaggaggcaaaacatgatagtcacactacagaggcaggacttaatgcttcctaacagagcatgcagccgcacaatgcataccttgctaaacaagcaggtggcagggagcgtggctgcactgaggggaagcccctcatggactggggtgctggctggcatgccctggcttttgctgcactctccagctctgccccaggaacctgaaggcagctgctgcaatcccaggcatcacatgcaggctgcaaactcattttattattttatctttgagacaagagtctcactctgtcgcccaggctggagtacagtggcacgatctcagctcactgcaacctctgcctctggggttcaagcaattctcctgtctcagcttcccgagtagctgggatcacaggcacgtgccaccatgcccagttaatttttgtatttttaatagagatggggggtttcaaccatgttggccaggctggtctcaaactccagacctcaagtgatccacccaccttggcctcccaaagtgctgggattacagcagactgcaaattcagatgccccgtccctgtgtttaagagtaagaaaaaccttgtagatctctagcagtcttcctctcttccctcactgggtggaaatgctcattattaaaccagccacagccatgctggaggcaccctggttgccttagacacatcagtactcccctgatgatgggggaacgctggctcctctttagatgctcctgctcttgggatcccgtgagcacaacccccacccccacccccactgttcacagacacaggggctcttagggagcacaggagaaaacacactcaagcagggaaatactgttctttaatggacacccttctaacgtgatagattattctgccccaaagaacaaattaaaagatattcaacttgctgcctgtgtccaggaagagagcagggagggtgctgggcacagacccagcctagccctcagcatcacacaacagggccaccataggatgagaaaccattctattagtaataaacagacctcttcaagaaatagtgtttttggtggttcatacattttaaaacacttaacaagagaataagcatacaaatttctaatactgtccaggtacaacactgttacacacaaaatctaacaagtgtgaacttaattttcagcttctatttgaaatcagatgaaatagcttttgatacattaaccaccaggggaaattttgagggaaggagtgcttaattccatatgtcttggacttggatttcttcagctgagtccacaaaccctctttatgcaaggttgtgtgttctgtagctgtgtgcatttcttaaaaaccagagtctccaggggccgacctgggagcctaagaagtgaagcctgctggtgcagaggggccagcaagccctacctgctcggcacacctgcctgcatgtgcagtggaactgagcgagtggagcagagtgtgagcactcacaatgctcaccaaacctgggacgtggcaggcagtttcccaaggactaggaaagacattcacagtggcacaactgtttagctacctcattatgacccacctgtgtgtccacacaggtcagggctacccttcagtttacctgagaagcctagacctcaggaccgccatctcctatgctaccatgcccagcctgacctggctgctcacaagtacctgccataatgcttggcctcctggaagctctaaagcggtgcaattgtcctgcagaacatcgcagtgtcagggtatcctgcatgcaggtgaggggtgggcaagtagggctagcaatgtcctgctccatgttcctgtgagcaagagctcacagggacccaccagactgtgtaggctggtcacagtccccagggctgtgcaacagcaacttgaaacagactgaggaagctgcacaggccaatggcagggatgcttgtcactcgtccttctcctgtggcagagggagatgccagtctggaggggggctctgcctcggggcccacaccaggatgtgcttccgtgcagcccggactcgtgcccgctcgctctcacagagggattgctgtgcaaatgagactctagtcactccccaggctctgagcaccctcaagacccctgtacctcccccctctcatcaccctctgaaacacagatggacaggcagggcctatggtacacaccactctgcagcacagctgcttccacctactataccttggcgattcttccatattagcgcacagagatggagatcattttttttctcacaagctactgtgaaaaactactgaataggtcataataatttgaggaatttttaaatatcttctcctggacctcagggctcaatggctctggttgacctcgtgagtctggggcatattcacctgctgagagtgagcctgggggtgctgggtggagaggagagaagagtctgagagagcagctgtggggagctgcagggaggagtgtgttagggagaagggaggaagacggggaagaaatacatgtcctgggtatcctggaagggtgggaagagtccagaggacagaccacccgcctgagtggtgccacaagtgccacttaacccatcagcttctcttggctactgtctcccaatacagacacaagtcagtgtatcacaacatgggtgacctttgctgtcagcccttggtaggtatcaggtgctatgtgagcctctttacacagataacttaatctgtctacatgtctgtctttgttcaagctctattgcctcaaataaaatattttgatcgtgtttaaaaagctatcagaaatgtagtacagaatattaaagattcccaaatgtccattcccaatgcggcagttaacagcttccctgatatctttttttggtccacattttagagctaacatgtttccctaaagataggataatcttttgctggctagtctacttcctgctttcttttcactaaacaatacactgtaggcacttttccatacccagggagatgaccgaccattcttttcaaaggctatctggtatttcactttgtggaaaaagctatttggtcaaatgtctattagtgaaatttaggttgttttcagcttttgcagtatcaaaaacataattagcattctaacttttaactgtacactgttatccaattacttccctgggataaagttccagaagtaaaacttaaggtcaaaaggtatgtatctgacatttacataatcagaacacctgacacccccaccaacactgcacaactacccagaattcttcaaacctctatcaacaccactttctgctgttactgtcatttagacttatatacctgacacctggccatttgattttttctttttttttcttgagagggagtcttactctgttgcccaggctggagtgcagtgacacgatctcggctcattgcaacctccgcctcccaggttcaaacaattctcctatctcagcctcccgagtagctgagattacaggtgtttgccaccatgcgtggctaattttcgtatttttagtagagatggggtttcgccatgttgccaggctggtctcaaactcctgacctcaggtgatctgcccacctcggcctcccaaagtgctaggattacaggcatgagccaccatgcccaggcttttctccttttttattatttttataaagatggagtctcaccatgttgcccatggctggtctcaagctcctgggctcaagcgatccccttgcctcggcctcccaaagtgccgagattacaggtgcccaccaccatgcccagctggctttcttttttaatgaattgcttctttgtgtcctttggccatttttccattctgaaataatccctatatttcttattgatatatatataacagctctttatacacacacacgcacatatatatacattaaagttatcaatctcttgctatataagctgtcagctttcttactttttttgactttcacatattatggaatagtcatcattttcttttatacagcagtctggtttccacatcagttcatctctttcagatcactgtatacacttaataatgttgaagtgttgatcagtcccattgattctcattccttggcactccccatgagcctcgcacctttcggctggcttctctccatctcctctcccacaaggggtccaccgtagcactgtattctacactacagtgtgggtgccaggagggcagagactcttcttatcactcgtgcatccccaagagcacccaatgtggtacatatttgctggacgaaaaaacaactagaaccacctccttaccggtctctctgctcctgtaatatattctctacaccctagcaaacagattgaacttcttttaccctctctcttttttttcccccctgagacaggtctccctctgttatccaggctggtgtgcagtggtgtgaccatagctcactgcagctttgaactcctgggcttaggcgatcctcccgcctcaccctcccaagtagctgggaccacaggtgcacgccaccacactttgctaacagactgatcttttaaagatataaatcgaattatgcctcccagcacactttagactaaactctaaactccgtatcaaaaggcccgccaggtccctggtataccgctctccaaccatccacctaccctctgcttcaggaacccaggccttatctgtttctcagcggtgtctaccggggctggatgaaggctggctcctggtcactcaggactcagcaacatcacctcctgcgtaggccagctgatgaccctaacaccggacggctgccctcttccctctctaaaccactctacaccccctcctcgctggtctcctcctttgtctttcacgccctctgaaagtcctgttgatatgctaatttacacaatctctcaaaagaaaggaagcgtgaggaggatagggaccccgtcagtccccggctaggtcgcggggcatggggcgtggaggggtggggaaagctgggccccgcaaggcgctccgaagcgccgccccgctccctcccggcgcacctgggcctcggcgttccggcgctcctcccagtcgcggcagctggccaggtcgcgctgccactgttcgcaggccggccgctcgccgtggacgtagtagtggtgtaggaagtgcctggcgctgcggcagagcttccactcggcgcggtaggcctcgcaggggcgcggcggctgcggcgagaggcggcgcctgagcggggcccggcggccgcgccctacgccccgagccagtcccgttccctccctccggaagaccccggtggttcccggctccgacccagcacactcacctgccagccgctgccgtccgccatgtctgggcgaccggcgcgccaagcccgcccctcagtccgccagccaatgaaaaatgaagaaaacggcacctcgtgatcgactgacagaagaactaatgagcaccgacacattcaatcacgtcttcgcccccttcttcgagaagcgccgacaaacaggacgagcaaccaatagcaaccgagggcggctgcggcgcgcgcggagggccggggtcgcagggtaaatccggggcgagacctggcgcgaagcctacgcgaccaccgcgacgacagcgccattcaccccgggccaggcgggcatcctgggccgcgcagctaccttacgtcagccgcctctcaaatcacacggctctggccagttcttttcagcagctttatgagattttctcaaatctcaacaatccggtatattttcaaaagtacatactgagcatcaaggtggtgcagcgaacctcccagatctgcagctccagcagtcttgcttgagcgtccactcaggatggaggtgaactcgcaaagtaactgagattggttgggcatgacatatggtggatctagggttgaatgacctccccagggaacgcaggcttgaagtggaggctgagaatgcaatccgagtacagccataggccggtcaaaggtatggaggcggtgtgtagcaggggtgagcggggtaggagtggcttggatgtctgtagttctattctaagggtgcgggagacatgtaacatttaccttattcatttttcgagacagggtcttgctgtgtcacccaggcttagtgcagtggcgtggcgtgttcatggcttactgcaacctcaaactcctggactccgaacagctgggaccaaaagcatgcacagcctcaccaggctaatttttaattttttttttttttttttgtaaagatggggtcttgctaagttacccaggctagtttggcctcaagcgaccctctcactttggcctcccaaagtgctaggattataggcggagcgccagtgcctggctgggacgtttataaaaaggagcaatgcacaagaggcaacaaaggcaagtaaagaggaggctggtgggcttgcagaaacgccctgcagtacctatgctgcggttctcccacttcactgataacaaatcctcagtatccactgatacaaatcctgggactgctgggccagtcccaggaatgacactgggacagactccctggaggtggatcagaaagctgcagttttaccaggggtcctgctgttgaggcagccggctcaaggaccaagcccaaataagacactgagaggaaggctgcaggccagggtgcaggagtaatgaccaggatcagtgctccaactggccccactgtgtcattaaaaggctctgcaatggaatccatcctggtccaggcaggggagtgtgcctccagcaaaggaccaggcgtttcactgcatacacagcaggtgttgcttagtgaagacaaaaacccagagccagaggtactgtaacattcttcattatgcataaagtgacagtctgttagctgatgtgatcctgcaaatgaaggctgtctacccaccaagggtttctccctctgctagtaaaactgagactttgtcagtggaggctcaggtaagtccccacagtgctcatgccttccaaaaccacgcccatttccagtgatgatggtttgtgccacaggccaagtactgaacatcatgacactcatagacactcttcactgaagacgtggatagaccctggggccaccattctctcctctctggagtgttggaggggccctgaccagggcaggacccccatgtctggaagcagggttagccctggctcatgggggaccctgctgggcttagccattgccacctagggatcaggcagccttgtttcttcctactttctccaggagaagccccagagggacacttttctaatggtgagatggaacacggagcacctgccaacaggccttcagttatggtcagaggcccaaccaccagtctgtgttagtacctaatcaaacatttagatttaggctttagttattgcctgtttttacttgaaattcttggcttagaattattcccaatggggccaggcacagtggctcatgggaacaaatttaaaataatcagattagcatgtcaaaagatctcacgttatagaaagtgaagatctaagaccaaataaatactgataaaaaatacaggccagcagaagcttggatgatttaataaattaaaattgggagttggggagtagggaagaaggagaggaacatctctttagcatttgttcattctaacattcacatgtttgcttctccatggagttgtttcactatgaacaggttcactaaggagccagttatgtccatatgaaatgagaataaaagtgcaaactcattcagatcaggttcttctgagtggtgtttttgaaaaaaatatgtaaaataaaaatagaaacattctttgtcaaatacttaaattgcagccacagtagtgggacagccactacttatagaacacatgtctatttaaagcctttttttaggccaaagactgacacctatgcaattgatgtaggaaaagaaaggataaatgaagaaaaagaaagaacacttcatgttagacaatttagtcaccttcataggttttgacagaattagggatgcagaattgctcctgctgaggcagtgggagctcccctcaagctgaaagcgtgaagaggtgaggaggcagctatctacaggccctcagggacagctctttgtctttccccaaatcaagcatacaactacaaagtcctgctgctccacttccaagtcaaacttaataattcttaggtaactctaaataaatcttaagtaacagagtattctctgatgaggctcgtccctgtcagtgccagtaactaaaagccaagatgttgcaaatgattcttttattattttccaatcagccaacagtcctcacttagggctttcttccctttttacgcaatgactgtccttctccagagaaagcgacgaatctgcctccagcttcatcctaggtttgaagagaagatactattttcagaaactccctggaggtttacaataaatgccttactctatggactcacgtaccatccacattactcataagaaatatctcaggctggacacgatagctgacacctgtaatcccagcactttaggaggcctaggtgggaggatcacttgagcccaggagttcaagaccagcctgggcaacatagtgagatcccatctctaccaaaaatagctcagtgtggtatgtgcctatgatcccagctacttgggaggctgagacgggaggatggtttgagccagggccatagtgagctatgattgtgccactgctccagcctggatggcagagcaacagagcaagaccctgcctcaaaaaaaaaaaaaaaaaaaaaagtctgtaagttcatcacccaaaaacatttcaggtcacttttctgtacatgcttaaagaattgttttcccacttaattctgaaatctcatgccaataaacttcctgtctagtatactcccaaggctacagaactgaattctgtaaaaaagaattccatgatgtaggagggccagttttctaccagtggacattgttgtggtaagcagcttaatgtatttgcacacaactctgattttttttagagctcaaattcctgggtcaaagtgtgtacacacttttaatgcttttaacatatagagaccaaccagccctcagaaacattccactaagctatccttccatcagcagaaagagggattgttttttcccaaacctttgaaaactgcacatattttttttcacatgcttttattgctagtcagtctgaggcattatctcaacttttccctaggaagaagaggattctggaatgttcaacacacatccctgcacctggctccccactaactgtagcatgttatacctgcaatagagcactgtttagtatttatgtggtcacattcatgtaaatttgagtcacagctgcatttagtcttcctttgccgcacagccttccattcatcctggtgtcaatagctgtgtttggcttcttcctctattcaatcacagcctgcattgcatggagttcatctgttttgacaaacctgtgtctcctgggccttcgccctgccgtacctggactggcctttctctaggtgccgtacatgttagtgggggctccttatttcctggattctatgactttcttatttctaccttattccttcattttagtgaggaacacctcctaggagcttcctgagaaaagatgcatgaggattatcttcttgtgagttccttttttctaatctcatatttcattgataggctggttggtatgttagtctgctagggctgccatataaaatgccaaagatagggtggctcaaacaacagaaatttattcttcatagttttggaggctagaagtgcaggatcaaggtgtcagcaggtttggtttcctctgacacccttttccttggcttgcagatggctgccttcttgctgtgtcctcacatggcccttcctatgtccaaatttcctcttcttaaaaggacaccagattgaattatggccaactctaatggtcttattttaacttaattgcttctttaaatggccctatctgagttactgggggttagggcttcaacacagaaacactggagggacacaatccagctcataagagttggtacagaattttaggttggaaaaaatttcccctcagaattttgagtatattgctccactatcttctagtttcctctgtgtcctgctaagatgatgtccctttttttgggagacagggacttactgttacccaggctggagtgcagtggtgtgatctcagctcacagcagcctccacctcccaggctcaagtgatgctcccaactcagcattaaagtagctgggactataggtgcgtgccaccatgcttggctaatttttaaaattttctgtagagacagggtctccctatattgcccaggctggtctcaaactcctgggctcagatgatcttcccgcatcagcctcccaaagtgttgggattacaggtgtgagccatggcgcttggctgatgatgtccttaatgcatggtgatacctctgttctctctctagaagctttaggatctttctttgcctcaaagtggggctattttcattcattttgctggaactcagtgagcccttcaaatctgcaaaattgtgcccatctttggggaaactatttccctgatgatttctgctcctttggtttctgtggctgttcttcccacaaatcctctattatttagatgctggaatggaaagctttctgactgtggccttcacttcagagatagtagtctagagacctactggagtcgagcctccagccttctgggatgggggagggagggtaatgcagctctaactgcttagtaacagaattctgtctttagtccctcatttctagaggtgccttttgagaattccacaatctacacagaactgcttctaggctttctatggtctactaaggtacctggggcttccaaagccttgtagttgcctcctcttccactgtctttcttacctcatgacctttagccacagccttagtggggctgcaggatggaatagagctaaatatgtcttcaatcccatctttaaacatatacttcttaaatacatatttatggtcaaacaggcctgctgtgcccactggcctcccctgccttctgtaaatttgcaacagtcaggtcacagtcagcctgggggacgtcccatgctaaggtcttaggtcggagtcaggcactggcttttagtgagaaaggcagcctgtagctggtgaagcctggatggtgcctgaaggaggagctggagggtgaggtctgactggccactatgtttgctcctctgagcctgaaaggtcccaatgcccaatgctgtttcaacttgaacattgagcccagaagtggttgtgagtaggaccaggtgtgcaaacttcacagtggtctctgtccccaaccaccccaagtgctagagaaaagagttcagtaattgggatggctcccatgtagcagctggtcctgaatgggtggctcagtacatctgccctctgccctgatcctggatcctcaagggtccaatcctttgagaaaaggaaccaggagagcgatgggtctgaagcgctggtgttgtagaaatcctcatcacaaagaggtgactgcgttccagttgctgccaggcctggccatattcccacaaagtgcccatgtctacaggatgctcagcccttgccttcctctgtcccgccaccaccctgctcagctagaaggtgctgcctatatttgaagttcaaggtctctgttggaagacgaagcccacccagggcacacagttctgtgataacagagcctggagtcggctctagagcaagacagagctcctgacccccatgctgcaagtcttctgtttcatacaccctacaccagctctacagaaaaaaacaggacaccagggagcagagggaccctaggaaagggaaaacatgacagacaccctcatgtggtttggctgcgtccccacccaaatctcatcttgaattaccacgtgttgtgggagggaccaggtgggaggtaactgagtcggtgggaggtaactgagtcatgagggcgggtcttttccgtgctgttatcatgatagtgaataagtctcatgagatctgatggttttataagtaggtgtttccctgcaccagctttttctctgcctgctaccatccatgtaagatgtgacttgccccctgccatgattgtgaggcctccccagccatgtgaactgtaagtccattaaacctctttcttttgtaaattgcccagtctcgggtacatctttaccagcagcttggaaacagactaatgcacacccctactcagaatgccaagaacttcagtcatcactagcaaataaatctcctcattaccaaccaaggaaatacaaggaaatacactcacctcttcaacctttttgacaaggggacgtgaatttctgatgaaagttatcttaccaagtttaaattcataattgggaattcctctgtaagaagagacagagacagagaaatgttatttccaggaaaaaaggactaaaattcatttttgacagtcaagaggaacgcagaaaagatgctgctgcaccccacctgggccctttggtgcttcctggcatcctcccaggagggaagcagaaagtaactgacttcttggtttggtatcaatattgggtatagggccaggggctttaggctctgtacctgtctatggagaggggtcatctgaaggattgggaagccctcactgtcactgtcctgagcttcacagaaccccctgaggtggctagactctcactccagtattctgatttcacacacacaacagacaactgacacacctcagccctgcccctgccatcatggccaccagaggaagggtctgctgtgggtccccggacccagcaacagaagcacatctgaggtagctcctcagggaactttcaggggaactgagataatgtgacctgattaataattccaagtcacaaaacaggaaaataggcagatcaccaaatagggaccagaaaggttttgagtaagagacagatctaatcagactcgcatcttaggaaagccagtgggggcaagaagaggctgaattgggggtatggagaggtatggagagaggctggaccacagtggtactgggggtggcactgtggaaggaggggcatgttgtgctccaccccaccaaggagagcagctaagggttttagtcccttgggagactactgacccaggctttgtctccagaactggggtgaggctgcccgaccccagcgggctggcacagatcctcctcctgtcctggaggagagccaggacagacctaccttttaatatctccaggcttgattggggaggggctgggctctacccctttcttctttccatccagtctattgccagatccagagaaagcctagacaggaagtaggtgagtcatataataagcccaagtgtgaggacgatatgtcctttgcttggagatcactgcagggatgtgagctgggggtgctgtgcagaccccttcaggactgaagccctgactcctcaactgctggggtgctggcagctaagaactctgcccagttcctcagggggtggccatgagctgaagacagccacttggccaagggcagccagcagtcagtgttgggttaaaagacctgatccctgcctctgcagggccacccagttcaagctctatgggtgggctaaggctactgttgtgactgccccatagctcagcttcccatcattctgccctctctgctgcttcctggcacctcctgccacctcagtgcccacacatgaaccacctccacctgtttcccatggagccttgccagtagttatgctaagggtcatgtttgcaacctacatggtacaggcaaagaaaaaaggaaacatgatttacaagagagagaaagcaaatgtggtaacttttggtgaacctaagggaacagtatatgtctactgtactatttaaactcttcggtaggttagaaattcttaaaaatctgggctgccttatggggctgttgggaagattccaggagagagtggatacaaaagggtttggtaactgagcgagtggcagatttgcatatgcacaggtacccagaggcctaacccctgctgatgtccatcgagcatcatggagaacaccttgagtgagtgctctaatttcaaggagcagagggcacagcaatataagtcaagtggtctggtactcacgcggaagcccagctctccagcatagccactgtggtcggcttcaccttcctgacagggaaaaagaaaaacaggtgagctcctcagcggggacacccagcttccctctcacccccacccccggctaggatgtcccccggaagcatggctggaagggacgcagaggatatgactacaccaacactagcagaggccacccacgagccactgccaggaactcaaaagcagcatgcagcaggacagcaaaggacactgaggataacacttactgtcgactcctcatgctggacttgtctttcgggttctttgtagcccaggggagcatcaaagtccacctgtgtttccaggattttaaaagtaaaatattgagacatgaccacccttggcttccttttttgtttttaattgagacaactgtagattcacatgcagttttaagaaataatacaaaagatgccttgtacacttgcccagttttcccaacggtagcatcttacaaaattacagtaaagtattgctgccaggatatcaacactggcacaacccactgctcttattcagatttccccagttttacatgtttttgttcatgggtatctttagttctacacaatgtaatcactgtgtggggcatgtatccaccacagttgagatgtagaacagtttcaccaccactaggactgcccatgttgtctttttataaccatacccagctgtctcccagccccctccaccagtcctaagccctggcaaccactggtctgtcttccatttcgaaagttctgtcactttgaggatgttatataacgaagtaactttttgggattggctttttttgctcagcagtattccctagtaatacaaccaggatgctgtgtgcatcagcacttcattcctactcagaaggttcagtacgcttccttagctcttaagcatattcactcctcggccaggcgcggtggcccacacctgtaatctcagcactttgggaggccgaggcgggtggattacctgaggtcaggagtttgagaccagcttggccaacatggtaaaaccctgtctctaccaaaatacaaaactagccgggcctggtggcacatgcctgtaatcccagctactcgggaggctgaggcaggagaatcgcttgaacctgggaggtggaggttgtagtgagccaagatcgcaccactgcactccagcctgggcaacaggagtgaaactaagtctcaaaaaaaaaaagaatattcactcctcaacgggtcagagctaaccatggcagcactggcagcaaactctgttgccccaactggccctgagatagatcacaaggtcacagtctcctcatgatgttctgacagcatcttcctcctctttacccagagtcccaggggctgtttgatgccctcctgacaccctggcctgcagtggtcaccaactgcccatcctcccagggcccaggctcactgtaactggacagagccactcacgttcatgtcacactcaatgatggacactgccttgtcgggtttggtctccatcacacgcagttcgtagatctgtggggcaaacacagaaatcagttggatggtttcctggcagcactggagctgtcgctgtccatgttactgtggctctactggctcctgcgaatgacacagcattcatgcccatgacacaacctacagctgcacttcttgctgtgacaacactgccataagggacaggctgccctgtgcccatcgctgaagagatgctgttccccagatatggttcaaattagacaaggtagttatacagctaactgcaaaagacactaacaacctttaacctggaaagttcacttctggaactttactatttattttatttatttatttttagacagaatctcgctctatcgcccaggctggagtgcagtggtgcgatcttggctcactgcaacctccgcctccagggttcaagcacttctcctgcctcagcctccctagtagctgggactataggcatgtgccactacacctggctaatttttgtattgttgtagagatggggtttcaccatgttggccaggctggtctcgaactcctgacctcaggtgatccgcccacctcggccacacaaagaactgggattacagacataagccaccgcactcggccttcgaaatttattctaagtaaataactagctatacccaatgagaaaattctaagaatgctcataccaacgtcactaataccactgtacagatgctccttgacttatgatggaaccaagtcccataaacttataagttaaaaatgtattaatattcctaacctaccaaacatcatagtgcagcctgccttaaccattctcagaacacatacattagcctacagttgggcaaaatcatctactataaagcttattttataataaaatgttgaataactcatgtaatttattgaatactgtactgaagatcaaaaacagaatggttgtataggtattcaaagtatggtttttactgaatgtgtatcatgtttgcatcataataaagttgaaaaattctaggtagaaccatggtcagggactgtctgtatactcaaaatgcagctgaattatatttcttcatatgtaaatttacagttatacaatggtatgctacgcagccaacaggaaaataattgtaaaaccagtcatgttgcttgtgtctaagatgacctcacctatgtaaaaaaggcacataaaaaatgtccagaagcagggccgtgcgtggtggctcacgcctgtaatcccagcactttgggaggccgaggagggcagatcacgaggtcaggcaaatgagaccatccttgctaacatggtgaagacccgtctctactaaaaaatacaaaaaattagctgggagtggtggcaggtgcctgtagtcccagctattcgggaggctgaggcaggagaatggtgtgaacccaggaggtggagcttgcagtaagctgagatcgggccactgcactccagcctgggcaacagagcgagactctgtgtcaaaaacaaacaaacaaacaagcaaacaaacaaactccagaagcatagaaattaaaagtggccctatctactttttcctgcatcatttcaggttctttgcttttatctaaagtctgtcttgcttttttttttttttttttttcgagatggaggctcgctctggcacccaagctggagtgcaatggtatggtcttggctcactgcaacctccgcctcccgggttccagcgattctcttgcctcagcctcccaagtaactgggactacaggtgcgtgccaccacacccagctaatttttgtgtttttagtagagatggtgtttcactatgttggccaggctggtcttgaactcctgacgttgtgatccacccgcctcagcctcccaaagtgctgggattacaggcatgggccaccatgcccggccagtatgtcttgcttttacaaccattttaaaaagtctggatagtcccaccatttaaaaaaaaaacctaagcagggccaaatctacttttaaaagtgtcataattattgaatagataaggaataaaaaaaggatctgtcattgtgtggatatactaccacttatccactgagcatccggcctgtttccaatcattttgctgtgttaatgacactactataaacattcaaacatgtctcctagggcttggctcatgcttctctaccgttttcatgttttcaaaaggccacaaataatcagtgggtcataaaaccaacagggctgcaagcagaactgaaaaggaaagaattggaagacagtaccctagaagtactattgcatttagtaaggataaatattcctgtgacattttccatttacttttatgtattggcataatattaaatactttttttttaaactatgggaccaattttctaggttggtgctcctcaaactacctgggaagacctagtttttaaaaatgtgcagtctgctggactgccatgtggtcctcctgcacagaagcaagacacaacacacaccagacgcccagagctcaccaagacaagtactggttctgtggccatgtgtgtggaggttatgacaatgccaaattactatacgtttctaaacattcacttttgattcctgcttcctcgaggccctggcaaccaccattctttttttttttttttttcccttgaggcagggtcttgctcagtcccccaggctggagtgcagtgccttgaccctggctcactgcagactcaactgatcctcccgcctcagcctcctgaatagctgtaactaggcacatgccactacgcccagctaattttaaaattttttcattaattttttgtagtgacaggatcacactatgttacccaggctactctcaaactcctgggctcaaacaatcctccaaccttggcctcccaaagtgctgggatgccaggtgtgaaccacggtgtccaggtgattctactttctgtctcccatgagtttgactactctaagtactcatgtaagcggaatgtagtatttgtctgtctgcatctggtttatttcactgagcagaatgttcatccatgtggtagcatgtgtcagaattcccttcctttttaatgttgaataatattacattgtatgtgtgtaccacatattatttacccattcatctgcaatttatttttgactatggtatgagttaggaactcaatttgttttttcatcttaggaatagtcaatatcccagattccgcaaccccagtatctcctttgcctggtgacatcaatgctgcctcagtggtggaccaagattctttgtatataaagctttcttccactggcctacttgtctactccagaaccaatgccatatggtgtcttaactactggagctttattacactcagctgccgtatagaatcttccttatatatgaccagattcttttgtcaatattttatctacaatctatgtatctgtatcaagtgacaatgatctgtagtttacctttctcctatccttgtgtggttttggtgatcaaggttatgccgacctcagagaatgagttgggggatatgttctttctctatttttagaatatctaagagcaatttattgcttgagtgtgaggaagaacttgcatatataaccatctgggcctgtgtttcctggattaagatttttctgattgaattacttgactggctatacaattatttaggctgtttgtttttttttttctttagtcaaacttcaattacacttttctctaggaaataatttatcaatgtcaaataagttggctcatttcttagtataaaatttttcacagttttatctttcaagatatttgctttatctaattcattttatttgtttttaaacattcaatatgcatgtagacttttcagggtttgctttttttttgtttgaggcaaggtcttgctttatcacctaggctagagtgcagtggcacggtcactgttcactgcaacttctgcctcccggactcaagtgatcctcccacttcagcctcccaggtagctgggactacaggtgcatgccaccatgcccagctaatttttgtattttttgtcgagatggggttttgccatgttgcccagtctggtctcaaactcctggacttaagtgatccacccacctcagcctcccaaattgctgggattacaggtgtgagctaccacacccagcttcagctatcttttttattaactttattgaattgtaaacagagaacactttaattctaaacaactctctcaagagagtaagtctaggccaggcgcggtggctcacatctataatcccagcactttgggaggctgaggctgatggctcacctgaggtcaggagttcgagaccagcctggccaacatggtgaaacctcgtctctactaaaaatacaaaagtagccgcaagtggtggcacatgcctgtagtcccagctactcaggtggctgagatgagacaggagaattgctcgaacccaggaggtggtagctgcagtgagccaagatcgcgccactgcactccagccagggtgagacaaagagagactctctcaaaaaaaaagagagtaagtctaaagacttactcttttccaacattttagatgtcattttttaagcttcatacattaaacattattactgctttatatggcaacatttaccctggattcatatttgccaatttatttattccctattccttcttgctttccttctaggataatgcttattcctaaagtacatgcttttaaaattccattggtaaataacctctctcagatttggttcatctgaaaatattttcactttgcccttattctttaaggaaggttttgatgatagttacttgatactggctgtaactgttgctattcaaagacctgctacttgctgttcttctgaaggtactgtgttttctccctgcttacctctctgtatttggtattttctacctgtagcttattctgtttgttatacattataaatttcctgtcatgatgggctgaccaccaattctaaatcaatttcagttaccatctcttcagattattgcaattcctccattctttcctactgggattgcaatgggcatgtttgactttctcagtgtcttcaacatctcaagctctcatatgttccatccccttgctcctctgtgtgaaattctgttatttcttcagattcatctttcattaactcttttatagctgttgtttaacattgtttttcaaatctttctggttatttttgatagccttttgttgctcgctattataattccattttaaaaaatatctttgaacattttatatctaattattttacatttgtatctagaaattctaatgctgatttccttagggatctaatttttattgtctctgctttggtgtagtttaattatgtgttctttgcttgttcaattgacagcaatcccaaagacgtaactaaactggagtgctttttccagagaggatctgtttatttctcctgagacaatgacaacacccacctctgtgtatattttactgcttttaagggttcccgttcaatcctgatctctgactcagatctcccactagagcactgatatggccatctgccctcagggcaacccagcttagagtgtttaaaattctctataagcacaacagtacattaatcagaagggcccattagaggatctagttttccctacttctaaaagtggaagttcaaacctgtgtttcaattttacatacactcttatataatgtaccctcccttagagtgcaaagtatcagtactatcctttatcatcagtttaggagttatatgtagtattactaccttaacattaaaaacaataacattaaactgcctgtaattaattataaaagcttagagtattcagttaaggtaaacgatacctaaaatgttctccacaaagctaaagggaacaagattatttcttagtttattaaaaggaaaaaagaaagtgtgattcgaaacccaaggaactgaaaaataaggtcagatgcctcaaatatgaggaaactgccagagaataagctggatccctgcactgacaccaagggagtaactggctaaaccacaggcagctgtgacacagctgtgacggcccagtccccgaagggaccagagagtgctgtgaaggagctaagtgctagcttcagggaaagcccagccaagccaggctgtggtcactcccgaacactaaggctagccctggcaacagctctgtgggagggtcaattgtcaacagtcacagtgaacaggggcacccatattactgtgctccatgcctgtggtgggacagcctgatggcaggattgccaactattacatcctcctgcaggcatattcccataggtaataggaaagtgaatgctttcttgaattttggactaagtcctgtcatttcactttacagttaaattgtctagatccagacacctaaacagcataaaatcagggatgaaaacagaggcattcagacctgagagacttgtgtcagaaaggtcaagcctagagaagctgctaagtgaaaacggaagctgaagaaaacaggaggtggaggaggatgtgggctcccaggaggagaggtgagcctaggaggtgttgccctaaggcagagccaggctttgcttctcagatgccacacagcacttggccccactgaagggcctgtcagcttctgtggggcaggtatcccaaggacaaggacccagcagggttgttattgtgtctccacagccctgcaaagggcttagctcagattagaggtgcagtggggacctttcaaaccaagacagaaccagcagccttgccaccaaggtacacagaggtatgactaataagtctatcaatgttcccctgtaaatgcaatctatcctcaaaacagagttaccaaatgaattagggctctaaatatgaacccgggaaaacttaataaccaaacagtaggcagtaattaggtgataagatccaggcatacgctgcttaaaaagaagccccattcaaacattagaatggacactgcaggtggctcttgtcaggaatgacctgcatgaactgggctcaccttttcattatagttgatggcaatcacatccccggtggtcagacaggcaaagttcctaagtgcgttttctaatctgcagacacattctgtcaaggcaacatggcaagatggataccttaatctgaaacaagtttccatgttagatgattactggtaggtagagactgtaccatgatggtacttgaaacacgaagcttttaatacaataaagtactacttggcaataaagaaggatggaactcctaatatgcaataatatggatgaaatgccaagctggggtaacaaatgccaagctgggggaaggggaaataaccaaccacaaaagggcagtgagattccatccacatggaaccctgagaaagacagatctatgaggatgggaggtagctgagaggtttctgggccaggggatcaggtggggactgacaggaaaggaccttttggggacatggaaatgttctgattacatgggtgtatacattttcaaactggctgaactgtgtgcattttattgtatacaaattataccatgggattttaaaaaatcctgtgggagtactaaagaacaaaaaagatttaatgagtcagataggtcctctcaaaagttcctcaaaatcaaagatgctttcatttatacttctgttgtttctatcttttgagctgataactttagttaatagaaattaaaataaagaaaccagcaaatactttttataacagtaaaactgtagaacccaaatgcccacacaaggaaatgtctattcatgtggaatattttgccatgtcttcctcatcaatttgctgaaggactttacataaaaaggtcacatgaaatgtggctccagagcctgccactgtgagtccaacttgagggtgaaagggtgaggctatctaggttcacctcgcttggtcaaacagctttccagaaccagagcaactttgtgaaaagcgccttatgtggtggatgctttctttgctcccaaatatgaagtgccacggtacgaagtgcccttccctccactcctctagtgaccctgccagggcatcttctctgacttccactgcagcagctggaggagcagagccagagccctcaggctgagaacacgaggcctctgcaggcagggcgggctccccatatggcctctgcgtactctggcacctgctgcagcaccagcttcccactttctctgctcggtgccaagactgctttcatccagacctcagccagaccagaaaacaccaggctctcaactgatggaagtgacgccctttctccacacactaacaagttaattgtgctgacaaaacagcatctgagatcaacctgataagtctgcattggggcagggcgcggtggctcatgcacgtaatcccagcactttgggaggctgaggcaggtggagcacctgaggtcaggagttcgagaccagcttaggcaacatggtgaaactccgtctctactaaaaatacaaaaattagccgggtgtggtggtgcacacctgtaatcccagctactcaggaggctgaggcaggagaatcacttgaatctgggaggcagagtttgcagtgagctgagaccgtgccactgcactccaacctgagcagcagagtgagactccgtctcaaaaaaaagtctgcattgcaacacatgtaaaaaccctgagaaaatgggcatggcccattcctggtcactgacagccaaacaagcatgtctaggtcagagctctgaaggacaagttaactagctcttcccataggacatccccctgcctgtgggacaggaggctcaacaaggccatcgtgtccagaacataggcagcaaagaatatacatggcccatatgcatccagagcacacccagcagtgccttgctcctaagaaaacatgcggagagagcgctactgggaaaggaggcagcttttcttaacttcctatctgtctgtgttgtttgactgtttgttttttttttcaagtatgcattaaaaaaaaataaaaaaaaagaagtagaatggagtggccactcttatgccatgatcgtaacaggaaaaatcagggccatggagctagagatcttgattggtgcacacagcaccgtcccgtacctgcactgcctacttcctgatgctgtcaacacatacacctggcttaagttcagaggtgaacaaaaagaatccactagaacctgatacctttgctttctgcttggtgacatagaaactgcagtcattgctacctattggcctggagtgaatcagctctcaggctggcatgcagtgaggttgacgggccagtgcacagctgggcggaggtactagggagccacagaaggggctggagctgaaggcagataagctgctccctccttccactggacatactgtgcatcctggctttgtgccaggtgacacagaccaactgaaagaagggcttcattgtggtctccatgaagtgtctggaaagtgacagaggtggcccagacagcacccagtgcacttggccagggccacgcagatgtgctagctgaaccccattattctcaaatcacaacttgaatcacaaatgtgtgatccccaaagcaggcacagattcaatacagtacatgatgtttaacaaccgccagcacactctcctttgtctagaagaactccgcttatttgaaaaagatacacggctttggggttggtgatgtccaggaagtcagggctctgaggttggaatttggagtaggtggccacttgaaggttgacgctctccacctggaccaggccgccttcttccaagagtaagttctgcatcatctgaaaggaagaagaggctacatgagactcctagagatgaagcagcctccacaaccactgctccctatacactgggcaggcccgtcttacttgggtccttggaagaggaacctgagccaagataagtaattcgtgatactatgtcaggaaggagggaaaaatcaagtgatgtggaaggaagaaggccaataaaggggtgctactgaagctgtatagctcacagtgtgaacgcatctctgcagggctgcccggattactcactagctccaggcttcccaggggcagagcattttcctggaatagtcactcactgtacttccaagctgtcccacaagcaaattataaggccctgcgtcaagtagggctgcacctgaggtaggacaaaagcagcacaaggcaaggctgacctggcaatggaatggcccaccacagctgaggctgcaagatggtgacagaccccagaggtctctgctaaggaggttataaaaatctgacaaagcctccacatgtctctattaaacaacccagccaggtagacgacggctgagaagtgagacggaaagagataaacaatgcccatgagtactgggtgtgcagggagtccagactcaggtcagaagctctatgtctcttgcaatgaaattttgcttgtcttatttgaaaccgtcttaaaaggggtgtcagacatatacatcagtagaaagagccgtagaagagagctcccacgcaccgagccctgacagttggacagtgctcacgtcgtggctcagtccatcgatcagcactacctcacacccagtcccaagccacattagatgccctgaagcaaatcccaggtatcacatcccttcaagaatgtttcatcgggagtggcagtgagaaggtgactttaacagccaagggaaaagggggctgagggctgtgtcacaaatgagagggagctcatgaggagggagaggcatgctgaggccgaggctgtgcctgggaagccgtgcctaggccatgagtgaagcctgagtggtgggccctatggataggcttgcagaggaccccatgcactcacgctgacagctgcttgtcaggctagtaagggcagaaatagagggtggtcactctaccaaatgccacaggcaggcacagaaggatgcagaggtgactggctttggtaacgggggtctggcatccccaggagtgatgttctaacaggaagtattctaaggctcagagttagccagtcgcaggccaggcgcactgtccctgggtagatttttgtgggaaatttgtcagcgaggggaaggatactgggctgcaattgcaagcctgagggaaggctggccagggatggggggtggcttcctcagccagaggcaggacactgccataggtgatgtgaggaggacaggcagagaggtcagactagggcttgaggtgagaaatgggctgctggaagaggcctgagagcactaagcaggcaggaggagctgatgcctggccctccccatgcagcattttagagcatacagcacaacgggcagccgagtacccacatgtcacaaacggctagtccagggctcggatctaggtcagcagacgaagccttggctacaaggaaaaaggccagtacctattccaggctggctcgccctgaagaagcttgggagcatgggtgggatggagtccaccagccagcccagaaaaagcactggctcacatgccctccaagacagcagatggggtatacctgtcacccgcctgcccatgccaggagctggaaggccagctcaggggaagaggtggcctgatggcttcacaccccaaaccagctccaggctacctaaagaggctttccaggggagaaagggttcaattagtttcctggtctaaagcagtccaacagcttggacaagaggccacccaaacttcaagtctatgggttaaaggagaaccttcgagatacagtgtatccccagcatcaccacctcctcttataggtgagccacagaagggactggggaagtagtcactgcctgacacttcagctacctagagtggcttcagtgaccaggtgttctaccggatgagcacaatgtggcctcaggcccttgggggcacctgcagacaaacacaagaatagcaaggggctgagcagcaaatactggggagggcaggtgagccaatctgggctttgaggcataaaagccccccaacaggccaggttgggcaggcctagtcagctgaggtgaggaggcagcatgggaaggccaggcactaggaggtgcaatgggagtgcagggctcttgtcggggagacactggccaggcccagaccttgggaaggaccctgggacccaggctgaagaggatgccactaccatggcagcatgggcaaggtcacctgctacagcaggaaagagaccttcagaattttgattcatattattgttgttttttttttttgagatggagtctcgctctgtcgcccaggctggaatgcaatggcatgatctcggctcactgcaacctaagcctcctgggtttaagccattctcttgcctcggtctcccaagtagctaggactacaggcacgtgccaccacacccggctagtctttgtatttttagtagagacggggtttcaccatgttggccaggctagtctcgaactcctgacctcaagtgatctgcccactttggccttccgaagtgctgggattagaggcgtgagccaccgtacctggccagaatttcaattcatatttaatctcagaaaatattagttaaggccatcccttctgaacgtctggcggccaccatgatagggcatcagcaggagaggtgggctgtgcttcagaccacctccctggtggcagccaagcaagcactcctgagagtttccagcccacagctcactgcggggtctctcagtatgcctgatgtaatccaagcacaaagagaaggacaagcaggtccctttgtgaacttccctaatgtgccagagctggggagaggagtgaggagaagaaggagccaagtgggccacagctacctgtgtggaactctcactgctgcaggctcctccctacagcactggcacagttctgctcacttctctgaggggtacagccttgagggcaggctctggtggctcacacgccctggatatcccagcccagatctgcaatgacatccttcaagtcaactttccaaagagagcctgcttgtaaggaaaaagacgtcactcccatggcagctcagttgagagatttgggagactacgtcagaggtaactgaaaacatgtatgctgtgacagactactaaaagtaggggaaaagcataaaaacctcaaacaccctacttactagaccacctaaaaaatactgttgctccattatttttaaaaacgcctcacccaggaaatcacagatgaacagttcagctgcgcaactatcaaagaaaaggccactcccacagcacagtggcccacaggtgcgtccagagcccaccagcccgcataaggcacagtgcactgctctggatcccttctctctcgctgggtcggctcaggctaagacgctgagcaggaggagtaggcggggccacctgctccagggccaggactctcgagtgcaggagatgtctctgcctaagtggctgctctctagagaccctggcagccccactcacccagtgtgggaggtagcagatgccctcatcagccacaaactccagcacgccacaatgcgtcatgcggtccgaattcttattggtcagtttgaacagcatgggataggtaatgttaagtcggcctgaaaataagagagagactatgaggcacagctcctatgaagggacacctgttcggcccacgccttcccatagaaggagcctccccacaatcctgccctcaaccccacactcctctggcagatgaatccccctctgtgagagcacagtgcacggctcaaggaggaacctggcaacttggtaacacagcactggcatagacttgtgattttctgaagtcaacattttaaaaagtgatgtgttcattcatttattcataaataatttcagtgcccaccatgccctggacaaaatcccgaccttcaaaggtttctagtttgaaggtagaaaccttccaacaaagaaaaccacaaccagatgctgcaggtgctgtgggaagagctggcaggagggggcagagctactgggctaggctcctagaggccgagttctttaggctgggcactgggcgggcagacctgggaggaaatccaggcagaggtggcagcctgagcaaaggcgtggaagggaagaggagcccaggcagttcagaaatggtggataattaggcaagacaggctggggacaggtgtgcgagtggttgggaaggggaggggcaccacacggggtagaacctagggcctgggcccagcgggcagtgtgagctctcagcagggtcatgacataggacgccccctctctctgatggaccttgaggtgtgggctgaaagcaaggccagaggcaagtaagctggactggtgacgtgctgacccaagaggtgcacaggcacataaaggaagggctggcaaaaagaggcaggaaaacccaggagacactgggcccccgggagaagaccgagaaggaactgatggtagtgatggtgtttgccatgtgtaaggcccttgttcagtcttcccagaacagtcaggtaggtactatcattatccccttttatctatggggaaactaaggcccacaggttaagtaacagcacacaagtggtgagcacacaagacctcacagcacacaagtggtgatgccaggattcaaaccaaggctgctggcttaagtccagggattcaaccatcaaagcagaatttagcttgttagttcagacaaatattccaataaaaatcacacttagtgttaggaagtaacgcagattccatttgagatctccctaaaaattctaataaagcaaatcaagttaaaagcttgggcaggaagctacagagaacctctgagagtagcatggaggtacagtaagggtgggcactccctcctatcaccaagggtgactctcacactggcagtaaaggggccaggacctctgtcccggtccacctctcagctgcacagccatggagctgacatacagctggtccacagtaaactggactgggctcagccaagggtctgagattgttgcaagtgaaagagactccaatgtccctcagtccactgactctcaaactgcattttgtgacttagaggctcccagtgccctggggctcccagtccctctgtaccccctcactttctccaaaaaaagcagagaacctcattttatgaattagaggacttcctataagatttagacagaaagagtttctcccatcacttaaaagatttgaacaacactgatctgagctacacctcaatgacccagcccctgagtctcttctggacacctgtgccaagggtcacccctggtgtctggctcctgggtcagcatgacttgaaaggaagacctttttagggagcctgttctctcctctgtaatgacagggtcttcgtgagaactgtgaactccatagctctgttgacctactggttgagctgaggcctccactgggtatagccacagccagtgctggctcaggggctacctccaccttgtggttggaatcggatagcttaggttgtcacagacactacagtacttctgatgcacagacactgtagatatccccaattaaagaagaggacattgaggttcagagaggtcaagttgctactctggagtcaggctgggcaaagagcccgaggtgagtcacaccacagccagcacctgttctctgcttgctgccaccagaggcccccaaaaccaagcatgaacctgtcctcctggccaaccccagtctcctgcctcacacaggaagaattcacaccagaaacactctttaagtctggaaggcaatgactgcatccttgattgggttgtccatgatagggattttctgtgcctgtgtagtatggggctagggcatgggtttccaggttgctctcatgggataaggggtcagagaaaagggaggaagaatgtggccactcttagaacccctgtgggcctatctcactcctggtaagaggcaggagcccagcaagaggagtggcttctggatggaagacaatagctcagtttttgacatgctgaggatgcattggtgcactggagattagaaacgggggtctgggccgggcatggtggttcacgcctataatcccataactttgggaggccgaggcaggcaggtcacctgaggtcaggagttcaagaccagcctgcccaacatggcggaaccccatctctactaaaaatacaaaaaattagccgggcgtggtggcgggtgcctgtaatcccagctactcgggaggctgaggcaggaggatcacttgaacctgggaggcagaggttgcagtgagccaagattgcgccactgcactccagcctgggcgctaagagcaaaactctgtctcaaaaaataaataaataaataaataaaagaaaagaaatgggggtctggagctcaggaaagatgtttggtgaggggatgaggaacctgctcacagcgccctcttgtgagctgaccaattcttcctttaggaaaaaaatctagtgagcccagccaatggcatcagctgccctggcacggtacaaagcacttgatacttgtaccttcacttaatcctgacagaatactgagaacagttggggggtgggtggaggtggtgatcaggaagggaaagggaacccccttcacagaggaggaacctgaagcacccagggcagtgatgaagctgaggttcagggggccctggcctcgccctaggtacctgtgacccaggttctcccagcccagcgcatgccctccacggacaattcacaaccagatgctgacaaagggcactggtgtctggatgtactgaggagcccatgctgactcttggtgtccatatgtacattatctaagtccttaagtcactcagaagatacttactgagttggtccagggccgagggtggcataattactgtggaaagaacatttaagaaatattaaaaaataaaaataaaaaggacagaccaaaggcaagatgcagtttctttatatctaacaaaaagccttaaactgtttttagggtagccagaatgtcccagtgatctttcatgaagaatcttacttgatgtaatttattttgggaactgaatggttatcagccataaacctaaccataattagcaccccaccccaacagagcaagtcagggataaatcccagcaccattttcacagtaacactagcttctgactcccacatgcaaagtaagtactgttgaaggctacagcattgcagacttagggcaggaaaagttactattcaaataaaaacaagcacatactcttccctcctttctccacatctgacctgtcattaggccctgctagcatggacacagagaagcagcggtactgtgtggagaagcggttttggaagaccctgggaatagggtggtcgaacatgttgaaagagaactagaaggaggaaagagaaacaagtattaaaacaaaggtacatttcttcatgtcaaaagccaaaacatgtcagagtaattaatgctactaaacattgtcagagaacacaatgtactgaaatcttcaatgtaatcttactaaatacaaaacaggccatgccaagcctgtcctgaacctttttcagggctatgctcccatcttcatcctcaggatcaaggcccaacctcttgcatacctcagagacttgtactgacagccccacagactcctgcctgggctagttcctctgccttgaacacttttcctattatcattaatctaaacaatatttgttaattgaaacatctctttattgagtgcctactgtctgccaggctctgatatgagcacaagggaagcaccactccagtgatgtctgtccactaacaaaatagataccacccctgtcctggtgaaaatgacactcaaagcaagagagatatacactccaagcaacggacacacacacatgtgtgtctggcagttctgaagacaagcagcagggtaagtagacacagggctcctgggaatgctattttaaataggtggttaggaagggactctgcacaaagacctgaatgctatgagagggagccaggcaaaaaagagggaaagacattccaggcagcaggaagaacaggtacccagtggttgcaccccttcccctgggttccaattaccatcctttcctttccccaggaagcctctcttgctctgctgagggtcaggtctagtgcctctccagcgtgctctcacagcacaaagtaggtacacgttacactatgttatgatgctttcttacagcaacaagcaaagctaaaacatgatgccattaaaaagataagatcctagatcttaaactgtagactaagatgaggcttagcaaacatgtatcaatttgaaggttttctcaaagtacagtattcctcccaccccccacccccatatccacaggggatacattccaacatccccagtggacgcctgaaaccacagataatactgaaatctatacatactatgttttttcttatacatatctacaattttcttatacatatctacaataaagtttaatttataggctgggtgcggtggctcacgcctataatcccagcactttgggaggcagaggcaggtggattacctgaggtcaggagtttgagaccagcctggccaacatagtgaaaccctctctctactaaaaatacaaaaattagccgggcgtggtggtacacgcctgtaatcccagctactcaggaggctgaggcagaagaatcgcttgaacccaggaggtggaagttgcagtgagccgagatcgtgccactgcactccagcctgggcaacagagcaagactccatctcaaaaaaaaaaaaaaaaaaaagtttaatttataaattaggcacagtaagagattaacaattaataataaaacaattacaacaatatactgtaataaaagttatgtgaatgtggtttctattttaatatttttggaccatggttgacctcgggtaactgaaaccacctaaaatctcacaggaggatatatattcaaaagaactggaggcagaatcaagaagagatttttgtacaccccgtattcatagcacaattattcataatagctaaaaggtggaagcaactcaagtgtccaatgacagatgaatgaataaacaaattgtggtatggtatatacatacaatgaaatattattcagcttttaaaaggaaagaaatcctgtcacatggatgaaccttgaggatatcatgccaagtgaagtaagtcagtcataaaaggacttatattttatgagtccgcttctaggaagtacctagagtaggcaaattcatggagacaaagtggaacagagattgacaggggctgtgaggagcagaaaatggagagctattgtttaatgtgagtagagtttcacttttgcaagatgaaaaagttctgaaaatctgttgctcgtgaatgtactcaacactattgaactatagactgaaaaacggttaagatgataaaaatttggtttttttaaccacaactaaaaaaaaatctgtattagagaaaatttcttgacttgattccaaatatatatttagtagaaggaatgccacctactgacaaagcagtttactagcaactccaaaattagcaagctgaattagccatctcccaaaatgcaaacatagcatgttcccgcctaaaatctgggatggttctttactccctggcactctaacacagtaatttccaatcttttgtctttcttcttttaagcagcataactgttcagctaaatcttggccagaaccataacacaggaaatagcgtttctgggtgaacaaggccagaacagggtaggggcttgcttcccttgagtgcttctcactagccaacctatgtaagccatttcttctctttgaatataaaaggtaaatccgcacaaaggggcaacatacttaacaacctgcctgcagtttacccatgaacccgaccttctgccccttctttgctgctcccgatcccatctctcactttccttttcaatcccgagacctagcacactgcctggaacatatcaggtattcttgagtggatgaactcaagaatagaaataagccagggtttgacagtgacacacttgggataaaatctaacaatcattccttgtctttactaaaataaacaggtgacaggaagacaataccgtagagtgctttgcagccagacagacttggcttcaactctccagtccctacttctgtgactcgaataaagtacctctgtaaacgttagttttctcatgtttaaaatcatcatcatccttgcttccaaagggattgtagggattaaaagaaataagccgcgatgagggagtacaggtgttaaaagctgtgtaacaggaaatgtaccagcaggtattagcttccatcgttatcattaccgaacacaacaccgctgtacagattcgaaggcacgaacccgtaggcacggagctcacggagctggggcaagagctgggtgtcccccaagagcgggggatgcccactacggattctccctggggagcgccctgattctgttcccatccccagcaaccttgcaactaactttgggtttatggaaacctgttgcgcgtccagcacttgggaaacccgtgaatggacacaaaccttcctttctttcgtcaaggagggcaagtccggctgagacagaatgcgagccacgttcaggaccggcggacgcgaccacaggcggttagtggtcaagggtcctgcttgtgcccggtgcggccgatgagcctgcaggccggactcaggcccgggtgactcggcacctccgccgccgtcccgccccgccctgccccgccgggccctacctcaggccccgggccaaggcccagcccccgcccgctgcccgtcagcgcttaccatgatggacaccacctggcagactccgctcctctcaggcaatgcaacgaagaaaccccgccgaccgctctcccagccgccgctgccgctgccgccgcgccaagccggtacgccccagaggctcaccggaagtgccggacccgagacccggagggggggtgcccgggacaaagcgtcggctgcaaaagagaaaaggccaggcgaagacgctaggctctaaaacaccctcagtagaagcattaaaatgccctttcgtgatttatttccccttttataggtatttttaaacgttattttaaattacgtgttgacagtattcccctccagacgaatttagtagggcccattgtccttacgactacactacccacaatgcactacccagactgcctctgcttcagccatcgaggactcgggcggaactaagctacaaatccttcttcaaaccacaccaaaaacctattgcaaacgtaaatgctgccccattgggtatgtgactgagtttaatgtatggttagaagtatactttccctgagggttcccagtgggaggcagtaggcttctcttcccaaagtaaagatgtccgcccagcgtcgcttttctgggtaaaagcgagtcagagttgaagggggcaacagtgtttgcgttcggcctcagaggtgacgcttctttgggggcgggctggagttttctggccgtgaatggcagagcgctaatggccgcctccaatgtggcccaatcagaaagaaaggaaggctgggaactaagaagctattggttggtgatccctggaccaatcggaggagccgtgatttggcgggagtcttgaccgccgccgggctcttggtacctcagcgcgagcgccaggcgtccggccgccgtggctatgttcgtgtccgatttccgcaaagagttctacgaggtggtccagagccaggtgacgcccagtccgggacccccgccgaggccttgccggtggggaagggatgagggggagcgaccgtgggtgaccgggaggcaggggagggccggggttcgggtcgccgtgttcagccggtctgctcttccccgatagagggtccttctcttcgtggcctcggacgtggatgctctgtgtgcgtgcaagatccttcaggtgagttctgcggaccctaggagggcggggccggcgcgcgaggtgagggtgctgcgtgggggcgcagggcgggcagagtgtcaggatgggtgctgagggcttagggtgggagagggagcagggcaggaggtgaacagcaagtgagaggagagagactcggaggagaggttgcctccctgtcccaacggtgtggggtgggataaaggattaagtaaaaggtaaagagactagtttgtatttttgcaataagctattaatattaataggtgaacacagcagttgcatttgggggaaactttggatctgtcgtggcctctcaaatgggggatttgagagagaggaatctgtgacaactgtgggtatagtcgtgtcacaggtgttgctgggaatatgggagcccctagtctattagggaagatcgttagtttggttttgaatagggcatagtatttacgttgttttggtcaggcccttggatcaggaacttttcagaaggcctggaagttaaatcggcatttctccccgatgttttactttggtaatttgcaaaattcacagaatggtatggtaaacgctcatatccctagcacctagcttttcccgtaagcatttcactagctttaatgttatcccgtgtcttttgtctctcaacccgtctaatcttcctcagtttcttttcaaggtaaattgctaatgtcctaaataagataggctttgaaaacactctctctccaggccttgttccagtgtgaccacgtgcaatatacgctggttccagtttctgggtggcaagaacttgaaactgcatttcttgagcataaagaacaggtattgaagatgcgttttagaataacgtggctttttactcaattgtaatttcttgacacagcattctatttccacgatagattaagcgtgtatttaagtatcagctacattaggcaatatggaagagaaaaacatgctgtatttactggtgacttaccacgcccaagttgtagaagcaaaattgacagcaaaaaaagataatgaatgtggatagccccaactttgaacttgttttaacttgttttgcagaaatttgattgtaaggtgcttggaatctagcagtttttaatatggtctagttaaaattattttattttattttggtttatttttttattttttattttttttgaaacggagtctcgctgtgtcgcccaggctggagtgcagtggcacgatctcggctcactgcaagctgtgtctcctgggttcatgccattcttctgcctcagcctcctgagtagctgggactacaggcacccgccaccacacctggctaatgtttttgtatttttagtagagacggagtttcaccatgttagtcaggatggtcttgatctcctgactttgtgatctgcccacctccgaaagtgctgggattacaggtatgagccaccacgcccagcctttatttatttatttttgagacggaacctcgctttgtcactcaggctggagtgtcatggtgcaatcttggctcactgcaacctccgccttctgggttcaagcgattctcctgcctcagcctcctaactagctgggattacaagtgcccaccaccacgcctggctaatttttgtatttctagtagagacggggtttcgccacattggccaggctggtctcgaactcctgacctcaagtgatccgcctgcctcagcctcccaaagtgctggaattagttaaaattattttagaatacactactattttatgttatttctctgagaaaatgcatcctggtttccaacttaaaatccaggaataaatttaaacaatagatgccaggattcctcccacctctgcatggggccaaatgagagatgggacattgtacaccccacagagaggggatgggacatggaagagggtccctggagtccctagccatatctaggattgttttggcagagacaaatcctctcctgatgttcctgttattatgtcaaggacccgcaccagcttggtatttataaggaaagaaagtgctatagtgatagagtgtgataaaggacttaatatttaagtacccataaagtatttgctaaaaacttaaacctgtacgatgccattagcctggagaggcacgcagcatagtactgtgaggtctggagagacccaatcacgtgctcgaagtcttggtctgctcctcattagtttcttgagcctgtccacgagacttgggcttgctgagtctcagcgtgctcctggggaaaactgggagccccagggcccaccctgctgtgtcaccatgctaaagcacttagcatgccagcctggccattttttggagtcccttgccacgtgggcctcgccacatgtcagggactgagtgagtttaagcagaacaactcagaggcttagtgatgaaggaaaaggggcctcctcgatatagctactttacaatatcttcctttttttcagtttcattattttattctcataaactgtggagctaatgtagacctattggatattcttcaacctgatgaagacactatattctttgtgtgtgacacccataggccagtcaatgtcgtcaatgtatacaacgatacccaggtactttttgtgctatgccctcaaactgtctgtactttttatgccatgtacaatgtctcacctggtgttcttggtaaggtgtgtgtctgactaccctgtgggactgggaacagcctgaacacaagaacttggtctttgtcatcttttttttttttttttaaggagagtctggagtacactggcacaatcatggctcactgcagcctcaaactcctgggttcaactgacccttcctgcctcagcctccttagtaggtgggactacaggcacatgccaccacgcccagcaaatatttgtttttatttttgttgaaatggagtcttggctgggcgcggtggctcacgcctgtaatcccagcactttgggaggccgaggcaggcggattacgaggtcagaagattgagaccatcctggctaacatggtgaaaccccgtctctactaaaaatacaaaaaattagccaggcatagtgttggacgcttgtagtcccagctactcaggaggctgaggcaggagaatggcatgaacccaggaggcagagcttgcagtgagccgagatcgtgccactgcactccagcttgggcgacagagcgagactccgtctccaaaaaaaaaagaaaagaaaaatcagcctggagttgctttcagacaggagttttagtcaccacttaggggttacacatcttcatgtcctatatcagacagaggccaagttgtggggcgttcattttattggtgtatgacgtaagaggatgctgtgtttccagacttaagtagactagatggttctcaaagaactgttttcagattttcataatttctgcataccacgtatggtgtaactctggtgcctcactggtaatgaaaacaagaaaattccttagaagcctggaactcttgttaaataggtagctatttgtatgaacaggaaactgagtcagcttattaggaaatgataagattctgcagaagaacatattgtatagttttccgtagaaagaggagaggcttaattcctttttgttttgaacttagatcaaattactcattaaacaagatgatgaccttgaagttcccgcctatgaagacatcttcagggatgaagaggaggatgaagagcattcaggaaatgacagtgatgggtcagagccttctgagaagcgcacacggttagaagaggtgagtttgggtctctcacagctatcccagaggaacttgcactcccagaggtcggaggtcatcctgaagcctgccaggccaaggtgtactgagggcagtgggaagtggaaaagttagcaggcatggatgctgaccctgggctctgctgtcccctggttatgtggcctcaggcaggttactggacttccctaaatagtggcttatctgtccaataggatcctgtcagaagaaatgaaatttaggacagctcagctctgcggctagatagcaaaaaaataatgtagagaagcaataaatagtgtaacccccaccccttccttttctactgtcttctagcatcacttactatgcagtcactgcagaggagcaatgtgggtctgcatcccttggccaggcccagtcccagacaattactgcaggggaggtatcttgtatgtgaagataccagtggttttcaccatgtggaccttgggtctgagctgcttagtgatctggggctgggcccagtggcctacccaacactacggcttctgcaagatgtaaaatgacaggcagaaggtggttgttcccatagcacggagggccacgtgatgcttttgaagatggcctctggctcctgatcttggtgtgtgacctagaatttgcccccgtaatgttctagggtcttcccttcatcctcagcctgacatttcccggtaatgtgcttttgggaagcctttttgagccatatttgagatgttcaagacattcttcatttggggaaggggcaatgcccttcaaactgaggcatgcttctctcttctttctcacctttgtcacccctttcactaggtttgggtgtctcatagggaacctcttggacccactgttatattttcttacctcttgcccagctctttgttctattttttggaagactttttgttttttgttttttttttgttttttccccagacggggtctctctctgtttcccaggctggcctcaaacttcgggctcactcgatcttcccacttcagcctcccaagtagctgagactaagcacatgccactacactcagcttggtctttatcttctaatctttggtttgtgaggggtcctttttgttctctgaatttttttttatatagcattcttttaactatcgatgagctgcatttcattggttcccaaatgtcagtatccaatgggatttcccgggaaacattcatgttctacagataagtcttggaattttccactctgactaataaacaaatattttttaagcacttactatgtgccaggtaccagttaggccctggggtgcgggtatgagagcaaagtcctgcctttgcaaagctttccattgggggagacagatactgatcatgtaaatgagcacaattagggaaagctttcaggtatcaaacatgagttagcaggggatggagccaagaggattcctgggcagagcatccatagacactgcagctctgaggtgggaaggaaagtttcaaggaaggcttggccagcagtgccaaaggaacaggcaaatgagaacagaccagtgggtttggcaataaagagaaggtaggttgtcttgatgagatacaggaaaataatcagcgtttccttttacatacttaacacatcaatttggaatttgtgtttgtaaatgtttaacataatattcatggattataataggcataatttcccaccaactttttattttgaaattttttgaaatgtatacagtggttgaaaggatagtacagtgaatatccatgtaccttcaatctagagtcaacagtggatcatgactgtaggtggtctcagctacttgggaggccaaggcaggaggattgatgaagcccaggaatttgagaacagcctgggcaacatgaagagaacctgtctcaaaaaaaacaaaaacagtttttcacatttgccacatttgctttctttctgtgtattcttttttctgtattatttgagaatagattgcagaaactgatattcttttttattttttattttgttttttcttgagatggagtctcactctgtcactgaggctggggtgcagtggcacgatctcggctcccttcaacctctgtcttctgggttcaagcgattcgcctgcctcagcctcccaagtagctaggattacaggcatgcactgccacagccagccagaaaccatgatattctacacattctttcataagcagctcctaagaataaggacattcttccccataaacacaatgccattgtcatacataagaaattaataatatcctaatatcatgtaatattcagcccatattcaggtctctttaattgtcctcaaaatatattttgcagctatttttatttctgaactattctccaatcaagattaagacatttagctattcctctttactgtcttaacctagaaccataccttacctcttttttttcttttgtttttaatgacattgaaggccagttctcttttctaatatttactactacttgtttcttcatggagtactttaacttgcttctctatccctgcattttctatgatctgtaaattaggtctagagcgttgattttaataacattaagcattcttgagaagaatactttttatataattaaaacctgtgcatgatttataactaagtatgtgtatattagaggtatatatatatttttttgagacggagtctcgctctgtcgcccaggctggagtgcagtggtacgatctcggctcactgcaagctcctgggttcatgccattctcctgcctcagactcccaagtagctgggactacaggtgcctgccaccacgcccagctaattttttatatttttagtagagacggggtttcaccgtgttagccaggatggtctcgatctcctgacctcatgatcctcccaccttggcctcccaaagtgctgggattacaggcgtgagccaccgtgcccggctgctttttagaggtatattcttagaaatatttttaccagcctggtgtggtggctcaagcctgtaatcccaacactttgggaggccaaggcgggtgaatcacctgaggtcaggagtttgagaccagcctgaccaacatggagaaaccctgtctctactaaatacaaaaattagccaggagcaatggcagatgccggtaatcccagctactcgagaggctgaggcaggagaattgcttgaacctgggaggcggaggttgtagtgggccaagatcacgccactgcactccagcctgggcgacagagcaatactcttgtctcaaaaaaaaaaaaaaaaaaagaaatatttataccagactggacaacatagcaagacactgtctctacagaaaaataaaataaaaattagccaggcatggtagcatggtcacataggcccggctacttgggaggctagagtgggaggatgccttgagaccaggaggttggttgaggctgcagtgatccatgatcacatcactgcactccagcctgggcaacagagcaggacctcatctcttaaaaagaaaagaatgaaatatttttattaataagggtgcacattcaaagaggtttagagacaataggttataaataattgttttaaggagttctgctataggccgggcgtggtggctcacgcctgtaatcccagcactttgggaggccgaggtgggtggatcacgaggtcaggagattgagaccatcctgctaacacggtgaaaccccatctctactaaaaatacaaaaaatttcccgggcatggtggcaggagcctgtagtcccagctactcagaaggctgaggcaggaggatggtgtgaatccaggaagcagagcctgcagtgagctgagatccaccactgcactccagcctgggcaacagagcaagactccgtctcaaaaaaaaaaaaaaaaaaaaaagagttctgctgtaaagaaaagaggagacatggggtcgagaatcatttttacttgtcttttaaaggttggatgttagagctggaccccagcaaagatgagagtccgctataaaaataaccataattatacttaatctacaggtgctataatatcgtggctcaggtcacgggtttcaaattttgtatctgctataacagctttgtgactgtaggcaagtgacttaacctctgtgtgccattgtaaaataaggagaataactagacttaattgttttggttcctactgatgtttaacaaattactccagaacctagcagcttaaaacaaccttttccttatgctcatggattctgtaggttaggaatttgggcagagcccagtgaggatgacatctttttgatctgtgatatctgggccctcaggtggggactcaatggctaagaactggaagcatggctcagacatctgctgggagggctccaaaccaggactactgagccaagcacctgcagggtctctccattgaatgtgacttccttacaacatgactgctcaggcttccagcatgaatattccagtcacccgggcagccactgcatggctctcccgaccagccttggagtacctcagcatccagtagccacaagggaggggacaggaccccaccatgcattgtggcagggtcaaagaaatctcaggctgtgggaattttgttactttattgaggcataatgtctacacaattcactaggtggtacaattcaatgagatttaacaaatgtataaagatgcaaccaccatcccaccatgatagagaacaattccattacccgcaaaaagtttcctcaccaggaccatggcttttttttaattaaagtttttcttttgagataattacagattcacatgtagttgtaagaagtaatatagagagatcacttatatactttgcccagcttcccccaatggtaaaatcctgtagtataatatcacggtcaggatgggaggctaaggcaggcggatcacttgagcccaggagttggagaccagcctgggcaacatggcaaaaccctgtctctacaaaaactacaaaaattagccaggtgtggtggtgcacacctatggtcccagctacttgggaggctgaggtgggagaatcacctgagcccagtaagtcgaggctgcagtgagctgtgagcacacaactgcattccagcctgggcaactgagactatctctaaagaaaagaaagtctcctttctaaatttataaatcatgtgatttttcagttggcactctaaaggttagaaatcactgtgaaagttctgccagaaactgaatatgtctattccatttatgcattcagaaactgccaaaataacccatgggtattgctttaaaaaaaaaaaaaaagatacagaacatttccagcactgtaaggatccctctgttgcccttttatagccacacccacttgtctgctgcctggtaaccactagagagctccatttctgtaatttcatttcaacaatattatggaaatggaaatggaattatacagtatgtagccttttgggattggctttttttcgctctgcataattcttggagattcatccatgtttgcttgtatcaatggctcattcctttctcgtccatcagcattgtgcagttttcagtgtataaattttctgtttttgttagatttatacctgcataaaaacaaacaatatttattatttctgcgtgctagccataaatacgtggacaccaaaatttaaaatacagtatcatttgcagtcagtcaaaaaaatgcatagtctgctgttgttgggtagagttttttagaaatgtcacttacatactgagagttggtggtggtgttgagttctgtttgcttgctgcttttctggctagtaatactttcaactcttcagaaagggacattgaagaccccaactctgattatagatttgtttgtttctccttccagttctatcactttttacttcacgtatttatagctctcttgtgcgcacacatttaggattgtggtgtccttttggtggattgacccttttattcacttagtgtcccactctgtctctggtaatttgctttgctctgaagtgtgatttatctgatattaatattgccactcctgctctcctttgattaatgtttgcacgatatatcttttcacattctttagtttcattctgcctatattgttacatttgtagtgaattttttaaaacagcatacagttggctcatatttttaaatcatgttttttaaagccattctctatctcttaattgataaacttagcttacttacatttattttagttactgacatgttagggcttaagtctgacattttattttctgtttcctggtctctgttttttttattctatttttttcttgttctttgttatttgtatttttatttttttgagatggagtttcgctctgttgcccaggctggaatgcagtggcgcgatcttggctcactgcaacctctgcctcccaggttcaagcaattctcctgcctcagcctcctgagtagctgggactacaggcacgtgccaccacgcccagctaattttttgtatttttagtagagatggggtttcaccttgttgggcaggctggcctcaaactcctgacctcaggtgatccgcccacctcagcctcccaaagtgctgggattacagccactgcgtccagcctgttttctttctttttctttcctctagtgtttgtgagtctatctccttgtatagattttttagtggttgtttcaggttattacattacatatccataacttatcacagtctactggtatcatcattttaccagttgagtcacatgtagaaaccttatcttcttttttttttttttttgaggtggagtctcactctgtcacctaggctggtgtgcagtggcacaatctcagcttactacaacctctacctctcgggttcaagcagtactcctgcctcagcctcccgagtagctgggaccccaggtgtgtgccaccatgcccggctaatttttgtatttttagtagagatggttttcactctgttggccaggttcgtctcaaactcctgacctcaagtgatccacctgcctcagcctcccaaagtgctggaattacaagcatgagccactgtgcctggccttgtcttctcttaatgtcttttactctgccccatttataatataattttcttaaatatttcctccacatatacagtgttataatttttgcttcagtaattaagcataattacaaactcaagaggataagtaaggaaagcctattgtatttacctcatttttgcttactgtatttttttcttcctttccagtattctaaggtttcttttccatttcctttctatttaagagtctcctttaaccgttcctttgggggagagctactggagataaattcccttagttttccatctttgagaatttcttgatttttttttttttattcctaaaaggtacttttactggatgtagaattctgggttaatacttattttctttcagcatttggaaaatactgtgccacttactctggctgccgtgatttctcatgagaaatcctctgtcattcaggctttatccctatcatgaaagtcttatttttctttggctgtttttgagatattttggttttgtttgagtgttcagaagtttaattaggatgttaggatgtgtcttggtgtggatttgtgtctatcctatttgtttctcttatttttttgagacagagtcttgccctgtcacccaggctggaatgcagtggcacgatctcagctcactgtaacctccacctcccgttacccagcttcttgaatctgcaggtttatgtcttttttttttttgaggcagagtctcactctgtctcccaggctggaggacctgcaacctctgcctcctgggttcaagcaattctgcctcagcctcctgagtagttgggattatagacatgtgccaccatgcctggctactttttttgtatttttagtagagatgaggtttttccatgttggccaggctggtctcaaactcctggcctcaagcaatctgcccgcctcggcctcccaaagtgttgggattataggtgtgaaccaccacacccagccagcaggtttatgtcttttgccaaattttcagccattatgtcttcaagtgtgttttcagtgcaccctctttctcctcctccagggcactgatgacgtgaatgttagctcttttgttgtagccccacaagtcccagaggttctagtttttttggtctattttttctcggttgttcagactgggtaatttctgtctttctgccagttcactaattcttccctctgtccccttcattctgctctcgagcctatttgctgagttaatattccagttgtatttttcagttctaaactttcttctatatatatatattttctttctttctttcttaaactttgtttagaacacttgtctcttctttagatctcttatttctttgctgaggcttcccggctttcatttgtttcaatcgtttgtcattgctcgttgaagcatttttatgatggctgctttaaaatcttgggcagataattctaacaactctgtcatcttgctgttggcatcggtgggttttcttttttcattcattttgagatcatcctagttcttggtatgatgagtaatcttcaaatgaaaccaggagatttttgtattatgtgatgagatttcgtgtcttctttaagtcttctgttttagttggctttctctgacacggctcaagcaaggagagtgagtgatgccaggtagaggtaaaagatcaggttccccacctgatgtctatcacctggggcagtgaaggtccaggcttcccactttgctgcctcttaccctcctagcagggaggggaggaatttctcattactagaaggtgggggtggaagtctgggttctcccaccattggttctcccacccagaggtggggtgtggacttgtcaccaaccagcaggggttgcagtctcagttccctccttggcctctctgataccaccagacagagggcttggggtgccttgctacagcttcgcaaggatgggagcctaggctcccactgggcctttgctggggtggatatggatgttcttggtggtgttggctagagtagatgggctactgcctaaaagctttctgtcttgggaggttgctccttcccagtcctttgactagacagagcagcttttgtgggtttttttttttgttgttttgttttgttttgttttgttttgttgtctgcacctgttggtatttctaggttgctggcttttcagctccaactctggcatatatgaaccagaaggaaaactcaaggaacactgtgttgttcctcatgtcccagagtccctaactgctctgccttcacctctacctttcagagtcttactttgtttttttttttttgttgttgttgtttgtatgtttctgaggcagagtcttgctctgttacccaggctggaatgcagtggcacaatctcggctcactgctacctccacctcctgggttcaggcagttttcctcctcagcctcccaagtagctgggattacaggcatgtgccaccacgcccggctaatttttgtattttaagtagagacggggttttaccatgttggccaggctggtctttaactcctgacctcatgtgatccgcccgcctgtctccaaagtgctgggattacaggcgtgagccactgcgcccagccttactttgtttgatctatgatgtcgaagggttttcggtatatttaatgaatgtatggggaaaaacatatctactccattttcccagaagcaggagtctcgggaccatggatttctaaacctaccacattattccaggcctttgttgtgaagattaaacgaggttgtgcctgtaacattagaatagttcctaacgcatggtagaatataagaaatgttagctctcatccatcctgatgtggaagctggtacaaagtgggtgtgagcttaccttggatcccatagtgctgtgggtgacagcagctagggtggatgaacacagttttgcctggagcaggtgcttgggaagcccctactctttctgcccatggtgtctggagagctgggagccagaaggggtcacagccatcccttgcctccatgcctctcttccgtaggaacaggctgtgctcggggcactggtgtgaccgtgttctctctcaggggtctgggcctactgacttctgccaaattggaaccttcttgggctgtggggataaattcctggtgcatttgctccaccttttgttctctttgtccctgtatcaggagatagtggagcaaaccatgcggaggaggcagcggcgagagtgggaggcccggaggtgagtctgtgcttccagctgctcccagcaccagaagcccacttgcctgggggtctgtggtgccacccatacctctgacttcctgtctcaggataatttattgagtttagaacctttgggccagtggctctgggagtgaacctgtggccgctgcattggagaagagctccaggttgttcgccggtcccatgagtgacaggacagccccaaggtctcccaggtacatgccatccattagagaccatggccctggctctttatttttatcaagtttttccaatgtagatactttgatttacaaattatttataagaagtgctctaaaatgaaaatattggaaaggttattctagcttgaagtgagcatgcagcagcgcccttgaggtgggtcccgggggaagcccttgctggatctctcatggaaggtctcccaggccatccagctgatgttccccctgtttcagctgagggcatgcactcctgccgctgccacaggaggaaggctgccccctcggataaggacaacgtaagacaggtgtggtggctcatgcctgtattcccaacactttgggaggcccaggcaggagaatccaggagagttcaaggctgcagtgaactatgattgtgccattgcactccagcctgggtgacagagcgagaccttgtctctaaaaacaaaccaaaaaaggataatataaaaccatttcaggaagcataaggaaagaaaagtgaaaataatccataatcacactgcctaattaaaagagattctgggtttgggtttctattcctgggttatacatacttgtgcatattttacatgatacatctgattttgcatctttctacttaatataaccatttaaaatagttctgaacaggctttctaaacagcctagtacttaattggcagtttcccttctttttgaaatgtaggttacttccaatattttgccattataaataaggcttcagtgaattactttgtgcacacagcaagttttgtcttgctttttcctttgaattgtaattatgggacaatttctctgaaatggaattctgaactataccactttacatcatacattgccactggcagtttgtgttaatttcccaacgttacacatatacattctgctaaagagtcaataagtggccaggtgttgtggctcatgcctataatcccaatactttgggaagccaaggtggaaggactgcttgagcccaggagtttgagaccaacctggacaacatagtgagactttgtctctattaaaaaatttttttaaaattagctgggtgtagtggcacatgcctgtagccccatctacttaggaggctgagttaggaggatcacttgagcccaggatgtcaaggctgcagtgagctgtgatcacaccactgcacttcagcctgggagacatagcaagaacctgtctcaacaaaaaagaaaaaaccaagagtcaatatgtgaaaacaaatagtaccatgatttaatttgcatttcattgaatactgtcaagtttagcatttttccaaaatatttggcttcctgtactgctacttcctgttgaagacctgcattttatgtcattacagaagagacatcctctttgactacgagcagtatgaatatcatgggacatcggtaagtatgaataggtggaactcactataaagttctgactccaggggtcagtgtcctcaaatgtgaagaagaaacgtagattttagagccacaaaagcctggtttgaatctgagctccatgtcttccccctgtgtgaccttgggcaggtgttgcaagctctctgagccttaaacatctcctcctctgtaaagagaataatcctcatttcagaggtaattattaaaatggtcgtttgcacccaataggtgatcaaagaagagcagcgtttatttttgttcatcaaaaacacagaatgagtttgtaccagtctctgtgcgagaagataaaacgctatagacttataatggcccatcagtgtgtgtcttttacaaaacagaatttagtgtagaaaacctactatgtcaatagtgttgagcagagctcaaggccttaaggagccctagaaaataagtttcaataaaacatcctgtatttagtcttagaatttaatactgggaccttgaactctaagcaccgtatttccagtgtcccttttattgtcaaggttccattgtcctttgaaggatcatccttttgctgtctctgctcagtccttgctaatggaaaattctaaacagttggtggggagggtgctgatgctcacttagagaagataactccctccagatatatggggccagttcccttggaaattctctccctggaggaagcccgcatctcacggcaaaggggatcttagggtcttctggtcagacaccagtcttcctcaaggtcttttaccaaatagagaccctctgcttatgggagttaaatgctccgatgtggacagccctgttggaaagagaggtgctgaggcccctccctctttaatattcaaataattggacccagggctctgcctcacctggccttcctgggaatgtgtttgaggacgccagccaagcaggaggagtgtgcggatgcagagccaggcaaatgatggggtctcctggcctttgggattcagtgcctgccttgggcatcactgaggaacacagggagatacaaagaggccccagccagtgctgcacccgggctgcccctaccaagtgaattcttcccttgctacaggataaaatatacagacagtaatgattttaggtagcaaaggagttactttcagtcttcctcttctcagtttagcgtgtactcatcccacatgtcgggctggaatccacccacatgccctggccaggtagaccctccatccgcaggggtttgccagggcccttctggctcaagtccagtctggctgcatggcccagccccagcacatgcccctcccatgagccttagacttctctgcttccttacagtcagccatggtgatgtttgagctggcttggatgctgtccaaggacctgaatgacatgctgtggtacgtagcccctgcggcagctgtgtgggagtatttgttgccttggtcagtgccacataagcagctctgtcctcccacagggagggtgtttcccttgtccccaccaggagtgtcagatgcagcccctttctgggtatgtgtgtgattttggtctttttcctaactgtgaagccctgggagcttcacacaaacatgggacttggagtgtcggagaatgcagaggaagagaatacagtacagcttcaccttccccactcctgctgctcagcctgtactcagtaaagtcaagtgacaggaggagtgtgagatttgaaggaggcagcctttgcagtggctcacatccttaattctacatccgtaatcccagtactttgggaggccgagacaggagcatcacttgagtgcaggagtttgagactagcctgggcaatgaagtgaaaccctgtctcaaaaaaaaaaattgtctgggcatggtggctcacccctgtaatcccagcactttggaaggtcaggaattcgagaccagcctggccaacatggtaaaaccctgtctctaccaaaaatagaaaaaaaaaaattagccaggcgtggtggtgggtgcctgtaatcttagctactcaggaggctgaggtaggagaatcgcttgaatccggaaggcagaggttgtagtgagccgagactgcgccattacactccagcctgggcgacaagaatgaaactctgtctcaaaaattagccaggtgtcatagtgtgtacctgtagtccaagctactcaggaggctgaggtaggaagatttcctgagcccagaagttcagggctgcaatgagctacaattgtgccatcgtactccagcctgggtgactgagtgagatgctgtctgcagaaaaggaggcagctcttgctaggcatccttgcagtcctggcacacggtggcaaaatttgatgtaggaagaaccatccctcctctgagtccgctgtgcgggctgcacctggcatgaccgagcacagtggggcccagtcactcttgctgtgggctggccgtcatgctggggaagccaggccttgcctgggtctcaggtaaaagatgagcctgaagatgggagccttgaaggctcaccagaggcctaaacactgctactctacatcctgctactttaagctgcaggatgagtagatgtgaacacaactagggccccctgtgctgggggcatgtgccatgaggggctcagagagatgaagtgataccagggtcaccaacagctcagcacaggcctctgccatgatactgtatcaactccactccgagtgttggggtcaggagtgcaggacaagagcagagcatggcctaggagtgggtgggagtgctggctcctattatagctgccatggctctcctgggaggttttcctcctctgagtacctaaagctcccacagtggcagacactgcactgcaaggccccaattacccttctaacctcttcacctcaaggagagaggccacctgactgaggcaagccagggtctggccccactggcaggacattccccagagtgctgagcttgggcccgttccatcatctcactccatcccccaggcctcattgagcccaggtgggctataggccggctccactgccttctcttcttccaggtgggccatcgttggactaacagaccagtgggtgcaagacaagatcactcagtaaggacacactcccttgccttgcagggtcagccctgtgctgtggccaggtgcacagcctgaccatagccactaagtttttagcagggtccctgtagggtcctattgagaagtgaggactggccctcctccttgggcccaagcatttgtcactgaggaagggctaactgagtaccagccgagtgaccgtggccttgtgtggcgtcttcatctggcaggtagagccagcctccccagttctctcccagtgccctgcttgtgctgggtgctaccagcagggccaggcttagaggcaggtgctgaggtgtggcccttgcagtaggtggggggatgggggaagacaacacaggagcaggttgggggcgggatgagagcccctagtgaggaccctgagtatcttgccaagcagtaggggtttgaccccaaaggtaaggggaaggctccaaaggtaaggggtctggtgtgaagcagaaccccttttgccctcagtggtgggctccccatctgatagactgacggtgagctgcaaggctgcctcagaatgcagatgctgcagggcgaagtgggggttggcttcttctttcatccctgctaatgcacgaagtggcccaaccttctctagtggccatcaggcagaatctcttagggattggcatggacctagaccccaacatgctggtcctctcctaggggacccatgtagatgtccccaggctgtcacctggcacagccctaggcgcagcctccaattgggtgctggtctcctcatgcagtttgaataggccccatgccactatttcctgcctccccagccctgcccctgtctggatcctgcaataaggcccacaaggcaggagaagcccaagtttcaggcctggagctacggcctggacaggtcaccttggcacagcccactgccctgttgggccctgagtcccttcgtgtgttaagagtagcatggaatttgtgcacagataatgtaggggctagaaacaccatggtgtatgcactgataggcactgttcctggtctgtagcagtctctcaggtgaggcccccacggtcactgtcctggttggtggccctttggaacctagagtggggtcttcctgctctcattgtgctcagtggcacttcctgtacaggatctgtacctgaaactgtccctataaactttacaaaattaatgagggcagggggaggggagaaatgaaaatgaacccagctcgcagcacatcagcatcagtcactaggtcggcgtgctctctgcctgcttcctcgtagctgcttggtgtctcattgcctccgaaacatgtagaccctgtcacaagattgtagttcccctaactgctccatagatcacaacttgaaccttaggaaatgccgttttccctttgagatatttctttgggtcccacatactgatggagctactgactgagctgctccgaaggaccccacgaggagctgactaaaccaagagtgcagtttgtacaccctgatgattacatcccccttgccccaccaatcaactatcccaattttccagccctccacagtctccctaaaagccccagcccaaaactcctcaaggagatggattgaagatctcctcccatctccttacttggtgccctgcaatcatgaaactcttcctctgctgcaaactctgctgtctcagtgtaacaggtctgttactgcacagtggacatatggaccgcctggtcctataacacattttggaggccgggcgcgatggctcacccctgtaatcccagcactttgggaggcagaggtgagtggatcacctgaggtcaggagttcgagaccagcctggccaatatggtgaaacaccgtctctactaagaatagaaaaattagctgaacatgatggcacacctgtactgtagtcccagctactcgggagggtgagacagaggaatcgcttgaacccaggaggcggaggctgcggtgagctgagatcgtgccactgcactccagtttgggcaacagaacaagactccgtctcaaaaaaaaacaaaccaaaacaaacaaaaaattatggagagcctacctgaagccccttatgggtatttgcctgcggctaggtgccccttcactgttcggtgggcaggacctagagacaagcccaagtggccactgggctccattgaaatatgggctgttgctggtgccctgcctgttgacggagcagtgtcaaccttcggtgcataaactgctcgcagcaaagacagtttctggttttcaaaggcattagaaaagttttctccatgcaactggcacccctttctcttctgatttgctggcctccttggaggtcttgtggcctcctcagaatcttgtgacatattataaccctttcttaactggaaatgacccagacacccaacaagcatctaaaataattttaggattttaagctgcatggaacgtttgcctagaagcattcatacaatttacatttcatgcatttttaagtttgcctagattacttatgaaaactgagagacaaaactagtcatcatttcaaattattttattgttaacctttttctttttttgaaatggggtcttgctctgtctcacaggctggagtgtgttggcatgaacgtaactcactgcagctttgacctcctgggatcaagcaatcctaccaccttagcctcccatgtagccgggactacaggcatgtgtcgccatgcctggctaatttttttgatttttttgtagagatggggtcttactttgttgcccaggctgctctcaaactcctaggctcaagcaatcctccctcctcagcttcccaaagtgctgggattacagatgtgagttgccacacctggccttcttaatcatttttatagcctgtgaccatcagatgttcacctaagaaccttaaagttaaatgcatgtgtatttttgctgacaactcagaagattcagctgttatcattaaaccaacaatattcatcttatttgtcaaaaagtcatacaaagatcattctggttttggttagttttacagtcttaaaaccttttatgcaaagtcctgacaccctaaatatccagtagagacaaatataaaatcgttcagtcaataaactcagaaaaaagatgtacgctgatagttttgaagacgtttctatttttattttaccaataattttaaagccagcttatttactaaagatcatttaagtcacatgaagttgaaaaatatttgaacttatttactttgtttatgagcactcatttatttataagccaatttggtagcatgtaggcacaacacataacacaacatgtacatacatctaaatttattttaacccacatacacacacatacaaaggtacagcttttactgcagaactctagccatgagacagcagtacaaactcaccagtttataaaagagggctggatccaaattatttctgacaaaattggaaccattcacataaataaactttgtttatcccagtaggtaattcagtgaaggctgtgaactaaaattttgaataaagcagtttctatagcagtttgattttaaaaacttaccctttctttttttctccagtttcaagttttcaatgattacattttagctacaactggctgagctgtataagcaaaacaaaatctccaagtagctctgaataataccatagacagtgagtcttttctcaataccagtagcttaataataccagattcaaagcagacagaaaagagacaggggtgatggctcatgcctgtaatcccagcactttgtcgggggtgggaggattgcaggaatccaacctaggtaacatagaacccctctctataaaaataaaaaaaaaatcagctgggcatggtggtgcatgcctgtggtcccagctacttgggaggctgaagtgggaagattacttgaacccgggaggtcaaagcttcagtgagctatgattgtaccactgtcctccagcctgggcaacagagtgagaccctgttttaaaaaaagaaagcaggcagaaactttctcatagtttttccacaggaatttcttcttttagtgggtaggttacccactgcactatcctgatgaagatgtacgtctcttgtcttcccagtttcacaagatgcagcccagtgcccagcttggagtaaccaaatcaatatttctcattccagctgagacgatatacacacaacaaaaatgcagacactgatcattccactctgcgcccagatttgacgtggcgaggctcatacttgcccctgtcagcccccagcacctttgatctactcaaagttgggaggaattacctccaaccaggagttcagcgggtggtctctgggcaagatgaaaaagtatatggtcaacctgagttaggcctgctgagctgctgctagcaattccttcagggatccctttcacaaacataaacctacataacaagacaaagacaaacaaaaggccttccgaaatcaagttccaaatttcagaagtcaagaggatttctcccaagcagtgctctttggtctccttccaatgcagaggaagtcccctcaaacgaggcccttcctattattagggagggtcgacaagacctcagaagaggcctcgagacttcagagggagccacaaaacctttgaagaggccacaggacctccaaagaggccagcaaatcagaggagaaaagggtgctggttgcacggagaaaacttacctaagatgcctttcaaaaccagaaacttgctttgctgcgagcagtctatgcaccaaaggttgacattgccctgtcaacaggcagggcacgggtggcagcccatatagttcaatggaacccagtggccgcttgggctttgggcttgtctctgggtccttcccactgaacagcgaaggcgcaccaagccgcaggcaagcaaatgcccacaaggggctcgaggctagactcaccataatgtgttataggaccagcaggtttgtatgcctgctgtgcagtaacagacttgttacactgagacagcagagtttgcagcagaggaagagtttcatgattgcagggcaccgagtgagaagatgggaggagatcctcaaatccatctccttgaggagttctgggctgggcttttttggttttgtttgtttgtttgtttttgagatggagttttgctcttgttgcccaggctgcagtgcaatggcgctgtctcggctcatcgcaacctccgcctcccagattcaagtgattctcctgcctcaccctcccaagtagctgggattaccagtatgcagcaacacgcccggctaattttgtatttgtaatagagacggggtttcttcatgttggtcaggctggtctcaaattcctgccctcaggtgatctgcccaccttggcctcccaaagtgctgggattacaggcatgagccactgtgcccggcctgggctggggcttttaaggggactggagggtgaggggctggaaaattgggagagttgattggtggggcaagggggatgtaatcatcagggtgtacaaactgcactcttggtttagtcagctcctcgtggggtccttcggagcagctcagtcagtagctccatcagtatacaggacccaaaggaatatctcaaagggaaaacagcatttcctaaggttcaagttgtgatctacggagcagttaggggaactacaatcttgtgacagggtctacatgcttctgaggcaatgagacaccaagcagctacgaggaagcagtcagagagcacgccgacctagtgactgatgctgatgtgctgcgagctgggttcattttcatttctcccctccccctgccctcattaattttgtaaagtttatagggaacatttcacccactctgctgtggatccctgtcacttacggagtctgtcatcttggctgtatgggctgtggcctctgcggtgcccattctcaggaggtgtgagacccatgaggaccggaggtggacaaggctagagaccacacccccccgctccatccaatcatgttttcctgggtgcttggtttctatgcaggctgcatgtccttagtccctgcatgggaacagctcctgtggtgagcaggcccctgaggaaggccttgagcgggaatggagcctaggcttaggctgcctggtaagagctggagggaaccagccgaggcttgtgctacttttttttccagaatgaaatacgtgactgatgttggtgtcctgcagcgccacgtttcccgccacaaccaccggaacgaggatgaggagaacacactctccgtggactgcacacggatctcctttgagtatgagtatccttgtggcccagcctgaggggcacaggcagcacccctgctcagcaggccttgtttgctttgtcaccctctgtgggttctggccacatccccaggagggaaagcaggtggggcaggaagttttgggggaaggggctgtggtgtgctaccccagctcatctgtgtggctttggcttctaaatgccagagctgagtttggaagtatcacccttctccagcacatccctgtaaagtgcttattgtgggcctggctctggacatggtagcagtgcgggcagtggttcacgcagtcaggaaagaaggcagctgccatgtaatcacacagcgtgacgtgtcttttgagaagcacatgggacattggtggagtgctcagaaaagaccatggggagaccacatctcacacagtctcagccacactcagtgtggcagctgctgtactgagcacaggaggggctgggggactggctggggtcaggtgtcaggaggccagagcaagccttgtgagccaagggcagcgggaggctgtggagtgaccagagtttgagtcagggtttttaaaaggtcccttggctgcccagtagaggtaggttgggggcaaggagatggtcactgctttccaaggccacacaatagtggcttggcccaaactgcagcagtggctgtaagcagtcagatagcatgatgtcagggacggagctgccctgtctctgcactgtgatggctgggaaggaggaagagtgagggtggacacgtcagtagtcaggtggccatcggagcctggggagcggggtggagctggctgaactcctggggaggggagccgctgtgcactggagctggtcccatcatgtgcgtggcagggtgggctcacttacccagggaccatgggagtgtgtgactgagacaggagggagggagtcagggagctgaggatgctggggcttgaggaagctgctggagtgtgggcagggagcatggtggtctgaaggcctgggagttcccaggagttgggaggggcagtggtgggaactgagcatgccgaggaagcaggcaggaccaggctctcgtcctgtagaggggaaatccaccgtgggggacagtccacactcacaactgcgctcacggtgccaggggcagtgatggatatgtttaagaaaagggctgaggaggtcgggcgctgtggctcacgcctgtaatcccagcactctgggaggccaaggcaagtggatcatgaggtcaggagatcgagaccatcctggctaacacggtgaaacctcgtttctacgaaaaatacaaaaaatcagccaggcatggtggcgggtgcctatagtcccagctattcgggaggctgaggcaggagaatggcgtgaatccagaaggtggagcttgcagcgagccgagatcgtgccactgcactccagcctgggcgacagagcgagactccgtctcaaaaaaaaaaaacgaaaaaagggctgaggatgggggcgcttcgtggatggggtcccagtggagggctctccggaggaatgggttgtagggagggctgggctaggtggagcaggaggtgcaggacgacaagctggtgacgcccagcctcctacgtcatgtgtggccatgactgctccatgtgaccacagcacctggactttgcagacccctgtgctccagattctctgcctgtcagacggatggtggtctatgcctgtcacttcacaggctctctgtatgggtcagcttaagctaagaaggtcaaagggctccaggtcactcttgggatacctggttttgcaggcaggcctggtgagaaagggccccgccatcagagtggcccacctgctggagttacgagagtgctcagggcggccagtgggtgcttgcatgctccttgactgcaggcccagcctccgcctggtgctctaccagcactggtccctccatgacagcctgtgcaacaccagctataccgcagccaggttcaagctgtggtctgtgcatggacagaagcggctccaggagttccttgcagacatggggtgagtgactgcctgggcctctgcagtgccagccctggccacccccaagggaaaagcccctctgctttgttgtgaccaacttagttataaaatgcagcctgttctgccataagctccttgccctagatcccagaatatcttctgaatgctggtgcggggacatcctcgcttgcccttggtttgggtttctttccaccctgtcggtgtgtggtgacctcactcatgtggcttgggcttgctctttccagtcttcccctgaagcaggtgaagcagaagttccaggccatggacatctccttgaaggagaatttgcgggaaatgattgaagagtctgcaaataaatttgggtaaacacacatttttctggatttatcttcattacatccaggttcattaaagtgaagggttctactttaactgtgctcctaaaataatgcaaaaaaaaccaacgtgctcctaaaataatgcaaaaaaaacaacaacccgagaatgtacaaatgagtgttatctgagtctggccattcctgaagtcttgagttctttttgggttaaaaataagacttcttcaagcttgtgaggtttaggatcctaggatccttggatcctagggctgctgtgggacctgtgaggtcgaccccagtctgtttcactggagacagcaaatgggccacagggccaggttcaggtgaactctgcccgaccaagtccatgggcactcctggaggcccctggcttctcccaccccagccagctggcatgctaaggtgtgagagaggaccccacacaccccctaagccagccataaagctgttgacaagaaggcacccggccactctgggctgcagggctggtatgtctggacgttctgacctgcctcatcctctgagcagcatggctgtgctggaagcattgacttgggcctgtgagggacattagcacatctgttggcctgcctggcagtgagagcttgcccacaatttgagggtgacagctgtgtttgctcccatgacaggatgaaggacatgcgcgtgcagactttcagcattcattttgggttcaagcacaagtttctggccagcgacgtggtctttgccaccatgtctttgatggagagccccgagaaggatggctcagggacagatcacttcatccaggctctggacagcctctccaggtagcaggagggctgtgggtttgcctcatggggccaccactggttctcacactgcccagggaggtcagttacggggaccccagggctgtgggagtgactgtgtcctgcagaaactgcttgggtgaactggaatcacagtgccagtgtggtgtgcacctgacacattacctgcccctcttcagtatttgtcactttctcttgaatcttttttggcttttttttctttttgatttttaaaattttctctttttttaccttttgtatctcttaacaaaaggcattatttgttatgtatattcgttcttgtgtttaatcttatagttgtcatttctcaattttttaattttccaattctttcttatctcacttcctgagatgtcctatatttttccatgtcttttcgcttgttttgaaatggaatgtgacaatttggatcttttttttagcatgtctgtctagtgtcagactaaagacatcagagaaaaatatctccaaatacactgaatttatttgggaattagaaaagaggattatagtgtctgcgatgcacagctatggcaagccaaatatgcatccaaagagaggaggctaaggggacacttttattggcaaaaggagaagttcacgaaagctagcttggaaacaattcattggtttcagagactcagagccagagttggcgtcagttcagtggtgaagatgcattactgggcaagtgttatattttaagagcatcttatctgaattgttgcagtcctaaagaagggatttcttgtggggttatttagaaagtctttgagtctttattccagacatgcaagcaggagctctccttggtgctttcccagctttaatttgtttgggcctgtcaaaaagtgatttcatcctgggatctgcaactttcacattagtgtactttcattatccagagaggtgttattctgtcccttattctctttttttctaatagtgactttgaggggatttgactttgctacttctctcatgctttttatgtataaatttcatttccctgactttttaggaggaggaggcatgattcagacagcttttctggcttcacagagctgccacttctgttgcttttgtgcagtggtaaagatgcatatgtatatatgggggcctgctttctgggatttcctggttctgctcccaagcacacttttttttccactgctttattgagatacaatttgcatgccatacaattcacccatttaaaatgtacaatgtgatggcttttatttattttattgttatttttttagagacagggtctcgctctgttgcccagggtggaatgcaatggcatgatcatagctcacagcagccttgacctcccagtctcaagcaatcttcctacctcagcctcttgagtagctgggacaacaggtgcatgccaccacgccttgctaattttaaaaatttttgtaaagatgtatcactatgtggcccagactggtctcaaattcctaggctcaagcaatcctttcacctcagcctcccaaagtgctgggaggaacaggcatgagccactgtgcccagcctgcaatgacttttagtaggttgcagttaggttttgcaaggttgtgcagcaatcaccactatctaattttagagcatttttgttgccccagagagatcctcccagcctctggcaaccaccagtctcccttttgtctttatgaattggctgttctgagcatttcatacaaatgggatcatataagatatggttctttgtgaccgggttcttcacttagcatcatatttgcaaggctcatctatattgtaggatgtatcgggattatatgtcttttccctcgtccgccacctgagacagagtctcactctcgctcaggctgtagtccagtggcacgctctcggctcactgcaaccttcgcctcctgggttcaagcaattctcctgcctcagcctaccgagtagctgggattacaaacgcatgccaccaagcctggctaatttttgtagttttaatagagacggggtttcaccgtgttgttcaggctggtcttgaactcctgacctcttgatccacctgcctcggcctcccaaagtgctgggattacaggcatcagccaccatgcccggccagtgtctttttattataaataatattccattggatggatatattctatttcatttatccattcataagttgatgggcatgtggtttgtttccacctattgacaattatgactaatgctgctgtgaacttgcatgtacaagtttttgtgtagtcatgtctttgtttcttttggttatatacctacatgtggaaatgctgggtgacatggtaacactaggtttcaaggaactgccagatttttgaggaactgccagacttttccacagcagctgcaccattttacattcccaccaggagggagggtttcaatttcttcacatcctcaccgacacttgttattgtccatcttttggattacattcatcctagtgagtatgaagtggtatctcgttatggttttgatttgcattttactgatgactaatagtgttgagcatcttctcatgtgcttattggtcatttgtgtatcttgttaggagaattgtctattcaagtcctttgtctttttttttttttttttttgagacagggtgtcactctgttgctcaagctggagtgcagtggtgcagtcatggctcactgcagcctcaaactccttggctcaagccatcctcccacctcagcctcctgaataggtgggattacaggcatgagctaccacacctgctaatttttaaatttttagtagagatgagatcttaccatgttgctcaggctggtctcaaactcctgggctcaagcagtcttccagccttggcctcccaaagcactgggattataggtatgaaccaccgtgcccagcctaaaacttttatatattctacatacaaatcccttatcagataagtaatttgcaagtattttctcccattctgtaggctgacttttcactttggcagtgtcctgtgaagtataagatttgttaattttgatgacatttaagttacctactttttcttttgtttcttgtgcttttggtgtcatatctaagaaaccattgcctaacccaaggtcatgaagatttcacattattttttctactaacactttaatagttttagcccttacattaggagtatgattcactggaggttttttttttttttttttttgagacagggtcttactctgtcacttaagctggcatgcagtggcatgatttccactcactgcaacctctgcctcccaggtagctgggactacaggcatgtgccactgcacctggctaatttttgtattttttgtagagacatgttggtcaggctgggccccttactctttactatagtctccttacacttcagcaaggccccttgctctttaccatgcccccttatactttaccaggctcccttgctgtttaacaggaccccttgctcattaccaggactccttgcactccagggaggctccttaaactttcccttggcccactgcactcacctgctcttgcatagggcaaaactctcagtttgggccgctgctctccagttgcctggagttttaagtcttcttaggtctcactacctcttggctttctctcgcactgatgtagatagtatacctgtctggctgttcatggtctctttttacctgcttacactttggggtttgaagtgttcccttgttctcttaatttgttgcaaatgtgggtcctaggtttttggttttgcaatctagttgctctacttttatctagaaatttgggaaaatccaaaaactattttaccactgttgctgccatcatcccagcattgatgggtaggctttagacattgtctaccaacttcctgctatgacaaaggagcatttatcccactcttgtccaccttccctcctgttggtacagttttgccactatttttaacttctttgtaactttaacatatttatgtcttctttcatcactagtatctcgtctccctactttgtaagaaaaggatatttaaaacactcttagtccattttgtgttgctataaaggaatacctgaggctgagtaatttataaagagaaaaggtttatttgcctcataattctgatggctggaatgctcaagattgggcatctgcatctggtgagggcctcaggctgcttccactcatggcagaaggggagctggtgggtgcagagaccatgtggcaatggaggaaggaagagagaggaggaaggtactaggctctttttaacaaccgtcacgggaactaatagagtaagaactcacttacaccccctagccccagggagagcattcatctattcatgaggggtctgcacccatgacccaacacttcccactagaccccacctcgaagatcttggatcagatttcaacatgaggttttgaggggacaaatgtccaaggtgtagaaacagccttactttgctcttcagtgctgctcagtactttctgaaatttgtgcttttacgttttcaagactgataacaatcttgggttagagaaaaagatataaattgtcttatctttggttacaggttgattttaaaagttgaaagtaaacaaatagttttactttattgtgctaataaactattccagagacaatcatgtgtagtaatagattactatctggcacggctctttgtttttcctgctgtttttaattgcctcctttatcacatccatttttttctcctccaaactccttccagctgtttttctgtgagcccctttttgctggagagtctggggttctgtcttcccaccacagcctggacctacagctctctagacctgctttccactgtccccatggatgtccaaatcttggctgtgcctcttagtttagtccaatgtttcttgggatcttcatctttgtttcatttactccctcattaaattagagcacagttcttaagtaacattcaaagaaagggcgcatgtgagataaactttctgagttcttatatatctgacaatatctttattttactatttctttactattccccccacagaaaacatccgtgttttttattcttgcttttcaggcttcctggaatgacgatgctctgtcttatttttttgccttacattttccatagctttgtcttgttatctatgttgaggaagtttttcttgactccagacttggagtggatgttttatcttttgcaactgttttaatttccatcaacatttcctagtttttaactcttcctttttcatagcatcctgttcttggtttaggaatgtaagagttgcacacatctctctgaagatactaattagagttcagtttaactttctttagttctccaaattatctgtttcttcagggttatttttttaggccataggcatttctcaaatggtctgatgtctttcatattcaagaacgggattgtggacccttggctgggccatgggtatctgggcacagctcactggtcataagacatcgtttcaccttagcaggcaggagccaactgtgacactttgggactccccactgtagggcccagaggctttgcttgaggattctacttattcacagatggtacatttcatatactcagaggggagcctccctttttgtggggaagagtaaaaatctatctgttgggtttgaggggatcccttgtccaacctccagcccttgcccaagcctcccctgtgtcagagtcctcctgggccttcaggatcttccctttgttggcttttagtttcctgtcttctgatacttgcacccgctccacctctcatttgcattactgtgggtttatacattttaaaaaattctttcctttcatgtgaaagacaactcaggagggaaagaagataaattcttacccccaaacctcttcctgaaccaggaaccaagcaaactatttgtgactttggtattttaccaagagttcctgacaagcaccaccaaagccatgtgtctgccctgttacaggagtaacctggacaagctgtaccatggcctggaactcgccaagaagcagctgcgagccacccagcagaccattgccagctgcctttgcaccaacctcgtcatctcccaggggcctttcctgtactgctctctcatggaggtcaggcttcccacagagcacaggcgcctggtcacagcaccagtggcttcgtctgaccatctgtctcgcctccgcagggcactccagatgtcatgctgttctctaggccggcatccctaagcctgctcagcaaacacctgctcaagtcctttgtgtgttcggtgaggggccaggcgggtgctgtgggtacaggagggcaggtgcttggagagctccctggatggggagttagatgctggccttggggtgcctgtggctgttgaccagctgcaaggtctaggcacatccattactttttctgagctgtctttttctcagctgacccctaggaaccttccagttctctcaagctctgattcatcactggctgtctaagtcactcagacaagtagggaggggcccttgcagagtgaacagggctggggcttgtgtcctattgttgcaggtcagggaaagcgggatggttgtagcaccgactggcttcccagcaacagcttgtccactaagctgatttcctgtgcctggctttgtcttctgtgtggcctaaccccctctttgcgttggcgtggaacacactcctaacttggctggctttagggcaggggtcctcacctagccgacatggggctcctcccagatgtgacatgtcaataattgaagtcctcctctgcttcgaggatgagagtttatgccgggggctatttcaaacaaaatgtgctaacaggaagttgaacttttcttttgccgctgaactaaccagtaaaatgatgacagatgacatgtgttctatcaaccaggtaatgtcaaagataaactagggacagagcatgggccttgacgtcctctaggctgtgttcaaagatgagcctcctcatttgccagttgtgtgacgtgaggtagatgatctgacctgatcctcagtttcctcatccgtgaaatgggtgaacacatacccactttacaggatccattcatttaccagacatgtattgaacatccaccacctgcccggccctgttgtggagtgactgcccatcctggtgcacatcctgggacacccctcagtcctagacacaccaggaatactggtcacctgggctgtagggtgtgggtgcagcaggcacagcagagaaggaaaccctaaacctttatcctgaaggagcgtgccggcgggggggacgaggagtggcagctgcggttaagatgaggggatgtgctgccaggggatggagcaggatgaggcggggtgggctggggcctcctggagaaggtggcagctgctgcaggacctgaaggaggtgagggagaggatagcagggcaggctccttgcaacaaacagccaaggggcagtggggctaggctggtagacaaggaggctcggggacacagcatcacagccacagtaccatgctgtgggtacgggagggcaggtgtttggagagctccctggactgggagttagacactggccttgggcatctaacttggggtggctgggtggggaccaaggcgtctcctggtgacagcgtccctggaggctttggggagtggagtgactgggcgctgttgggctctgggctctgagtgttgagctggggcccaccataccctgacggagggtgctctccgactccatagacaaagaaccggcgctgcaaactgctgcccctggtgatggctgcccccctgagcatggagcatggcacagtgaccgtggtgggcatccccccagagaccgacagctcggacaggaagaagtgagcagcttccactcgtcctgggactggagggtcgggggtgttggggttatcagcttattagccctgctgagtagagtggtatttgcctctagtgtctgtcctggggcggggggtgggaagggtccattgcaggccgcctggcccccgacatgtcttgtgtgtcagcagcttttttgggagggcgtttgagaaggcagcggaaagcaccagctcccggatgctgcacaaccattttgacctctcaggtgagagtctcctgccactctgccacactttcccacctgaccctttgaggctattgcaggccctggaaccaagcaagttggcatggctggaggagcctggccagcagccctcttgaccttccagatctggccctgggacaggctactcctggtggctcagggagctctggtgaacctcaggcccctgagagggaaaaagtgttttccagggaatgactggcctggctgtggccttacagcggccttacagccagtgctaaggatcactttcccagcaagcctaggggactggccaccagggcccgtgtgccccgatctcacctgtcagggttgggttgtttctgtttcatggggtgagggaacagcagggcccgtgatgacccaggacaccaacccttgctgcgccagccacctctccacaggccggggtgtgtgtcgtgataggtgctacctgtgagatggctgggacaccggccccacctgtgtgtcagatgagcccagaatggataggcctgcctgcccactgcttccccagcaccagcacggaacatggttcacattcggctgtgttggcgttcttattattgttgacaggttttaaagtaaaacagacgtattgatatttcaccccgggttagtttgctaaagctgccataacaaagtgccacagacagggtggcttcaaccacgtgtctcctcccagtcctagaggcgagaaggcccaggtcaaggtggggcagggctggcttctcctcaggcctctctccttggctcacacagatgaccaccttctcactgtgtcctcacgtggtctttcctctgcatacctccttggtgtctgtgtccaaaccgtttcatcttccaaggacaccagacagattggattagagcccaccctaacaaccacatttgaacttaattaccatagtcacattctaaggtcctgggggtaagggcttcaacatagagatgtgggggagaccgttcagctcataacaccctcagtacttcctgcacctctgagaaaggatattttcttgcctcatcaccacggattcctcaacaatgatagacactgtcatgggagatccagcctttgttgaagtggcgtcagccatctcagagctgccttccttgagccagacccagccatggctgtggcactgtgtggcattggttcaccccgcacagcagcccctgctaactcttttgtgcctgtgatgtgggagaggtggatggacacccactggcctgcagaatatctggccttcagtatacagggaggactcgggctgggaactgcttggtttccctgagggtggagagccaggggtgagggtgcagagtgggccatgtctagtgcccacctgcgtgggctgggtctggggctctcggggctgtggctggcagcatagatggctcccagggccaggccagccccatcctggggcctggttttgctttgtggtgagggtctgggtgctcagctgagcctgagggccctgtgagatatgggcagtttgcaccatgtccccttgtgcggaagagaacactgaagccgaggaattggccagagtgcggccaaaagtgacctgccccacccaaggacttccacaacccactctggggacgggggttcatgccagctggggtgggcaggcccgtgtttgtccaggtctgtagggcccttccctgtgtcacctctattgtcttcccgggggggagttctccctgcaggccccaaccctgacctctctagcagtgcagacagcagttgtgaagatgaagtacagtgagacagacacaaccactgagtgcagaataccacaggccgggaggagccgcgcactttggaatgcagtggagggcaggcagcggaggggagttctgtgccctgtcttgtgttcccactcctcccttctcacggctgtttttctttcattacttcagtaattgagctgaaagctgaggatcggagcaagtttctggacgcacttatttccctcctgtcctagggtgagttacaggggttctgcaggggtggctgcagcagccccctcagagcccgaccctgatgccctgctctgtcctccctcaacggaggcttctacttgggtttcagaccgaagcagggttcttgagattggagccaacacatttttcccaagcacatctgtccttaggctgccagcagggccacaatggggcattttgaggcagctaatttcattaagcccctgcgatcccttcagaaagagctggtattcaccctctgctgaccacacttgggctgggcatcgcgtgtgacacatgtcacacacagactccctggtgctgccctcgaaggccacctggagcctcctgtcccacagccttcgtgtcaggcgctgggcaagagcccgcagagcagccatccgggcttttgtgtgcttggctcatgagaaagcaaagctgttggcagccgcttagctgggaattccaaagcgctggttctgctggggccttcaccagcacacagctgtcctgagggccccattgggattcactggcaggtcactgtcccgggacacctcccactgccccatgtgctacctctttcttaagggttcccaggaaataggcctgccttgtgtctttgtaaccatctctcagcccaggttccccacagggaatgccacatccagccctgcatctcccagagccctagcctggaggctgcggctgtggcagatgggccctgccaagactctgttgcaggaggtccctcaggccaggcctggggtcctccccactctcccatccgtccgtccatccatccatctgtccatccctccaggggcaagcacctgttctcctgttggggctggagtgggggtttctgctgacaacagcatagggggcctcagggaccccacagttcctctcagggtggcctgggctacatggggcccattttgggcgcggggctctgagtcagaccctcggggtttttggcaagttctgtagggtcatcagcagtgaccttgggccagccacctaatcaggcttagcctgtttcctcatccaaaaatggggcccactctctccttagacgatgagtgtgagcatcacaggactgcatagggtggggcggaggcagaggtggggctctctggcagtggagtgggtgctagaggcaaacccctcccctgcagcctgcttggtggtgatgttatgctgctgtgtgtccttccactgaggcaggggcacaggtggcctgggctaggagggctgagcagcagagtgccgagggatggagggagagcccccatgggagggtgccagggggctggctgagcagctgggcggggtccgtgaggtaagaaggtgcccgggccagggggcaggagctctgatgtaggacagctcagcccagtcaaggggtgctatgaggacagcaggggcctccgagtctggggtggcctcacccccacaagcagtcctggctactcagcagcactacccagaggggacgcctgggcagtttcttcaattcggtggcacatcaacatcgtttgaaacttgttttttcttgttttgttttctagaatttgattcttccagaatgaccttcttatttatgtaactggctttcatttagattgtaagttatggacatgatttgagatgtagaagccattttttattaaataaaatgcttattttaggctccgtccccattgtggctctggtctcgaggccagtgcttgagtgtgctctgagccttctgtgggtcttgggccccaggagccctcagtgcctggcaggaaatcagcatggggattggccccaaggacaagatctccttactctgtcctccaggccctccgggtggcagtggacagaggtcaggacccctcggcatccccgcctcctcatagcacctgcaccggccactgcctggtggtgccagccagcacctggctctgtccacctaccacttcctctggtccacctggcctcagccacatagcaagtccaccctctcagccatccctccacctgtgggtctcaccatccagcactcttttccaggtctttgaaggcaggagtgatttgggtaggttttaagtcagtggggaaaagctcagaaagagtggcctggaaaagagcacacaggtaggtggggctggtcttggtgcagcccttggcaaagggcagtgggcacaaaagggtgagagctggactggaggctgggcccctcccctcacctctggtggtttgcacagcttcccgggacccttgagctgcctaccctggccatttgggaaaattcaaaggctgtgcagcttcctttccatgccctttctttcctttttttgagacagagtctcgctctgtcaccagactagagtgcagttggtgcgatctcggcacactgcaacctctgcctcccgagttcaagtggttctcctgtctcagcctcccgagtagctgggattacaggcacacaccaccacgcccagctaatttttgtatttttagtacagacgggtgtcaccacgttggccagaatggtcttgatgtcctgaccctgtgatccgcccacgtcggccttccaaagtgctgggattacaggcgtgagccaccgtgcccagccccgtgcctgtcctttcttaggaaaaggctttcttaggaatgccctcccaggcagccttgggcctcagcttctgaccaaacacaccagacctggtactacccagtcccggtggccaggtgcaagagtgtaaggaccattgtttttggctctgcccagggccacagctctgggatcacacactcccaagcttggggactattcttggtccctgttgtacaggcccaggtggggtacaggtcaggcctgctgaggacctctgcaccgtggggcccctctccctgtaactcatcccaccggctggttccacagcagctcccaggaagctgccacacattccagcagctgccctaagccactctgagcctgcattcttggggttctcccactgctccatgatggtagcctggccagacctaggagactccctgccactggatgtggcccagacatttctgggcagggcccccaagtccagtttggggcagataccaagtctcccttccggctgggcttagagctcttccctgcagcatgcccccttcatcagctgctctcttctgcttctagctttatgtcaaatgtcaaaaatgtgttaattcaaagtgcctagaacaaggctaaaaacagtgagctctcagtggctatgttagatggctctagacacccccattccgaggtgcctggcaggggccagcactgactcccaggccacacagcccctggaggaggaaggttacccagagtgcccccagcaggggctggcacaggtgctggttgtgagcaccattctgggcaggctgccaggccagcagggtgggtacaggctctgtagggagctgcgctgggactggcagaggagccaggacgaggggctagagccaagctgtggtactccaggcaaccagctgccagcacctcctcccatggcaaccctactgttgaccggcgtgtcctgcattcacccctgttcctgccccacccaccattggaaagggcctggtcggggattctacagacctctgtggccacttgatggggcttgggactaggcaagccctgagagggcagtggaaaacctcaccctgtgctgtgtggggcttggccctttctgggagaagccagcggcctggctgctcacccccagcacttcccacaccgcaggacccccactcaccagcctgtgttgagggcgcttcaccccgcatcttctgctggggtctgccgctgcccccgcccctgtcccatcccgggccccagggccccatgacgcagcagctcttctgaccgcagatcccgcctttctgggctgtagtaagtggtggctgtgtctcccacctggtgggaaggtggcagggaggatggggaaaagagccccagcctccagccctgggaggaggtctccacaggagtccttgggagggcggggctggtgggtgatgaatggggctgctggacacggaagatggctggacagagaacaggacacaggtgggagagagttcaaaccatttactaagcagattcttagccttcccactcccgccctctctcaagctccggtgcccacaagccttgcctggggagatgctggagtgagaccgggaggtccaggccaagtcactggtccctgggctcgggccctgccgatggagtaaagaccagctgtacacatcttccggtgggggccctgggctctgcatccgcccctccgaagtcagcaggagcctctgggaagtaaggcagcagccaagacccccagcgtcttggaggggaagcgaaatcctcagtctgacacccgctctgcctatggaaacagcgccgcgcacagaaaaggaaacttcattccgtctgttaagggcagggccgggctagtggcaggagaaggtcagctgcgggcgcaggcaggagcggatccaggagccgcgtcggggcgcagagccggacgttccgaggagcctgcgcgccgcgctacccggcggaagccgcggtccatgcggggctccccaggcttatccaacgcctcgcaggcgtggctggcaggaggggcccggccgtgcccagcgccctcagacgtagttcttcttgtcgtagtcgccggtggccgtgggccgccgcggcgctgagtacttcacggggaagctgaggtcgggacggccggtgcagacccaggcgccgcagcacaagaggcagccgcctaccatgagcagcgcggtggccgcccagccgatgtacagcgctgcgcccagctcgtacttctgcgacacgggcacagacgggtcgtaaaactcgcggacgacaatgttggcgaaccagcagagtggcacgagcgccagcagcccgcaaaacaggtagagcacgcctcccgtgagggccacacgcgccttggccgggcccggggccacgcaggtggtgcactgcgcgcccgccagggtcacgaagagcgcaacgaacgccagcagcacggcgctcacggtgagcgcccgcgccgcctgcacctcggtgctcagagccagcaccgagtcgtacactttgcactgcatgtgcccggtgctctgcaccacgcacgacatccacagccccttccaggtggtctgcgccgtcacgatgttgtggtccaggaaggcggtcacctgccacatgggcagcccgcacgccaggatcagacccccccagcccaccaggcacagcaccaggcccaggatctccaacgctgcggaccccatggctagaggcgagacgcgcacccgaaggcccgcagaacccccaaggccgtgctgcgcggcgccctgggcgggccctggtgcctttgcgcccgcgctcccggctcttggccccagtccgtttgccccgcgggtctgtcgcacctcctgggtctgccagctcctgccggggggtaccctctttgaaggttcgggggcggattctgtcccccgggcccggccccccggcccgaagcagccaatccgtgcgcgggtcatcgtgccgcagccaatcacagagcctctggcagctgaagttagggaaacaacggctcttgaggggtagctgagggcgcgggaccgctccccgcccggcagccgcccccagccccacccgccgttgtcctagtcgcggccgagcgcattctgggctggcctagggcgcgcttcttgggccgcctccctgcgcgtcccggccccgtcacttcagaaggcgctcgacccccagtctgcaccacccagtccactcccacatccccgactgagccgggtggtctcttccactcgagccagctccacttccctgaccaaggtttgcagaagccccccaccccgtcaccgccgtagaggccctcgtaggggggctctccagaaagcccgccccggggtccaagccccacccaggccctttctcgcactctcactctccagccccgctctgagtcccagcactgtctctctcatcccatggcaaacagagaggccaggcaggcgtgtggaggtcaggcccagggccccagcctcaccccccatgccactcactgcctctctggagcctgagtctctggcaaaaagcggtggcacaggggctttccccctgcctggcgacccccactctcccaagccgcaggggcttcccagacctctcaatcttcacaggggctgctcctcttcctgcggtactgcccgcaccccatccttgggggcccagttcaggtgacaccacttcaggaagttcccagtgacccagcacactgggtgtagcacccaggggcagtggtggccccaggcctagcagcctgctctggccttcagacaggagagacaaagggacacggaggggctgtgccctgccctcccaccagtggcgatggtgtccctggcaccccagcccccaggccaccctccggaagccaacttggagtttcctggccaggaggaagagcccccatccttgctggaggagggaggcgcgggatttccgggcattcttctgcacaatggcccagccatttctcgaaaggtccactggtgtggacactccgggccccctgaggctcaggtgggggcacgcggctccaaaacccacagccccatgggggcaccagcccctttctagtagttctttccccagtctctctcggcccctttgtttccagtaaagtttgaactccaggccctggactgaggccactgggtgcccagttcttttatctggtctgtgctcagttccattggacagggccctccatagaaaaagtatggcactgaggctggtcacagatgtgggaggtttgatgactttctccctcctggggcccggttcccttctcccccttcagatggctctgagatggtaaatgagataaggccagcgtctggctcacctagtgtggggaggttctgaaggcaagtgtgcccagccctgaggctggaaggaaatcataccctctttgctcagccccacgtggcctctccccaccaggtatggctctgaggaccactgccttctcccagctatcactttagtcactgccttcctcctgctgcagacccatgggccatgccccttcctctacagaccctcctggacatctcctcctctgtgtactccaggggtacagctgacccacccaccctctcactcttactaccccctaacccaagcccagggaacttccccagatccccctactcccagcccttccatgccaccatcttcctgggatgactgctgcggcctcctcaggtcatcagggacctgcccttgcccagctaggccacccaccccaccaggcccctctcctgggcctcaccctacctaagaccctccatggctcacattgcccatggacgaagagccgactcccagagcagctggattgatgtgtacctgcatgcgctaggactggccagtccagccaccagtcttggtgcggccctgagcacacactctgccccaggagacttacctgcctatgggcctcacatgggccgtctcttaccttggcctcttctgcccgcagcgtgtatctgtcaggttgggtcctgctcatcttctaagatgtgttgccgaggtcatttccaggaacaccttgctgcaccgtcccccagcattgcttttagaagcttgagctggacctgtccttttgcttgccgactttcccacctagtatccaggaataacctccacagggtggctgtcttcatgcgtctgtcctgcacaggaggctgcctgttgccctctagccagcttggagctgcagccagcccaaggctctcccttctcacctggctgcctgtttttcttctctcctagctgtcaccctagggtggccccagcaagctcatgtttctttggcggcagcctcacagcatctcagggacgtggcagaggagtctcaggcttcacctttcacaatctggtttctaccctgaccccactatgttggtcgaggccccaggctgcagtggaacaatgccaatgcagagaggcccagagagggccgcaggggctgacgccaccccagacaaacccacctcagatggaggctggcctctgagtagcccaggccagactccggaggggcatgagggtgcacccacctttcctgccactcatggagggtctgctcacctacttcgtggcaagcactgtctctaggcagagcacacagcacaagaagctcctgcccagaaggagctgacaggaacctatcaaccaagaactgggcaggaaagacagtggtgaaggcctctctgaagaggtgacatttcacagggatccggggaagaagttccaggcagagcagaagcaatagccagtgcaagatcccagaggtgggaaggggctcggcgtccaaggggcagaagcggccttgtgtccacagtgccacagtggtccagggcctgcaggtggagatcggaggtgtcctggttaggcagggacacaaacccctgatctctggtaaagggcccttggggcagagcactggccaaggccacctgctcacccccagccattgttctgctttcccaggggaagaatggcaggatctcattaattgtgtgtgagaagagcctgagtctgcagaaaagccaagtttatcttgagcagctgctggctgaccctgccccagggtaatcccgtgaccttccaaggataagctaaatttaggctcaagattcctggggatttgggtttgggaaactcctagttaacagatttgatttcaggggaagtgaagaacagcgtttcttctatctttcagttttgaaacagttaaggatgtgtccttctatttccgcaaatgtttgcagagcctccaagcacagtgtggcctggtgctctttcttgacacaagccagtactcctgcaggccgagagcagcagctggggtcctcctgcatccctgaccactgcaccaggtgcccgaggcaccctgtgtggggcccctgggcggctgtgacgatgtgagcagcatccagagtggacagtgccagactcggcggttttgcgggcattgttgttactctttgtggttaaacacaggcatggagtcagattcgctcccgcaagcaagaaactttctggactagtgaggtggcctctctgccttagttcctcactggtaacgaagccccccaatggtggaggctgcgaggctgcaggggaggccgatgccagtcccggttctcttctgcctttcctgagtgccatccacccaggctcccagggccttcacagctcatccaacctcagccgcacccctcagggtagtcatcgctggctgttagtcagaattggaggtcactgtggctttaacttccccagcgggtgagggagtggggggcagggagctctggtgtgatccacgaagggtcaagggttctatagaatggcaagccaggccaagcgcagtggctcacgcctgtaattccattcaggaggccgaggtgggcggatcacttgaggtcaggagtttgagaccagcctgtccaacacggtgaaaccccgtctctactaaaaatactaaaattagctgggcgtggtggcacgcacctgtaatccgttactcgggtagctgaggtgggagaatcccttgaacctgggaggcagaggttgcagtgagccgagatcatgccattgcactccatcctgggcaacacagcaagactccatctcaaaaaaaaaaaaaagtccaccaaagtacatcataaaccaaatttcgtaaaactggtgctaaagagaaagtcttaaaagcatggagaggaaaggccgggcgcagtggctcaggcctgtaatcccagcactttgggaggccgaggcgggcggatcacctcaggtcaggagttcgagaccagcctgaccaacatggagaaaccccgtctctactaaaaacacaaaaaatcagccgggggcttggtggcaggcgcctgtaatcccacctactcaggaggctgaggcaggagaatggcgtgaacccaggaggcggagcttggagtgagccgagattgtgtcactgcactccaacctgggcaacagagtgagactccgtctaaaaaacaaaacaaaaaaaagcatggagaggaaaaagacacattgtgtgcagaggaatcaagaagaaggagatttcttgttggaaacagtgcaagcaagaagatagtgtagcaatatctttaaagtactgcaagaaaaaaatccctgtaacctaaaattctttttcttttttctttttagaccgggtttcactttgtcatcgaggctgcagtgcagcggcacaaacatggttcactgcagcctcagcctccgggttcaagggatcctcccgcttcagccgcccaagcacccaaatagctaggactacaggcgtgcgccaccacacccggctaatttattttattttatttttgttttttaaattttttgtagcgatggggtttcaccatgttgtgcaggctggtctcaaactcctgagctcaagtgatccatttgccaatcccagtgctcggattacagcgtgagccaccacgcccagccttaacctaaattctatactcaccaaaaatgtattccaaaaatgaaggcaataccacatccatggatgagcctgaaaaaaataaatgaaggcagctgggtatggtggctcacgcctgtcatcccagcactttgggaggctgagacaggtggatcacctgaggtcaggagtttgagaccaacctggccaacatggtgaaaccctgtctctactaaaaatacaaaaattagctatgtatggtagcaggtgcctgtaattccagctacttgagaggctgaggcaggagaatcgcttgaacccaggagacggaggttgcagtgagctgagattgcaccactgcactccagctggcatgacagggcgagactccatctcagaaaacaaaaacaaaaaaaatgtttttaaataaagacaaaacagacttctgcttcctagaagacagataaacatatgtttccctattccttccacaaaaaaaccctaaatgttataaataaagcaaacataagaagatgctaagtgttacaaagaaggcagacaagctagagacttagagccaaggacgaaatggtggtgtttctctgggttgcctttttgtttttttttttcttattttatttatttattttagaaatagttctcattctgtcacccaggctggagtgcagggacacaaccatagctcactgcaactttgaactcctaggctcaagtgattctcccacctcagcctcccaagtagctgggactacaggtatgcaccaccacccacctaatacttttaaaaaatttttgtagagacggtcttgcaatgttgctcaggctgatcttataactcctggtctcaagggatcctcctgcctcagcctcccaaagcactgggatgacaggcatgagccaccatgcccagcctcctgggttatctttttgactcatgtatcccagactgcatacagaggagctggccacccagaaacaccaatgggtacaggcaaaaaataagtcctaagcaaagccggttctgtctagccaaaagatcaggacaaagacagactaacaagacaaaaatattttagacaataaccactctactcaagctatactactacagaaaaaaactgtggccccaaccctgccctcaatagcaaagaccagtggggagcttagactcctacccttgccaggctgtaatgagatgctccagcctcctactggggtgtcagaggaggccaaggaagacttgggtggaaataggtccccctccctgaccacagtgtcagtggagaccacatggggagcctggacttccactcctaatgtggtaataagggccccctccaggtcctcactatggtactgtcagaggaacctagcagagggtaaggacattcttcattttccagaggtgatgaggctctccctgcccacacatggtgccagtggaggccacgtggggatcagcagcaggcattcctcccatccatgcctggggtatcacaagaggccgagtggggagcaggaactcccagccccacccagcagtcacaaggatccccgtggccccaggtgtcaatggaggtagggtggagaacctggacttccacttctgcctggcagtaaagtgtcccctgtcattgccagaatggtgtcagaggaagcttgctaaaatacaagatttaaataagatccacagtcttgtaataaccaaattatccaagttttgattgaaaataagtcatcaggctgggcggggtgtctcacgcctgtaacccagcactttgggaggctgaggccggcagatcatgaggtcaggagattgagaccatcctggccaacatggtgaaatgccatctctactaaaaatccaaaaaaattagccaggcatggtggcacacgcctctagtccccgctactcaggaagctgaggcaggagaattgcttgaacctgggaggcagaggctgcagtaagccgagatcatgccactgcactccagcctgggcaacagatcaagaccctatctcaaaaaaaaaaaaaaaaaaaaaaagaaaagtcatcataccaagtatcagtaagatattaaactaaattggccaggtacaatggctcatgcctgtaatcccagcactttgggaggctgtgggcagatcgcttgaggtcaggtgttcgagaccagcctggccaatatggtgaaaccctgtctctacaaaaaattagccaggcttggtggtgcacccctgtagtcccagctactccagaggctgaggcatgagattagcttgagcctgggaggcggaggttgccgtgagctgagatcgtgctactgcactcctcctgggcaacagagcaagaccccgcctcaaaaaaaaaaaaaaagaaagaaagaaagaaaatcgacaaagatggcaatgtcacagatgtgagaattacttcatatttcaaagcagaaatgataaaaatgcttcagtgagcaattacagatatgcttgaaacaaatgaaaatatagaaagtcttacaaagaaataagaaccacatagaaattttagaactaggccagccatggtggctcatgcctgtaatcctagcactttgggaggccgaggtagatgcattgcctgagctcaggagttcgagaccaacctgggaaacatggtgaaaccctgtctctactaaaatacaaaaaaattagctgggcgtggcggcgtgcacctgtaatcccagctactcaggaggctgagagaggagaatttccagaacccaggaggcagagattgcagtgagctgagatcgtgccactgtactccagcctgggtgacacagcgagactctgtctctgaaaaaaaaaaaaaaatttagaactaaaatacagtaaccaaaattaaaaaaaaaaaaaaaggtcattggggctgggcgtggtggctcacgcctgtaatcccagtactttgggaggccgaggcgggcggatcacgaggtcaggatcctggctaacaaggtgaaaccccgtctctactaaaaatacaaaaaaattagctgggggtggtggagggcacctgtagtcccagctactcaggaggctgaggcaggagaatggcgtgaacctgggaggtggagcttgcagtgagccaagattgcgccactgcactccagcctgggcgacagagcaagactccgtctcaaaaaataataataataaaaaggtcattggatatcagctggacagcaacatggaagggacataggaaactattggtgaattggaagctagaacagtgcaattttcccatctgggccagccacagtggctcacacctgtaatcctagcagtttgggaggctgaggcaggaggattgcttgaggccaggagttaaagaccaactggccaacacagtgagacgtgtctctattaaaaacaaaattttaacccaattatcccatctgaacaagagagagaaaatcactgaaaaaataagaataaacaaaggctcagaaaatgtgagatcataacaaaagacctaacatccatgtcatgagagtgccaaaaggagaggagaaagggggtggggttaacaaagcattcaaagaaataatagctggaaatttcctgaatttagcaaaaagaaaaagagagagaaaaaaaccctacagattcaagaagttaagtgaggccgggtgcggtggttcacacctttgggggccaagatgggtggaccgcttgagcccaggagttcaagaccaacctgggcaacacagtgagacccctgtcgagagagagagaggagaaaaattaaatggaaccttaaacatgataaactcaaagaaatccacactaaaacatctttttttttggagacagattattgctgtgtcgcccaggttggagtgcagtggcacgatctcggctcactccaacctctgcctcctgggttcaagagattcttctgcctcaacctcccaagtagctgggactacaagcacatgctgccatgtccagctcattttttttgtatttcagtagagacagggtttcaccgtattgcccaggctgatcttgaactcctgagctcaggtgatctggcctcctcagcctcccaaagtgctaggattacaggcggcagccaccgctccaggcccaaaacatcttaattgaacttctgaaacctaaagacaatgcagctagacagaaaaatgacacctcacctattggagaagaaaatgaatcaaatgacagagaatttctcttcagaaaccagggagaccagaagaaagtagcacattttttaagtgctgaaagaaaaaaaaaaaaatctcaatccagaattctatgtctagtgagcatattattcaagaatgaagggggaaaatttttttttcaagtgaaggaaaatgaagagaatttattgccagcaatatatgctgaaagaatgctaaaggatgttccttaaacagaaaggaaatggtaaaataagagtcttggaacatcaggaaggaagaaagaacatgataagcaaaatactggtaaatattaatacaatagattttcttcctcctcttgagtttcctaaattatgtttgatggctgaagcaaaaattattacactgccttaagtggttctcaatgtatgtagaggaaatatctaagatatataattatattataaatgggggagggtaacaagacattaagggaggtaaggttttttgtttgtttgtttgttcgtttttgagatggagtctggctctgtcatccaggctggagtacagtggcaagatctcggctcactgcaacctctgcctcccgggttcaagtgattctcctgcctcagcctcccaagtagctgggactacaggcgcccgccaccaggcctggctaatttttgtatttttagtagagacagggtttcaccacattggccaggctagtctcaaactcctgacctcaggttatccgcctgcctcagtctcccaaagtgctgggattacaggcatgagccaccatgcgcagctgggaggtaaggtttttttttttgttttttgtttgtttgtttgtttgtttgtttttgagatggagtcttgctctgttgcccaggctggagtgcagtggcgcaatctcggctctctgcaagctccacctctgggttcacgccattctcctgcctcagcctcccgagtagctgagactacaggcggctgccaccaagcctggctaattttttttgtatttttagtagagatggggtttcaccgtgttagccaggatggtctcaatctcctgacctcatgatccacccaccttggcctcccaaagtgctgggattacaggcatgagccaccatgcccggccaccgggagataaggttttttacacttcattccaactggtaaaatgttgacacctggagactttgattatataatataaattttatatatatttatcctacagcaaccactaaaaagctatacaaaggtatcaagaagaaaaaaaaaataacaaatgctggtgaggttgcagagaaaagagaactcttatacactcttggtgggaaagtgcacccatctggtaccataaactagcccaaccacaatagagaacagcacggagggtcctcataaaaactgcacatagaaataccataccatctagcaactccatgactgggcattaatccaaaggaaggaagtccgtttatcaaagacacatctgcacccttatgtttaccgcagcactgttcactagccaagacatggaatcaacctaggtgttcaacagcagaggaatggataaagaaaagttggtacatatacacaatgaatactattcagccattaaaaaaaaaaaaaagaaatcctgtcattcatggcaacataaatggaactggagaacaatatgttaagtgaaacgagccaggaacagaaaggttatttatttatttatttttcacttatttatttatttattgagacagagtcttgctctgttgcccgggctggagtgcaatggcatgatcttggctcactgcaacttctgcctcctgggttcaagcaattctcccacctcagcctctcaagaagctgggattacaggagcgtgccaccatgcctggctaatttttgcattttgagtagtgacggggtttcaccgtgttagccaggttggtctcaaactccttacctcatgatctgcccgcctcagcctcccaaagtgctgggattataggcatgagccactgtgcccggctgatgttttattttttagagatggggtctcacaatgttgcccaggctggtctcaaacttctgggttcaagtgatcctcctgcctcaccctcccaaagtgctgggatttcagggaggagccaccacacacagctaagacagagttaaacaccacatattcttattcatatgtagcagcttaaaaaagttgatcttggctgggtgcagtggctcatgcctgtaatcccagcactttgggaggccgagggcgggtggatcacgaggtcaggagatcgagaccatcctggctaacacggtgaaactccatctctactaaaaatacaaaaaataataataataataattagccaggtgtggtggcgggcacctgtagtcccagctactcgggaggctgaggcaggagaatggtgtgaacctgggaggcggagcttgcagtgagccaagattgcgccactgcactccagcctgggcaacagagcgagactccgtctcaaaaaacaaaccaaaaaaaagataaataaaaaataaaaataagtaataaaaataaaaaacaataaaaattaaaaattaaaaagtatatttaaaaagaggtagagctatatgcactgacctggacatatctctaacagatcttattaagggaaaaaaatcattcaagtttatcacattacatatacaatgatactgtgtaaacttaaattcccacaaaaatgaaactatgtaattttttttgttttgtttcattttgttgttgttttttagtgagacagagtctcactctgttacccaggctggagtgcagtggcatgaacatggctcactgcagcctctacttcccgggttcaagcaatcctcccacttcagcctcacaaggagctgggaccacaagtgtgcaccaccacgcctgcctaatttttgtatttttctgtagagagggggttttgccatgttgcctaggctggtctcaaactcttaggctcaagcaatcctctgcctcggcctcctaaagtgctgggattacaggtgtgagccacctggccaaaactatgcacttttttttttttttttttttttttttttgagaaagagtctcgttctgtcgccaagctggagtgcagtggcaggatctcaattcactgcaagctccgcctcccgggttcaagcgattctacctcggcctcctgagtagctgggactacaggcgtgtgccaccacacccagctaacttttgtatttttagtagagatggggtttcaccatgtttgccaggctggtctcgaactcctgaccttatgatccacccacctgagcctcccaaagtgctgggattacaggcgtgagccaccgtgcccagccccaactatgtacttttatgtttatttttatgaatacaaatggacagataaaagtctaaggcatagatgccaaattgatatctattattgcctatgtgtaggagactctgggatttactgggggagacatcagggattttttactttctttgtattctgtactttttctatatttcacgactttctatattgtttgaaagtttacaacataaatgtatttacatcttacctacaaaattattatttctttaatgaacagttgtagcttatatataattccttcagaataaataaataaaagaaaggaagaacacgggggaaaagctatacaaagagacacactcaaaaacactgtagataactcaaaatgtaattttttttttttttttttgagacggggtctcactctgttgccgcccaggctggagtgccgtggcgcaatctcggctcactgcaacctccgcctcccaggttaatgacattctcctgcctcagcctcccaagtagctgggattacaggcaccccccaccatgcccggctcattttttgtatttttagtagagatgggatttcactgtgttagccaagatggtctcgatctcctgaccttgtgatccgcccgcctcggcctcccaaagtgctggaattaacaagtgtgagctacggtggccggcctcaaaatgtaattttaaggaatattcaagtaagccacaggaaagcagggaaaagtaaagagaaatgaacaaaaagagacacaacaaacaaaaaaataaaaataaaatagcactcttgggccaggcgcggtggttcatgcctataatctgagcactttgggaggtggaggcgggcagattacttgaggccaggagtttgagaccagcctggccaacattgcaaaaccccatctctactaaacatacaaaaactagccagtcatggtggtgcccacctgtaatcccagctactggggtgcctgaggcatgagaatcgcttgaacccaggaggccaagaggcagaggttgcagtgagctgagatcacaccactgcacttcagcctgtgacagagcaagcaagtaggcaggcaggcagagagaaaggaagaaaagaaggagagacggagagagggagggtggaggggggagggaaggaggaaggagggaaggaaggaaggaaggaaggaataattactagaacaaagacattacataatgatgaaagggtcaattcaccaagaagacacagcaattctaaatatataggcaccaaacaacagagcttcaaaatatgtgaggcaaaactgataaaactaaatggagatatagataaatgaacaattgtagttgaagcttcaacatttctctctcaaaaattgatagaaaaagtagacagaaaatcaacaagaagacagaatctcaaacaccatcaactaacaggatttactccacatttacagagcactacctaacagcagtggatacacattcttttctagtgcccacagaaccaaccatatcttgggccgtaaagaaacctcaaaatcaatgaaaccaaaagttggttctttgaaaagttcaacaaaattgacaaatcttcagctagattgacctaaaaagagggaggaaacccaaattacctaaatccggaatgaaagaagagatatcacttgtgggcttacacaaataagagtgattttatttatttattctactttattttatttttttgagatggagtctcactctgtcacctaggctggaatacagtggtgtgatctcagctcactgcaacctccacctcctgggttcaggtgactctcctgcctcagcctcccgagtagctgggattacaggtgcccaccaacatgctgggctaatttttgtattttgtatttttagtagacacggggtttcaccatgttggccaggctgatctcgaactcctgacctcaggtgatccgctggccttggcctcccaaagggctgggattacagatgtgagccacaacacctgaccaaaatagtgattttagaggaatactatgaacagttgtatgccaacaaattagttaacctagatgaaattgaccaattcttagaaacatagactaccaaacctgactcaaaaagaaatagaaaatctgaatagatctataacaagcaaatataatacaaaaaattagccgggcatggtggcagatgcttgtaatcccagctactcgggaggttgaggcaggagaatcacttgaacccaggagatggaggttccagtgagtcaagatcgcaccattgcactccagtctgggcaacaagagcgaaactccatctcaaaaacaaacaagcaaacaaacaacaacaacaaaaaacacaagcaaatataacaaacaaacggattgagttaggaaaaagaaaaaaaaaaatccaacaaagaaaagtctaggaccagatggcttcactggtaaattctaccaattttttttttttttcgatggagtctcgctttgttgcccaggctggagtgcagtggcgcaatctcagctcactgcaacctccaccttccgggttcacgccattctcctgcctcagcctcccaagtagctgggattacaggtgtctgcaaccatgcccagctaatttttgtatctttagtacagacagggtttcgccatgttggccaggctggtctcgaactcctgacttcatgtgatccacccgcctcggcctcccaaagtggtgggattacaggcgtcagccatggcgcccggccctatcaaatgtttaaaaaacaactagcaccaatccatctcaaactctcttacgaaaaagaaaaaaaagagagagggaattcaatccattctatgaaaccaatattactttgacaccaaaagtaaagcaaaaaaaaagaagaagaagaaaggaaaaagagagaggaaactacagaccaatattccacatgaatatagatgcaaacattcttaacattttataaaataaattcagccgtatataaaaataattatacaccatgatcaagtgggatttattcctagaatacaagcttggttcaacttccaaagatcaatcaatgtataccaatgtaagctaaagaagaaaaatcacatgattatattaattgacacaaaagaagcatttgatgaaattcaacacccattcatgataaaagctgctggtaaccagtaatagaaacttcctcaacttgataaacagtgtctacaaaaaacctacagctaaaaattatacttaatagtggaaagctgaatacttttctgtgaaaattagggacaaggcaaaaattctgccttcactactcttactcagtatagtgctggaagttccagacatcacagaaaggggagaaaaggaaagagatagagatcagaaaggaaaaaccaaagctgcttctatttgcagatgacataaatcaattcccatggaatcttttaaaaagccttagaaccaacaaatgagtttagcaagatacaaggattcaagatcaacatacaaaaatcaattgctatttctatgttctagcaatgagcacatgaaaaccaaaataaaaaataatatcatttgcaatcactcaaaaaatgaactaggtgtaaatctaaccaaatatgggtttgtatggataaggacttgtatgctgaaaactacaaaaccctggtgaaagaaatcaaagaagatgtaaataaatagagaggtatggcctgttaatggactggaaaactcaacatggtgaagatgtgaatagttcgattcctttcaaaattctagaaagatttcttggccaggcacggtggcccatgcctgtaatcccagcactttgggaggccgaggagggcggatcatgaggtcaggagtttgagaccagcctgaccaacatggtgaaaccccgactctactaaaaatacaaaaatcagctgggcgtggttgtgtgtgcctgtagtcccagctactggggaggctgaggcaggagaatcacttgaacctgggaggcagaggttgcagtgagccaagatcacgccactgcactccagcctggacaacaaagcgagactccgtctcaaaaaaaaaaaaaaaagaaaaagaaagatttcttatagatataggcaagattattctaaaatttataagaaaaagcaaaagaattaaaatagttaaaacaattccaaaaaagaagaataaagtgggaagagtcactctaccaaatttcaagatttgtatagactgtttggcattggtgaagggatagatacattttgttcaatgaaacagcctagagaacccagaaacagccccatgcaagtatagctggctgatttttgacaagcatgtacaagcaattcaatgatacaaaggaatcgaaaccaggaactcaaacagacatttgtacctcagtgttcatagcagcatcattcacaacaccccaaaggtggaaaaacccaaatatccatcagtgaatagcaagataaacaaataaccaaacctaaaagtggcatatccatacaatggaactttattcagccttaaaaagaaagaagattccagtacatgccacaacatagatgaaccttaaagacatgataccaggtgaaataaaccaaacgcaaaaggacaaataccgtatgattccactgacatgagggagaggcctggagtagtcaaattcatggagacagaaagtggaatggggattgccggggtgggggcgtgggacagagtgcaaaatagggcttttctgtatctattgaaattttgttgctgttgttgttttattctgttaatgtcgtgattcacactatgtaattttatatcaaccctgtatttttgcgataaacccaacttagtcatgatgatttatgttgtttttttcttttttgagacggagtctcactctgtcgcccaggctggagccatctcggttcactgcaaccttcacctctcgggttgaagagattctcctgcctcagcctccgagtatctgggattacaggcgcgtgccaccactctgcctggctaatttctgtatttttaatagagacggggttttaccatgtcggccagactggtcttgaactgctgacctcaggtgatccacctgcctcggcctcccaaagtgctgggattacaggcgtgagccaccgcgcccagccaatttctgtatttttaatagagacggggttttaccatgttggccaggctggtcttgaactcctgacctcaggtgatctgcctgcctcggcctcccaaagtgttgggattacaggcgcgagccaccgcgcctggtcgatttatcttttttatacattattggattcagtttgcatctctgttcatgagtgaaatttaccagtaattttatttttttgtcctgttcttgttcagtttgtatgtcaagattacgttagttttataaaactgaagtgaaagtgtttctcacttttctattctctgaaataatttgtacaaggttggaattatctgttttttgaaaggcagaatttgcttgcaaagttattttaacatttttgggggaggaggggaatattttaaattactgattacatttctgtaattgttgttaagacaattgaggtttatttcttttttattccattaaaagaaacctgtgtttttccaagaaattatccagttcatctgttttcaaacttgttggcataaagttgatataagagcctcttatattttcatatacttgctgacacacccatgttaaatctgttttgtcctggtgttttttatttgtgcatcctctcttcttcttgttaatacttccagaagcttggctttatatttgtatttccaacaaatcaatgtttgactttgctgccttaaattttatttaatctgatattgaccaaattaacaatttttctcttggttagtctttgcacagtatatctttctttcccttgacattcaatttttctttttctttctttttcttttcttttctttttctttttctttttttttttttgagtcagggtctctgtcacggaggctggagtgcagtggtgcaatcatagctcactgcagcctccaactcctgggcttaagtgatcctcccaactcagcctcccaagtagccgagaccacaggtgaaacaccaccacaccaaacttctttttcttttgcagagacagggtctcaccatgttgcccaggctggtcttgaactcctgcctcaagcaatcttctgccttggtctcccaaagtgctgggattacaggcgtgagccatcacacccagcccatttgggtttatttgtgacattttctgcccagctttcccactcattcctcctttcttgcatcttttgggtgtgagagagagaatgtgtctttttttttttttttttttttttttttagagacggagtctcgctgtgtcaccaggctggagtgcagtggcaaaatttcggctcactgcaacctctgcctcccgggttcaagcaattctcctgcctcagcctcctgagtagctgggactacaggcacacgccaccatgcccggttaatttttgtatttttagtagagacagggtttcaccatgttggccaagctggtcttgaactcctgacctcaagtgatccactcgcctcagcctcccaaagtgttggggttacaggcgtgagccaccgcacccagccacgtgtgtgtcttttattccctgctttcccttctgcctgtttggcacttataactactgtgcctatttcatggatgccctccaaagttaatatctgaggttaatgtttttccctcctcccattccaatgggtattctcccaataccagagccttagcatgtatcacctgctaccagctcacatgccattgttgcccagcgcacgtgctgggtgtactggtgtgcagagtccaacgggagggctgggagaaggcccccgacctccctgccctctcagactgtggccgcacccagcttgccagacggagagcccaggagcaggaagctggtgtaaacacagggcgggcacccacactgttcccaggagccagtccttagatcctatctggctctcaccctgcctttgtcaagccctcaggacttggcacccaggtctgatctgggtgggcgtttgtccaaacaagaagtgagccagagctggacatccaggaccagaccataccacacagagggcatggggacactctcccagggcctgcagcccttcccggggctgctcttggcagcccaggcaccctggaggatatgcagtgcctctctgcccacccacacccctctggggctggcagggcctggagtgtgcgtgggcatgcagacgcatacacatctagcccttggctctcctcattggaccccttcagacactcctttctcttcacacttttacggaaaaggcacaagtggggatgtcctgccctgtgactggccttggctggcctggcccctgtagcacacgctggtggaaggaatgtccacagtgcagaaggcgctgctgcagaccgtgggctcacccgttctcattccacctgcaggtggaccaagcctggggtggcggggacaggccccacagactgaagtgacaggggatggagaagggctggggacagaggggacacagccacctacctggcaagctaagaggtcgggaagagtagctgccacttacatgggtttagacaaacaaacaggagttcaccagggtgaagggaaacgggagacctggctaaaagcaggaaaaagtaccagcatgggagcgggggcaacagcagaaccccagggagggtcagatggggtgcagcgccgggaggccagccagttccctggaagagagtttgcaggactaaagcctagagcctagattgctgcaaagtttcccagaagcggctgttgaacaatagtcacggccgggcacggtggctcacacctgtaatcccagcactttgggaggccaaggcgggcggatcacgaggtcaggagattgagaccatcctggctaacatggtgaaaccctgtctctactaaaaatacaacaaaaattagctgggcatggtggcaggcgcctgcagtcccagctacttgggaggctgaggcaggagaatggcatgaacctgggaggtggagcttttagtgagccgagattgcgccactgcactccagcctgggcgacagagcaaaactctgtctcaaaaaaaaaaaaaaaaaaaaaaaaacaacaatagtcacacggccacatctagctgggaggaaaggtgaaatatgttttagctgggtggccacgactagtgaaacatgaggcctgtatttttgctggggcagtgagcatccttggccacatgctgggctccagggggacggccaggggcattggccagggaaggagcccaggagagcaaacagaacctgcatactcactcccctccctcccagtcccatttaatctaactgtgaagacagtgaaaactaataagcccacagtaagaggggaaatactcgagactgccatcagttgaccagaaattttggaagagtttgaagaatttttgggagacaggaagcagataggatcagggcatagttaagggcacccaggcagaagccacggccctgaaggagcccccggcaagggcagggatggctgcagttgccagctttagccctgagagcagctttgtgaggcaggcagagcagttcccgggagggcccaccacagtggtcagagaggcagcaaactggctccgccgtgcagctttgggcggaaaggcaggtcctgccaggaaagaaaccaagcagagtcagttaaaggaggtctcctggtggtcctagagtgttgtgggggaggttacgaacaggtcttccacacacctggtgggagtgtgaggtgacacaaccacttggagaacagttccccagtatctcacaaagcagaacgggtgcgtagcccatgagccagaaaacaaggacccgtgtgtgccagagtagtgatacgagaatatccatgggagcattgcccttaatcccttaatagtgctaactagagtgcacacaagtgtccatcaacaataggctggatgaatgcactgtggtatattcacacagtggaatacatgcaatgcagagcaacacacagcttgtatgaattttataaaggtaacagcgggtgagaggcacaagcccctgaactgtctactgtatgattctgtggcagattgtattttccaaagatgccaccaaatgtagagacattcaaagatatcacccattggacattctctttttcattttacttttgtaaaaattgcgggcggtggtgatggttgtacaacaatgtgaatatactattgctactgaactgcatactgaaaatggctaagatgaggccgggcgcgttggctcatgcctgtaatcccagcactttgggaggccaaggcaggtggatcacttgaggtcagaagtttgagactagcctggacaatttagcaagaccctatctctaccaaaaaacaacaacaaaaaacacatttttttttcattagccaggtgtggtggcacatgtctgtagtcccaggtgttcaggaggttgaggcaggaggatcacttgagccacgaggtcaaggctgcagcgagctgtgattgtgtcattgcactcctgagtgagatcctgtgtctaaaaaaagaatgtggtaaaatatacatgacatgcactttacttttttttttaaccgagttttgctctgtctcccaggctgcagtgcagtggcgcaatcttggttcactacagcctccacctcccgggtttaagcaattctcctgcctcagcctccctagtaactggcattacaggtgcacaccactacacccagctaattttgtatttttagtagagacgggattttgccatgctgaccaggctggtctcgaactcctgacctcaaatgatccacctgcctcagcctcccaaagtgctgggattacaggcatgagccactgcgcccggcctcatcttaaccattttcagtatgcagttcagtagcaataggtacattcacattgttgtgcagccatcaccaccgcccatctccagaactcttttcatcttgtaaaactgatactccatacccgccaaacactacctccccagtaccctcctgttccagtccctggcaaccatatctactctctgtctctatgaatttgactactctaggtacttcatgtaagtggaatcatacatgaggtatttgcccttttgtgactgacttgtttcactaagcataatggcctcaaagttcaaagttcatatattttgtagcatgtatcagtacttcatgaatttttttttgttttgagacagagtctcactctgttgcccaggctggagtgcagtggtacagtctcagctcactgcaacccccacctcccaggttcaagcaattcttctgcctccgcctcccgagtagctgggactacaggtgtgcgccaccataccgggcttttttttttttttttttcgtagagatggggtttctccatgttggccaggtctcaaactcccaacctcgagtgatccacccaccttgacctcccaaagtgctgggatgatacaggcatgagacaccacactcagccttgttgttgttgttgttgttgagacaggatctggctctgtcacccaggctggagtgcagtggcctgatcatggctcactgcagccttaacctcccaggttcaatcaatcctcccacctcagcctcccgagtagttgggactacgggtgcacgccaccatgccttggtaatttttttgtattttttgtagagaaagttttgccatgttgcctgggctggtctcaaactactgggctcaagcatccacctgcctctgcttccctgaatgctgggattacaggcgtgagacaccatgcctggcccttcattccattttttttttttttttttgagacagagttttgctcttacacccaggctgaagtgaagtggcgcgatctctgctcactgcaacctccgccccccaggttcaagtgattctcctgcctcagcctcctgagtagctgggattacaggcgcctgccaccacgccctgctaatttttgtatttttagtagagatggggtttcgccatgttggccaggctggtcttgaacttctgacctcaggtgatccacccgcctcaacctctcaaagtacaggcatgagccaccgcgcctggccccttcattcctttttaaggctgagtaaaattcccctatatagttatattacatttgtttatccattcatcaaccaaaagtccacttggggccagggatggtagcttgcgcctgtaatctcaacactttgagaggccaaggtgggaggaccacttgagcccaggaattcaagaccagcctgggcaacatagcaagaccccttctctacaaaaaaaattggccaggcatgatgatgcatgcctgtagtcccagccacttgggaggctgaagtgggaggatcgcttgagcctgggaagttgaggctgcagttagcagtgatcgcaccactgcacgtgagtctgggtgacagtgagactgcctcaaaaaatgtttttaaaaatacagtcgtattggctgttccaaatgatggtgccatgaacatgggtgtacaagcatgtgctgctcttatgatacaatgctgatgtgctccccatcaaaagctggggtctatattccctctccttgcacctgggaaggttgtgacagaaatgatgctatgtgacttccaggctagatcataagaggtgatacaacttgctcctcatcctctttagtggctcactcttggagcccagtcgccatgttgtgagcaactcagaccagacttagaggccacatgtagatgttccagctggcagccagcatcaactaccagatagagggaaagagttttccaagcaaccccagcctctgtgactatctgagcaagaaccacccaggcgagcccagtcaaccccagagccatgagagatgacagaaatgactgttgctgtttcaggccactgaggtttggggtgtttggagtgcagccactacatgcaccctacaaagaagtctgccctgggatgggaccccccacatcccacagccacctccaaacacaggaccagagaccccaggatcagcaggccaaaatgaccataaaggaagcccaagcttgccaccctgtcaacgaggaagtcccagatgggagatagtaatgcgagaacaaaggaaaacgtaagcaaccttgatgatgtgaaataatagtaaagctgatggaaacggggaggtagagcaggaagatttcttcatcttgcacagtggggtccgtcataaaatatctacagcaatagaggtctggggcaggtccaggctccactaggtggctgtaaggtggcttgttggacggacccgagtcactggtgtcactagtccctgaaatcacagcatctccactgctctgacaatgacaggtttagaggttaggccccagcctgctgggtatgcatttcctttagtgctggagatggactcagaatgcgtatgtgaccctatgtgggccagcaattggccagtgcaagattgctggggattctgggaccggggtccttattttcaagatacagccatgtgaaaaaatggctcctaccaacacacgaagagggaaactccgcactcctattgcttggcagccatccttccatcactaagggaaccagccttaggataaagctgaggggtggagcaatggaaggtactcaggtttctatcacagtttttgtttgtttgttttttgagacagagttttgctcttgtagcccaggctggagtgcaatggtacgatctcagctcactgcaacctctgcatcttgggttcgagcgattctcctgcctcagtctcccaagtagctgggattacaagcgcccaccaccacgcccagctaatttttttgtatttttagtagagatggggtttcaccatgttggccaggctggtctcaaactcctgacctcaggtgatctgcccgcctcaggctcccaaagttctgtgattacaggtgtgagctactgcgcctggccccagctaatttttatatttttagtagagatggggtttcaccatgttggccaggctggtcttgaactcctgacctcaggtgatctgcctacctcagccttccaaagtgctggaattacaggcatgagccactgcgtccagcctctatgatggttctgtaaagcctgtaagctgaacagccctggagcctgccttacctctgaacatccactggcatgagccaataaattgctatattaagaccgttctagttggatttttttccttttttttttttttagacagggtgtcactctgtcacccaggctgcagtgcagtggtgtaatcatagctcactgcagtctcaaactcctgggctcaagcgatcctcctccttcagcctcctgagtagtttggactacaagaacgtgccaccacacctggtgaatttttaaatttttcttttgtagagacgaggtcgtgctatggtcaccccggctagtttagaactcctggtctcaagtgatcctcccacatcggcctcccaaagtgctgggattataggcatgagccaccatgcccagctgtttctttcctttttaaaacattttttattgagatacaattcacataacataaaattaatcactttaaagtttatacttcagtggctttagtatattcactatgctgtacatgcatcgccacggtgtaattccagaacatttccatttccccaagagaaaccacaaatctgttggcagttattctccacttctccccaccccatgccctaggtatccaccaatctactttctgtcttcgtggatttgcctgttctggacatttcatagaactggaatcacacagcatgtgggcttttgtgtctggcatctttctctccgtagattttcctattctggacatttcatagaaccggaatcacacagcatgtgggcttttgtgtctggcgtctttctctccatggatttgcctgttctggacatttcatagaaccggaatcacacagcatgtgggcttttgtgtctggcatctttctctccgtagatttgcctattctggacatttcataaaactggaatcacacagtatgtgggcttttgtgtcgggcgtctttctcttagcacagtgtttccaggttcatccgcgctgtagcctcattcaacacctcattatctgtgacgctaaataatattcctttattctgtttatccatttacctgttggtggtcatttgtgttgtttccatttttgggctattgtgaatagtgctgttatgaactttttttttttttttttttgagacagagtctcgctctgttgcccaggctggagtgcaacggcatgatcttggctcactgcaacctctgcctcccgggttcacgccattcttctgcatcagcctcctgagtagctgagattataggcgcccaccaccatgtccagctaatttttttgtctttttagttgagatggggtttcaccatgttggccaagctggtctcaaactcctgacctcaagtgatctgcccaccttggcctcccaaaatgctgggattacaggcgtgagccaccgcacctggtcgattactatagttttgtagtaagttttgaaatggagaagtgagtcttctaacattgttcttgtccaagactgctttggttctttctgtgtcccttgcagttccatatgaattttagaatcagcttgtccatttctggaaaaaaaaaaaaagctgttgaaactttgataggtattgcattaaatctgaagatcttaatgttaagttttctagtccacgaatatagaatatctttccattttctttcaacaatgtcttgtagattttttatagcagccttgcactttttaaattaaatttatttctaagtatttcaagactattcttttgatgctgtattttcttaatttgattttcaaattgttcattgccagtagatagaaatgcaactggttttgtatattaatcttgtatcctgcaactttactaaactcacttattagctctaccagtttttgtgcagattctttagggttttgtttggttttgttttgacagggtctcactctgccacccaggctggagtgcagtggcatgatcatggctcactgtggccttaatcttccaggctcaggtgatcctcccacctcagtctcctgagtagctagaactacaggtgtgtgccaccatgcccagctaattttttgtagagatggggttttgccaggttgcctgggctggtcttgaactcctgggctcaagcaatccacccacctcaacctcccaaagtgctggtattaaaggcataagccaccatgcccagtttctttagggtattctttatacaagatcatgtcatctgcaaatggagttttacttctttctctccaatctagatggctttttgttattttttcttgtctagttgcccagcctagaatttctagtacaatgttaagtaagtggcaagagtggccatctttgtcttgttcctaatctcaggggtaaggctttcagttttttaccattaagtatgatattagctgtgggcttttcacagattccctttatcagactgtgcgagttccctcctattcctagtttagtgcatgatttttatcactaaagggtatcctgactttgttaaattttttttttttttttttttttttgagatggagtttcactcttgttgcccaggctggagtgtgtgatctcggctcactgcaacctctgcctccccatttcaagtgattctcctgcctcagcctcttgagtagctgggattacaggcacccgccaccacgccccactaattttttgtatttttagtagagatggggtttcaccatgttggtcacgctggtctcaaacttgtgacctcgggtgatccacccgccttggcctctcaaagtgctgggattacaggcatgaacgaaccaccacaccctgcctgttaaaggtttttgtcaaattcttttgtgcctatttagatgaccttgtggttctgtccctttattctattaatatgatgtattacattgattaggttctgtgttttaaaccaaccttgcattcctgggatagatcctacttggtcatggtgtacaatcctttaacatgttgctgaatttggtttgttagttgtttgttaaggatttttgaatccaaatttataagggatattggtctgtattttttattgtgatgtctttgtcgggcttcacagcataagtcagtaagtgttccctcctcttctgttttttggacacatctgagaagtactggtgttaacccctctttaaacatttggtggaatttgccagtaaagccgtctgatcctaggcttttcttgctagaactttctttctttttttttttaactagtaactccaaattcatcaaatttgggaagatttcagcctttatttcttactaagaatgaggcatttctcttgaatgttttcctcatgttgctacaaacctttttttgtttgcttgcccttttttttttttttttttttttgagatagagtcttgccctgttgcccaggctggagtgcagaggcatgatctcagctcattgcaacctctgcctcctggttcaagcgattctcctacctcagcttcccaagtagctggggttacaggcatgcaccaccatgcctgttttctgtttgtttgttttctttgttttgttttgttttttgtatttttagtagatactggatttcactataaggctggtctcgaactcctgatctcaagtaatccacccgactcggcctcccaaagtgctgggataacaggcatgagccaccatgcctggcctgctgcaagccttttaatgtccagagctatttttaaaaagttgatttttgagttttttcccttttttcattgttttttgtggaggggtgaaatttgtatttcttcatcctccatcttcactgatgtccttccttagctgggtttctgatagggcagacaaaaatgccccaactcctaagacacttatttagttataaggatgatggttttcaaactttagtgaacacaattaactaggggagactattataaatacacattcctaggtcccaccacaaattccaatgagtttgtctgcggcctgggaacctgcattttgaaagcactggattacaagatctaaaagtaatgaacaaattgagaggttgagaggaggagaggttgtctaaatatgttaacttcacattgatttcatacaatagagccaaaagaaactacacagttgagaaatcaagatgtgggttgtatgctttagaattacgaaggcaaccactgtaagaattagaaacaaaaatagttaagacaggccaccttcagggaatggagttggagtaagacagggcaattttaaattttctttatagtttgagctttctttctcaaatacagctgttatctttataataaaacaaacacaaaaatgacaagaaaatcagtaaaaggggactattggccaacaattctgtcttcccttcccagtgcctctgccagtgtactcatccatccaccagcagctatggcccaggggcgtgcagcctggctcctcagaatggcacatggagctgggctcctcccaggagccacattccttcccacctccccccagaggcaggcatgggcaactgaatgcaaacaagatgaagaggaaggacactgtaaactaaacaattgttagcttccagacgcagccacaacctggagtcacagagccctcctggactcagggccaaaagagacctacacaaggtcacatagtgacccagtccttcccagaaccagtagtctttggagcttaaaaacataagcataggccgggcaggatgactcatgcctgtaatcccagcactttgggaggccaaggcaggcagattgcttgagctcaagagttcgagaccagcctggggaacacggtgacaccccgtctctactgaagtacaaaagaaattagccagcgtggcggcgtgtgcctgtagtcccagctactggggaggctgaggcaggagaattgcttgagccagggaggcggaggttgcagtgagccgagatcgtgccactgcactccagcctgggtgacagagtgagactctgtctttaaaaaataaaataaaataaataagcataaatctaaaacactttgcttggaagctggcctcaggcttagcttataccatgaattcatctgccaactgtttcagaggtctgggcagaagggctgcccagcaggaaccagaggtctggaacaaccaagtggggatggctgattctgagggagggatgggcatgtgacagtgtgccctctgaactgtgggggaatgtggctcccccgacccctgggctctggggggctgttttctgggtgaaggtgatccagactgttcaggccaaagccccagtgccagagactcattgtccctcccacggtggagatgttcctctctcaaggtgtcctgcattagcatgggacgttctcctccactccaccgtgcctggaatccatgtgggcaaggatgaggagggaagcagctgttagtgggaagtgaggctgtgggactccagcgttctggacagtcccagcccgaggtgacactactctgatgtgctgagtggctgacttggtagggagttagtgtttggaggttttctcacaattccatgagaatccagggcaggccatgatagtggggaaggctttcacatgacgcagcactggagctggacctgctggctgggcaagcttcagacacaggagggtggtggcatatcctttgctgtaacaggcagaaaatataatgatgtgacatgccccacctgggcccatcttgcctctggccctgcaggccttctgaaaccagctctaggaggcccagggaaccccacaggcaacaccagatttgaccccaccaaggaggccatgacaggtcccagtccacaagatgaacactatgctctttaaaaagaactcctgtcttagttggtgttagttcccagccagtgaagtcacaatgatggtagcaacaggtaccatcacctggcacctgctgagtgccaggcatggttcccagggatgcacacacacaacgctaccccgcagccccagccatccatgtacccctgtggaaaggaaggcacagagacacatcacgggacttgagagtggcagagtcaggatctaggcgggcagtcagctccagtgggggttcacagcccctcgctactctgccgttaccttcatccatgacaatgtgaccagtcatctctgcagctgcaggggccagtaaagtgcgagactcctaattccagtgcatatttgctgaatgagagaatgaaaatgtgtacccacatacctcaggtacctacaacagactgtcattataactgcaagagacagagtgaaattaatagacaccgacatgtcctcagcaattccaacaaaacaaatagtgacaagtacccaagttagtatgacctactagtctccaaatcatagtaactggtggtcaaaatgaagaggcaggacattccacaacagtgtggacgcaccaaaggaatgggcaaaaacacacacctccttcttctcaaaagtatgtgtactggttttctatggctgacatacaaattatcataaatttagcaacttaatacatcctagcactttgggaggccaaggtgggaggatcacttgagcccagcaattcgaggctgcagtgagctatggtcaagccactacactctagtctgggcgacagagtgagatgttgtctctaacaacaacaacaaagcccagttcgggtggtaaaggtggcatttcatagcgatgggatggtgcagggtgatcctggcagggcaggtgatgagagtgtggaggcagagcctgggaaacctccatgtcaatatgatcacagaaacaaggagcgctccatcgcaactggggcaaagtagaaaacgcactgagggactgacctgatgaaggtggagggtgcgaaatgcaatccaaagtaaagaagagatgagggtgcagaaaattatgggcaagaaacaatgctctcaggttctagatttgtggtcttaattgaatcacaatttggagaggcttattttgtttttatttttttgagatagtctcgctctgtcgccttggctagagtgcaatggtgccatctaagctcactgctacctctgcctccctggttcaagcaattctcctgcctcagccccctgagtagctgggattacaggcatgcatcaccacgcccagctaatttttgtatttttaatagagatggggttttactatgttggccaggctggtcttgaactcctgacctcagatgatccacccgccttggcctcccaaagtgctaggattacaggcatgaaccactgtgcctggccggagagtcttaatttataaactttaaaacttcagaacactaaaaaaaaaaattaattaaaaaaaaaaatatatatatccatttgggccacatgtggtggctcatgcctgtaattccagcactttgggaggccaaggcaggagggttgcttgagcccaggagttcgagaccagcgggggcaacatagcaagaccccatctccaccaaaaaaaaatacaaaaattagctgggcgtggtggtgtgcacctgtggtcccagctactctgggggctgaggtgggaagatcatttgagcctgggaggcagatgttgcagtgagctgtgatcgctcaacctgtcccccccacaacaaaaattttgagaatctgtctcaaaaaaaaaaaaaatttgttttgttgaaccatggtctagagaattattaatagtaaagaaaatagaagtaaaaacttatttttaataattgctcatttttgttttctaaatataactcttttatttattttatactattcatttatttatttttgagacagggtctcactctgtcacccaggctggaatgcagtggtgggatcacagctcattgcacccttgacctcctgggctcaatcgatccttctgcctcagcctcctgagtggctgggactacaggcatatgccatcacacccggctaatttttttgttttgttttttgagacagagttttgctctttttgcccaggctggagtgccatggcatgatttcggctcactgcaacctccgcctcccgggttcaagccattctactgcctcagcctccagagtagctgggattacaggcatgtgccaccacacccagctaattttgtatttttagtagagatggggtttctccatgttggtcaggctagtcttgaactcccaacctcaggtgatccgcccgcctcggcctcccaaagtgctgggattacaggcgtgagccaccacgcctggccaacacccagctaattaaaaaagaaaatttgggggatgggcacggtggctcacgcctgtaatcccagcactttgggaggccgaggcgggtggattacttgaggtcaggagttcaggaccagcctgaccaatatggtgaaaccccgcttctactaaaaatacaaaaattcgctaggcatgggggcacgcacctgtagtcctagctacttgggaggctgagacaggagaactgcttgaactggggaggtggaggttgcagtgagctgagatcgtgccactgcactccagcctgggcaacagggcgagcgagactgtctcaaaaaaaaaaaaaattttttttttgtacagatggagtctcacgaggttgcccaggctggtctcaaactcctggccacaagcaatacctcccaccttggtctcccaaagtgctgggattacaggcgtgagccaccttgcccagccaaataaactcttctaaagattgttcccaggacaagtttagggcaaatgttccacaaactactacatgtaagcacatgtgtgattacgactgaactttcacctgatttgtgaggccccaaagtagcctcagaaggaaagagccaggcccctcaaactgcggggaggtgagtattccacgctcacctgggccagctcctcctcctgcagctcaagggctcagcctggtggggtgctgttccccagggcgctaaggaggagccagtttctgtctcacatgggttgatggccatgcagcttgatttcctctctgagtcaaaggaatcttgtcagggccaggcccgcagctgccctcctgtcttggaaaactaagaactgcaccccacccctgcaagtctgtccatagccccggcaatgccacgtgctgccttccttttctgcatactggtcttggccacctgccatcaccatgtggccccagtcaccttccatcaccatgtggcttctcctatgccctggtccttgcccctgaggcatttaagcacatctccacacccgctcaacactgcagtgcagccattgctgtgtgcttctgatctcggtgagttcgcatgctcaagaagtctttggcacagagtttacgacctcaggctctccagttcaatgggcctaggttcatcccagacctgttctatttactagctaagtgcagttgtcttaacctcagtgagctcatctagttatatacagaatggtgatggcaatacctaccttataacattggactgatccacccaacaagcataccttgggcaccttccagtgttctctgtgtgggggtacagctgaactgccacagggtgacaaaggaactagagctggggttgggggtgggggctgctggggctggcccaggcaggaccttcagtgcctggctaggagccttggactctgtcctcagagcagtgggaacccaccggagggcttccgttgcagggtgggaagggtgatggggtatgccagactcatccaaacaaagccacagtctttggggagggggcagcaactggaggcagggggactgcacaggcagctatttgcaaggattctgcaggcaaaagtagtgtggggggaaattggggatgaacttgaaacttaggtgatgggtggggatgtaaattcattcaacctttatggaaaacactaggaagatttctcaaagaactgaaaatagaactaccattcgatctggcaatcccgttgctgggtatctaaaggaaaagaaatcattacgtcaaaaagacacctgtatttgtatgtttactgcagcactattcacaatagcaaagacaaagaatcagcttgagtgtccatggatggaagaatgaagaaagaaaacatggtatatatacacaatggaatactatttggacataaaaaagaataaaatcatatcttttgcagcagcatggatgaaactggaggccattatcttaagtgaaacaagctggacacagaaagacaaataccacaggttctcacttgtaagtgggagctaaataacatgtacataaggacttagagtgtgaaatgatagacaatggagactttgaagggtgaggggtgggagagaggtggctggtgagaagttacttaatgggtacagatatttgggtgttggataccctaaaagtccacacttcaccaatatacaatctatggatgtaacaaaactgcacctataccccataaattcatacaaataaaaaagaaatttaggtgataagagctatgggccttggttaccagttctgtgcatgtgcatgagtgtgtgacttgtggcatcacacggtgtcagggagccgatcggggcactgggagaggtgataaactagaatttggaaatgctgaattcgaggtgcctgtgaggtagcaagtgaggaagtccagtaggcagtgggctagacatctggaatttaggagagatcttaatggaagaaaaagatttgggaattagggttttcggggggtaattggcagagaattgagggaggagatggtgtggggtatcttcttttttttttaaatagagtcttgctctgttgcccaggctggagtgcagtggcacaatcttggctcactgtaacctctgcctcccaggttcaagcaattctctgcctcagcctcctgagtagctgagattacaggctactcgggattacaggcctggctaattttttgtatttttagtagagatggagtttcgccatcttggccaggctggtcttgaactcctgacctcataatctacccgcctcagcctcccaaagtgctgggattacaggcatgagccactgcacccggcccatatcttaattttttttttttttttttttgagacggagtctcactctgtcacccaggctggagtgcagtggcgcgatcttggctcactgcaagctctgcctcctggtttcatgccattctcctgcctcagcctcccgagtagctgggactacaggcacccaccaccatgcctgcctaattttgtgtatttttagtagagactgggtttcaccatgttagccaggatggtcttgatctcctgaccttgtgattcacccgtcttggcctcccaaagtgttgggattacaggcatgagccactgcgcccagccccatttccattcttgtttccaaaggactgtatcggctgtactatcacccctgtagggacactccctcaaacaccaaggactccttggtataacagctgcactttcagtatctgctgatcaagaaaatatataatgacaaaagtgcattataaggtcagcaatgtaggtattattttataatttttttttttttttaaagacagggtcttgtcatgtccaagctgatctcaaactcctgggctcaagtgatctgcctgcgttggcctcccaaagtgctgggattacaggcatgagccactatgccaggccaagctcagcaatatcttaagtgagtccgtattttattttttaatttttttaaatttattttatttatttaatttttgagatggagtctcgctctgtctcccaggctggagtgcagtggcgcgatctcggctcactgcaagctccacctcctgggttcacaccattctcctgcctcagcctccggagtagctgggactacaggagcccgccaccacgcccggctaattttttgtatttttagtagagacgaggtttcactgtgttagccaggatggtctcgatttcctgaccttgtgatccgcctgcctcggcctcccaaagtgctgggattataggcgtgagccaccgcacccagctgagtctgtattttattaactgcaatggcatctatatatatttggaaaatacagtactgtgtccacatgctctgtggaagctctgttatactaatttaatgataaatgcaaattactgagctatctcatctcaggaggtataaattactttctctaattgctaccttcaatgaatctctgtcaaatttcccatatttcccttaacaatactttgggcagatcccgtaagttcccaagcagttattcaaagtccagctagttcaatctcaaatacagggtaagcctttgcccactcccatcaccatgtgggtttatggcttaggactctttaagagaacaggtgggatgtgctgcctctgaattcccaccactctccttagggtctcccttctctgatgtcaggtcatggagaatgaattagggaaaacggcaaaagtctttccacgtacagggtacactggccgtatttttctcaggctaacactaatttaatttttttttaaattgaggtatactttacttacaacaaagttcaccaattttaagcacacaattcaatttttgacaaataactaccacaattatgatacaaaatattttcactgccgagcccactttgtgctccatgcagtcaatcctttcccccaacacctagcccctaagtactcatctgctttctctcaccacagtgttgcctttctagaatttcacagtatgcagcccttggtgtctggcttctcctgctgagcctgacaaatgtgagactccttcttgctgtgtgcagcagcagtctgttcctttattctgccaagtgttattccactgtatggatctacctgttccactttttgtttgtttgtttgagacggagtctcgctctgtcacccaggctggagtacagtggtgcaatcttggctcactgcaacctctgtctcctcggttcaagcgattctcttgcctcagcctcctgagtatcttggattacaggcatgcaccaccatgcccggctaatttttgtatttttagtagagacgggtttcaccatgttggtcaggctggtctcgaactcctgacctcaggtgatctgcccgccttggcctcccaaagtgctgggattacaggcatgagccactgtgcccggcctccactttttgactattattcataatgcttctatgaacattttgctataggtaagtcttgtggtgacatgtttctatgtctctgggctaagtacctagcagtaggattgctgagctgaatggttaagcggttacaacttcatgagaaattaccaaaatgttttccaaattggcctaatcattttgcattcattcctacctgctatatgtgagaattctagttgctccacatcttcatcaacacttgctactgttagtctttttaatttgggtcattcaagtggacatgtactggtttagtgatgtctcactggtggttttgtgtttctctaacaacagatgatggccaagcatccttcaggtacttatgtgtcatctgtattgtatttcttctttggtgaaatattattttgtttgtaaatcaatcaatcaatctacctatctgtctatctatctatctatctactgagacagggtctcactttgtcactcagctggagtgcagtggtgcaatcacagctcactgcaacctttacctcctggactcaggcgactctcccacttcagcctcctgagcagctgggactacaggcatgcaccaccacacctggctaacttgtttttttttttgtagagatggggttttgccatgttacccaagctggtctcaaactcctgggctcaagcgatctgcccacctcggcctcccaaaatgctaagatactgcattcagcctgtttgcaattttcttatagagccaaatgagttctttatgtattctgagtagaaatactttatgagatatgtgtttagatattctcctagtctgtagcttgtctttcattgtctaaatgaggtcttattaaaaattaattttctctgggtttattgaagtataatttacatttaataacactcaccctttttaggcagagttctgcgaattctaccactacaatcaagatatagaattttcccatcaccctcccaaaatttccctataccctcttctagtcaatcccctcccctcaaatgcaacccctggcaaccaaccactggtctaatagtgtcttttgaagtggtcaaagtttaaaatttgatgcagtatgattaatcaatttttaaaattatgtgtcttagtctgtttgtgctgctataacaaaatacctgaaactggataatttgtaaacagcaaattcatcacttacagttatagaggctgggaagtccaagatcaaggcacctgcaggtttggtgtccagtgatggctcgctctctgcttccaagatggtgccttgttgtgtcctcttgaggaaatgaacactgtgtactcacggtgaaagagatggaaaggcataaaagggctagctggttcctttgggcccttttataagggcactaatctattcatgaagttggagtcctcatgatctaatccctccctaaagtgttaaaatcaggtaacttaagttctccaactagctgtttttgatctctgtgaggccagtctgtacactaaccttttttttttttttttttttttttgagacggagtctcgctctgtcacccaggctggagtgcagtggtgtgatctcggctcactgcaacctctgcctcctgggttcaagcaattctcctgcctcagcctcctgagtagatgggattacaggcaagtgccaccacgcctggctaatttttgtatttttagtagagacggggttctaccatgttggtcaggctggtctcgaactcctgacctcgtaatctgcccgccttggcctcctgaagtgttgggattacaggcatgagccaccgcgcccagccccactgaccttctttcatggggagttcatgtaagtttttccaaaggctctgcagggtatcttcagtatagagtgttctgatatgggaaacgagctctagctcaacctccttcactcccaactccaactagctttgccatcagtgttactccctattgctgtttgctccacagcctcttgcctagtggatgtggtctggcattggacagcacaagcaatgacagggaagccccctgaagacccttgcccagaggtctctgagttttctagatttcttcaaagccaggtataaaggcagtctagcaagctcacactgtccaagcagacatccaatcagggaagatgccagcctctcttttttaggcatctgaagtcattatggtaactctctttgagctacaccctgttggctttagtaatagcaccgcaccctccctatttctgcacccaggaagctgcttagggaaactcttacccttcctcccgccccatccctcccccgttgtccagttatgtaagcctgagggtagggtggtggtggttcagaatggcagggctggctcttcagccctctaacaataagctctgggtgctgccatgttgtgctgcctttacagtgtgggatactgaatgcctctgggtactcacctttgtgccctgactcactaattccagggtaacaggaaaaggctcattaaacgtcccgttacacacagctctaataaaaacagcaataataacatcaaaacactcacatagtgcttgccaggcaccagtctctttctctacttatgttaactcatttcctcttcacaacaacccaccccattaagcaggatcagtaacccctttgcacagctgaggaaactgagacatagaggaggtaaactgcccaaggtcacagggacagagagccagagagctgcaatccaatcgagggagtttggctggagtccacgctgcgctgctttccacataggagaggcagagaaaagctgcacctgcaagagcgatggtttcggctgcgtatttggaataacgaagtcagcggtcaggagcaaggagaaggcacacatctcgggcctcatttctgtccccgagcgctcccccacactgcgagatcatggcggtggaggggagtcccgcatcctgacccccggccgccgcgcactggggggccctcaacctctgggttacttgggggcacgcagtagccacccacggggcagaaaagacgggggcggtcaactttctccactccagccgcctggggtcccgccatccctcagccaggacgcttggcagccgcctctaggctaggtggccacgagttgcgtgcgagagcgagggctgcgcatgtgcgaggcgtgcgtggtgcgtgtgtggcgccgcgggcttccgctccgacgtggggatcactagacagcaactgccccccaagttctcgtatcagctgcgggaaggagagaatggttctagtcaaccgagagtggaaggagaccaaatttcagcaaatgcacggacttgagtcctcatgagcagggtggccatggtgcggaagcagctggcacggccccctcaaccccggacccctggggtcctcactgccgacccgcgcattcagtgctgcgcataaataagatttccaattagaaggcctaggtcccagctctgccccacagcgtggctttgggccaggcacgtcatagccctggaactctttcttcccattgttgagatgaagagggtgcacgatatgttcgacgcagcaaggttaaatggaaggaaacggggcggccgcttaatgactggttgcacgcgcttgcgttgggtgctgcagcctggtgccaggaaggtggggcagggaccttgtggtgtaaggagtggcggtgaaagtgcctggggtcagagaggagaggcaggggatgagttctgagtgggaggagggggcagctcaggtttcgtcaagtagatgacctctgaaccagaacttgaaggataagacgggagatggccgagacgagagatggccctaggagcatcctggcacagcaggtgcctgaaagcctgcatagggcatagatgtgtctagagagttctgggaatgatcgctagagcggtgttgggctcgtagggaggcaagaggtgggcttggagcgggaggtgggaaaggcatggggagtgtcttgaaagcccccttcatctgcaggtcctgaaacgctgcagagggtctttaggcgtggaatttacataagatgtgtgtttcagtaaagtgacttacaggaaccagacaggaattgtaattatacaaaggggatttcggaggaaggaagttagtctcagtccagggaataatgagggcctgagctcaggagtgcagtggggagggagaaagaaggattccagagagattttgggcagagtaattgacaggctcccgattagagcagaaactaagatgatgcctaggtttggaaaactgggtgaattgaatcattaagacactgaagtgtccaccaagtgcagaccttgtgccaggcactcagcatccaaagatcaaaaaagacctagtctctgccctcaggtgcttctacttgaatagggcaggtggacacataactaggtaattgtatctataccctgtgatgttgaggattacagctgtccctgcctgacctggacctaggggtgagggcaggggggcttcctagagaagtgggacctgagcttggcagaaatgggagttcacaggcagtgtgagatgggtcccctaggtacagtaggaacgcaagcaggaaggccagggagtttgtgatgtgtttggagaactagaagcagatgctggagtgtaaaaccggagcttgacttttattctctagagggtggggagccattgcagagccttaggcagagaagggcctggtcagatttgggtttagggcagcttgccctggtgcctcgtggagaacggttgtaaaggcgagaagctaggagcgagaggtggctgtaggaagtgctggtgaaagagagtggaagctggagctgacacagggagttcaggaaggagagtgggctgggggatggtggggtggggaagtgcaggatgaggagggagggctgaggtgaggtcagtgctgcacaccaggtgcatgaggcctggggagcatctccatggaggtacctaatggcaatttactagccaagtcatcttgaccagttcacttagccttggcgatttgcctcatattgcagaatgtggatgacaagacctacctcataatgttggagtgattcactcaacgagtatttactgagtatctgttggtgttctgggtgccagggattcagctggatggcctcagcagaaaatacacaggaaatatgggttgagctaaaaatcaagggcccaattagaacagatttgactatcatccatattaacactcccagaaaagagggagatgagcagagagagagagagagagacttttccagttgcaaggcaagagtaggctgcagggtcaccttgtgctggctggcaggagccaggggctggcatgtatcctgtttggccaaaccatcattaagtggcagttcgagaataggccctctaagctcttgcactggtgtcataacatctggggatttcctgtgtgtcagtgtttgtgtggatagagggagctggtggtaagtgttcagccaggtgcatccaagatcccagggtctcatgggaggacccagggctggaactggcctcctcataccgctgtacagctctgcctggagcctggagcctcctcctctgctgagtggtgctctcagcacaaaatgagtgttatcaaaggggcatatattctgcactcactagctgcacaagagaagaacagcggttgttggtatgccttataactactcttcagaatacacacccctttgacaacattcactttgttctcaaccataaacaaccacaccccttgtttatggttgagaagatgaaggcctggtggaattagcttcttgccagagactacactgtggccagaaggactctgccttttccttggctatctgagcttcatctcagaggtgtttaattgctccagccagatccatgtgaatagcaaattaagcccacacagtggctcatgcctgtaatcccagcactttgggaggccgaggtaggcggatcacttgaggtcaggagtttgagactagcctggccaatatatgaaaccctgtctctactaaaaacacaaaaaaattagccaggtgtggtggcacacgccagtagtcccagctactgaagcggaagctacatcgagttgagatcgtgccactgcactccagcctaggtcacagagcgagactccatcttaataaataaatagcaaattaatgttttaagtgaagtaacaataacggtttactctgatttaatttacaaataaacatggagtttttgtttataaattttcaccaaatttaaaatcttcaaaggctaattaaaatagttaatatttattgagtgcttcatatgtattttctcatttgattttcacaacatccccatgagttagatatgattatcattgccattttactgaaagtaaggttggagcaaggtggagtaggatggagtaaggatgaggttaagggtggagtaaggttggtatacggtggctaaagttggggtaaggtaaaataaggttagggtaaggtgggataaggttgaggtaaggcggagtaaggttggggtaaggtgggctaagatgaagtaaggtttggcaaagttggggtaaggttggagtaagatgagtaagggggtaaggttggagtaagcttggggtaaagtgggggtaagcttggggtaaggttggagtaaggttggggtaaagttggagtaaggatggggtaaggtggggtaaggctgggataagatagagcaaggttggggtaaagtggggtaatgtggggtaaggctgggataagatagagaaaggttggggtaaagttggagtaaggatggggtaaggtggggtaaggctgggataagatagagcaaggttggggtaaagtggggtaagcttggggtaaggttggagtaaggttggggtaaagttggagtaaggatggggtaaggtggggtaaggctgggataagatagagcaaggttggggtaaagtggggtaatgtggggtaaggctgggataagatagagaaaggttggggtaaagttggagtaaggatggggtaaggtggggtaaggctgggataagatagagcaaggttggggtaaagtggggtaaggtgggataatgctgggataagatagaacaaggttggggtaaagtggggtaaggttggggtagggtggcctacagttggagtaaggtgaggtaaagttagggtaaggctggggtaaggtggagggtaacttttcagatgtgatactgtttttgcacgccttatctttcccttcttgctgctcagttaggagcagcttttctcctcaatttaactgaagtgagcatttgctggagaagttgagggaacacgcacattgtgcagccctgtttgtctgagctgaggcttgtgtttgtcctaggaagggccatttgggagctgtttgagatggcatctcacagcgagcagaggagggcacagtcagggtggtgattggggtgaaaactctgctcatgaagaatgatttggtatgtgcacagatgatagcttttctaaatcctattttgtttttctgaaaaataagtgacagtaacctgaacacctttgagtttctccaatgctggcttagtctgaggctggggcctgcctgccatccctttccctctctcactgagtggctgctgcttgcccgtctctgacctttgagagtctcaggtctgatggtggtggagatggagcacaggtgactgattcgggggactcggagacacaccccttggaggagggacagggagggttggaggtagctggtttcatgtgggcagaacacaggacatagacatcctctgtcaacgttggtcttctctgtagtattttgtgcagggtcctggtcagtaaatctggccaagtgagtcatctgaaagcagtcatgtgatctgtgttgataagtggataaagcattggctttcatcactctctggatttgttagtgaactttaaaaaagaaacctttcttgtgcttttaaataatgactgtgttttttaatcttaccatttaaatctagttttcctgaagatgcctgtgtgcctttggccaacaggatctttgtccgaggtgacaatgaagatagtataccatgagcccatactgcctgcagagtcgtggctgccaaaattaacagctgtggaattatttgtgaccctgttaaggataaacatatttgtcccttttcattttatgatcagcaactgctaaagttcttacttgtaattgcaatttactgccctcactgtattgcttagtttagaggtggacacagaaagaatggaacatttgttttcttttgggtctgagctatgaatttgggccgcattatcatgcaggccttggcccctctgtctctgcaagattgggctttcctgtttttgtcattctcagcttacttcgcaggcatgctttgtgtagaggagaaaaataccctccaaagaacctcccaaggaggttaccaggtacacggttcagccaagtgggtgactcaatgggatgcatctctttgtgtttgtcagggccgggaagggtgtgacagcatgtggggagagactcagttcccagccaaataactttaccacctgagctatgaggcagttcctgcacatcaccactccagcagggtccagccttgctgcggcagaaagcgagtgtgtgggaaagcaaatggctccacacgacgcttgcagtgttcagagggatgagtatgaattgtgtgtatctcagggacccctttgacccatgaatacatgtatagagtattctctattatgtgggtgaagtgtatctacttacatacttaagtatttgtgagtaaaacgagaaaaaaaaaagatgtgaaggatggatagagaaaataaaacagcaggaggctggtagttcctgaggctggatgctgggcacatgggcatccattctactcttctctctatacttctgtgtatatttgaacattttcaaaataagaggttttattttgttttttgattttttttttagatggagtctcactctgtcgccaggctggagtgcagtggtatgatataggcttactgcaacctccgcctgctgggttcaagcaattctcctgcctcagcctcccaagtagctgggactacaggtgcgtgccatcatgcccaactaattttttttgtatttttagtagagacggggtgtcaccgtgttggccaggatggtctccatctcttgaccttgtgatccacccgccttggcctcccaaagtgctgggattacaggcgtgagccaccgcacctggccttttctctttctttctttttttttgagatggagtctcactctgtagcccaagctggagtgcagtggtgcgatcttggctcactgcaacctctgcctgtggggctcaagcgattttcgtgcctcagcctcctgagtagctgggactacaggtatgcgccaccacacccagctaattttttgtattttagtagagatggggtatcaccatgttgcccagggtggtctcgaactcctgagctcaggcaatccacctgccttggcctcccaaagtgctgggattataggtgtgagccactgtgcccagacagaatcaaaggattctttttttaagtatgtacagtatttgtcttagtctattgtgctgctgtaacaagatacttgagacagggtagtttataaacaacagatatttatttcttacagttctggaggctgggaagtctgagaccaaggcaccagcattcagtgtctggtgagggccttcttgctgtgtccccatggggcagaaggcagaagggcagaagggcagaaggcagaagggcaaaacctgcctcgctggttccttcaagccgttttacaaggtcactgatcctgtttatcagggctccccctgcagaacttaatcacctcctaaaggccttgtatcttaatgctgtcacattggcagttaagtttcaacacatgaattttgggggcatccaggccatgacagttttcaaacatttttctgcatatgtaggacccatcaaacgctgtactcctgctctggtgcacacactgagctgggcatctgggttcaacaatgcttcactttcctggcacgcagagctgaggggcagggacagagatgaaatctctgaggcacagtgatggtatcatggaaaccttgaactgaggggagggtcggagttggtttcactgaggaatcgaggactgagctgagaaccgaaggatgactgggaacctcctgggtgctgtgggactgggactgggggcgagggagagggagtctcagatggtgggaatcccctgtgtagtggccctggggcctgatggtggccagaggatggagcccagagggaggggaggatggtgaggcaggggtggaaggtaaggggtgttccaggcccggttaggggattggccttggtattcgtgccatggacagccattgaggcgtctaagcagggagtagccacagatcaggctcctgttttccagccaccgtttatttgtggcttggaggatggatggcacaggcaggcactggcatccaggtgagagatgacagctccccagactgaggctgttgggggtgtgtggtggcaggagtgggagcagaggtgtgtttgagagagatggaggatgtagtggcggtctaggcatgggtcatggggaggaggggtgagcataaacggtgatggagccattgcagagatagaacgccagaacaggacctgatgtggaagggaagaccaagccttgtgtctgacttgggtggatctggagggagattttgcaaagcaacttggtcatgtagacttggggctcagaggaggcccctgggaaatgagtctgagggactcctccgcatgcagacactactgagagtgtggaggagttgcttagggagaggtatgagccaagggaccacatgaggtggctccagcagactgttgagccccagctcgggtctttttaaaattaaacaagccacacttaggtgtgcttgttgtaaagatgtgaagccatagctactatatacagatgcagacacttgcagacacttttctagacagcacagctacacgtatgtacatatgcatatatattattttccgttttatgtaaatgggatcataccatcatcccagcaactcatttttttgaaggtttgttttctgattataaatgtcatgcaaaggtataatgggagtcctctcctaaaatcccattctccagagataacatcattgttaacatagtccttaaacgttttcttctatacctatatagtattttattatatggatgaatcattatttataattattcctctgtggaagaacatttaggtgcctgtaagttttcttctgttaaaatatagccctacagtgaacattcttgagtgtgtgtattcacttgtgtgcatttgtgagtagttttgcaggctgggctcctccaagtggaattgctaggctaaagggcatgtaccttttagaggtttttgtttgtttgtttgtttgtttgttttttgagatggagtcttgctgtgtcacccaagctggagtgcagtggcgcgatctcagctcactgcaacctccgcctcccgagttcaaacaattctcctgcctcagcctcccaagtagctgggattacaggcatgcgccaacaagcccaggtgattttgtagttttagtagagacagggtttcaccatgttggtcaggctggtcttgaactcctcctgacctgtagtgacccacccgccttggcctcccaaaatgttgggattacaggcatgagccaccacgcctgcccaaccttttagagttttaacagatgttgctccgtggcctgagaatgcctgtttccccacactttctccagcactagatttaacctaatctgttgggtgaaaaaggttgtcttattgatgccttaatttacattctatccatgacttgcaactttaagcatcttttaaaatgtttattggttacaggcaatcttcatgagaacattgtatcctctgtctgtttttcttttgggtttcctttatttttccttaatggagttgaaacagttctttgcaggatctggcagttgattgacagcttcttaattctaagaatgcccccaacttaaaagcagccctggagggtccccttcttccgtgtcacccccagtgtcttgtgtgagttgtcaccgggccccacttgttttcctctgaagcattctgacagctctgctcgtggcccctgcgtttaagagacatgctgggccgggcgcagtggctcacgcctgtaatcccagcactctgggaggccgagatgggtggatcacgaggtcaggagatcgagaccatcctgcctagcatggtgaaaccccatctctactaaaaatacaaaaaattggccgggcatggtggcaggcgcctgtagtcccagctcgggaggctgaggcaggagaatggtgtgaacctgggagatggaggttgcagtgagccgagactgcgccactgcactccagcctgggtgacagagagagactccgtctcaaaaaaaaaaaaaaagagacatgctgcaggccaggcatggtggctcatgcctgtagtcccaacactttgggaggccaaggcgggcggatcacttgaagtcgggagtttgagaccaccctggcaaacatggggaaaccccgtccctaccaaaaatacaaaacagctgggcgtggtgcctgtaatcccagttaactcggtaggctgaggcaggagaattgcttgaacgcaagaggtggaggttgcagtgagtcaagatcatgtcactgcactccagcctggacaagagtgagattctgtctcaaaaaaaaaaaaaaaaagagagagagagagaaacatgctgctgcagagcacccctgcagtgttcccgaggtgtgaggtgacagagccctagtctctgattctgtgacagcttcagagggtgacactctgtgtcgggcccaaaagggctcccctgggctgtcagtgatgagcttctctggtcacctttggggggtgccgtaacctcacctctgttcagtttctcagatggccagtcagggaaaagagtggccatcaacatatcatgaaaatgttctatttgaaaatgcagagtacagttcctggggacacggggatctcccagtgctcggtgcttcaagaccctgggcagttcatattagacaatgtcacaggaaggtgtgagtcattctgggcggttgctagtgtgccgtgcctgtgggcttggtgctggggaggccaggcaggcttggtggtggggaggccaggcgtgggagtgatgctcctgactatgccttctctcccagtcactcctttctgggttttgttaggggagggggtgtctagggcccaggccatcaccagaagcttggccccctgctcttgcttctgccaaacactccacagttcagctggaagcgccctcagggttgtccaagctgcctgcagttggttgtgcctccgactggctctggccccgcctcccagcctccgtagctggttcctgagccctactcctggggccgccagcctctcctacttccctcctctctctctgcttgctttgcagcagctttactgagatatgattcacataccctacaattcacccctcggaagaagagttcttagtagagttttccatcatttttagtctgttcacagagttgtgtaaccatcaccatccagtttagaatatttgcatggccccaaaagaagcccagtactcatgaatcagtcactcccatttccccctcacctacctcctctctcagcctctcccagcctctcacaaccaccagtctactttctgtccctatggatttgccctttctggacatttcatgtaagtggaatcagatggtatgtggccacttgtgtttagagtggtgagcagagcccaggctgcggcagacatccagaccaaggcggtctgggccaggtgacagcctggctagggtttggcgaggtcagttcctcctgcctccgtggggcccatgagccgcagtccccagggatgcatccggagggcatcagaggcaggacgccgagcaagctgatacccaaggagtcacagccaccctgggagcttaaagggccgatgcagggattgggaggccgtggtctgggtcagttgggaactgggggtgatcagggatggccactcatagaacctctggatcctgtaatctagagagacacggaacatgagctcccctgttggtgtctctcctgaacccattccctcaatatagacacgcttctcctttgatgttgtagacagtctgagatatattctactaattttaccagttaggctttccgtgaattgatgccttgttaaagttctctagagggttttgacattcattttcattcattcacatcttagggtgaattattttaatctaggtactttcttcctaacagaagaatcaagttaatgaaactggaagtccctagtctccttagatttcataattggcctcacaatgtcacaagaaccctgatcctggcactcgtcctatcaggtgctgtgcaagggaagcgctgtgagtgacagagcaaagccaggcatctttcagtcaaggattttctctccagttgtgtgcaagataagaagtgactgactctgtgtagccaggaggctgaggcaggaggatggcttgaggccagcggtttgggaccagcctaggcaacatagtaagactcggtctctacaaaaaatttaaaaaatatccgggtgtggtggtgcgtgcctggggtcccagctgctgggaatgctgaagcaggaggggattgcttgagcccaggagttcgaggctgcagtgagccatgattgcaccactgcactccaatctgtgtgacagatgagaccctgtctcttaaaaaaaaaaaaaaaccaaaaccaaaaacaaaaaaccacctctctagattatgttgctcctctgctccacaccatgctgtggcttctgttcacagtcaaaggtcccaaagtggccatggcctgtgctgcctgctgccgctctccacaccctggccgctcggtccccaggagaccaggcatgctcctgccacagggcctttgcactgggtgctctctgggtctggaacaggccccacacccactcacttcccccaagtctgctcagatgccacttccacacttcctaacaaaaggaagctgttggtgagcagatgctcagtaacttatgtgtggccagaaggagcgagtggctccagcctgcgcgtggaaagctggctctcctgggtcactgctctcactgagcctcgggtttctgctgcccagaggactgcgtggctctttcttgtacctggcagttctgacactgctggaattgggaagaaaagggaccctgagactaggtcactccctcctggggtctcaaggggccctgtccctggggctggaggctgagcttcctcctccttgtccccaccctggggatggcctgtgttctgtcttccttgtgctcaccactggcgcctgttggctgaggcaagagggcctccagctgggttcttcctgtcctctagttggtgcctgaaggccccagttgggtggggtctctctttaccctctggtcatatagcaaactgtggctggtgtgtggtgagtcagccctgtgtgcaggcagggtcccatttccctgtgtgcaggccacagtctgtcccagtgcctgcaaggcctctgccccagctggcctggaccccccttgccagactctgctctttgtggggctctgcccacatctactgcccagtaggacgcccagtctccactgctctttggaggtaaaagagggcctggcacactggcacggggtactttcccaaaggtcaaagatgtgttgagtgaacgaaggtagagagttcatttctgagacctttgctggcctaattcagctcagtggggtgaagttattactgttgagatgcttgctgttttgattgtctttagagagcattcttaatatttggatggtttaaaataccaaggagaaaaaagggaggagaggcttcttttttaaaaataccaacttcattatgaaaacacacaaatgtacacacaaatagaataatataatgacacccctcccaccaccacacggcctgtttcagtctgtgtccacagcgaggcttctgaaggaaaggctgtggagggggtgagctggtggagcccatgttctcccgggcctggccgggatgtgcttgccgctgtcacagctcccccatctccacccgtcacatgacatcgaatgaggccggcctggctctagccactgcacaggtgtcccgtggtcatttccttcctgtgctgctgaggcacacagtcacccgtttgcaaactctgaggtgttttcccttttcccatttcctgtcactgttttgaagctgtgagaggaagagagagacctcgatctgataaccattcatttactatcaaagttggggtcacatccttataagaacgtgtggcttgaggtcatgaatagcagtaatgcgagggaagctaagattctggcaggatgcaaatgatctgggagttttcattttgtcgttatgtatgggctgttttctgctgcattgttaactattggaaaagattttccatggattattatatggattatagaggaaaatgcaaatctccaacctctatacatttaatcacttaaatgaaatgtcaagttttcttgttaagaattatggtgctgactggaagaacaacatggctttaaatatgacttattagtttctttccacttctaaagttcaaaataaaacatcataggtggcaaaacaaatcaaggtaaaatacgttttgaaaagtcataactttactcaacaacaaaaaataagaaatagacagaggacttgaatagacatttctccaaagaagacatacaagtggccaagaagtacatgaaaagatgcccaacatcactggttattagggaaatgcaaatcacaggcattaggatggctattatcaaaaaaagccaagcaaaaccaacaacagaaaataaaagcattggcaaggatgtaaagaacgtgaagatgtggagaaattgaacgttggtttactgttggtgggaatgtaaaatggtgctgccaccgtggaaaagtttggtatttcctcaaaaagtgaatcagaggccaggcgcggtggctcacgcctgtaatcccagcactttgggaggccgaggtgggcagatcacgaggtccggagatcaagaccatcctggctaacacggtgaaaccccatttctactaaaaataaaaaaattagctgggcgtggtggtgggcgcctgtagtcccagctactcgggaggctgaggcaggagaatggcgtgaacccgggaggtggagtttgcagtgagccgagatagcgccactgcagtccagcctgggctaaagagcaagactccgtctcaaaaaaaaaaaaaaaaaaagtgaatcagaattaccgtgtggtctaggaattccacgcccagaataggcatgcactgaaaagaattgaaagcagggactcaagacacttgtgcatcgatgttcacagcagcatcattcacgctagctaaaaggtagaaacaattcaaacatgcaccgacagataaatggataagcaatgtggtctacagacatggacaatggaatattatccagccttaaagaaggaactctggccggtcacggtggctcatgtgtgtaatcccagcactttgggaggccgaggcgggtggatcacgaggtcaggagttcaagaccagcctggccaagatggtgaaaccctgtctctactaaaaatacaaaaattagctgggtgtggtggcaggtgcctgtaatcccagctactcaggaggctgaggcagagaattgcttgaacccaggaggcagaggttgcagcaagccaagatcatgctactgcactccagcctgggtgacagagcaagattctgtctcaaaaaaaaaaaaagaagaaggaattctgacacatgttactacatggatgaatgttgaagccatgcccggtgaaataagccagtcacaaaaagacaaatattgtctgatttcacttatatgaggtatctcttatataaggtaatcaaattcatagagacagaaattagaatagtggttaccagagggtggggaagcagggaatgggaagttattattgaattagtatagacttacagtttgggatgacaacaaagttctggagatggatgatactgatggttgtacaacattgtgaatgtgcttactgccacagaactgtacaattaaaatgattaaaatgatccttttggccaggcgcggtggctcatgcctgtaatcccagaactttaggaggccgaggcagatggatcgcgaggtcaagagatcaagaccagcctggccaacatggtgaaccccatctctactaaacatacaaaaattagctgggcatggtggcacgtgcctgtaatccccgctactcgggggctgaggcaggaaaatcgcttgaaccagggagtcggaggttgcggtgagccgagatggcaccactgcactccagcctggtgacagagtgagactccgtctcaaaaaaaaggatccttttgtgctgtgtatattttaccacaattaaaaatgcaggagttagtaaaggaatggaacaagatcatgtgaacgtgagttatgagaatactggaatggcatccggcaaagcagactcagaacaggactgttcctagagatagggaggactgttttatgcggataaagtggtcaagtcatcaagaagacattatgatcctaaatatgtatgcacccaatacagagcaaaaactgacagaaccaagagaacaaatagacaaatgcgcagttatagctagagatttccacacttctctctcagtaaatgacagaacaaggaggcagaaaatcagtttaagaatgcagaatactgcctgggtgcggtggctcacacctgtaatcccagcactttgggaggccaaggtaggcagatcacttgaggtcaggagtttgagatcagcttggccaacatggcaaaaacctgtctctaccaaaaatacaaaaattagcaaggtgtggtggtgcatacctgtaatcccggctacttggtaggctaaagcagaagaattgcttgaacccgggaggtggatgttgtagtaagccgagatcacgccattgcactctagcctgggcgacaagaacaaaactccatcatgacaaaaaaaaaaaaacaacaacaacgacaaaaactagccaattgagttgggcacagtggctcacgactgtaatcccagcactttgggaggccgaggcaggcagatcgcttgagctcaggagatgaagaccagcctgggcaacgtggtgaaaccctgactctacaaaaaatccaaaaaattagccatgtgtggtggtgtacacctgtggtcccagctgcttgggaggctgaggtgggaggatcactgaagcctgggaggtcaaggctgcagtgagcagagatcgcgtcactgcactccagcatgggtgtcagagtgagaccctgtctgaaaaaaaaaaaagtcagttgaatctagcaacaaaaaaaaggataggccatggacaagtagagtttatcccagtaatgcaacatcagcttaacatttaaaaatcaatataatcctccatattaacacaaaaaaagtaggaaaacactatcaataaagagcagaaaactgatggtacaacaagtggatgaatctcacaggacttatgttgaatgaaagaagctggacaaaacagtatgcactgtgattccttttatagaaaactctagaaaggacagatctcatctagaatgatggaacacagatgggtggttccctgggtcctggtgtgaccaggaggagtcatgagggaagcttctggagtgatgggatgttcttggttttgactgtgatgatggttacttacacaggtatacacatttgtctacatgcattgagctgtatacttttatttttttttttgagacagagtctcactctgtcacccaggatggagtgcagtggcacgtcttggctcactgcaagctccgcctcccgggttcacgccattctcctgcctgaggctcccaaatagctgggactacaggcatgggccaccacacccggctaattttgtttttgtatttttagtagagacggggtttcaccatgttagccaggatggtctcgatctcctgacctcatgatctgcccacctcggcctcccaaagtgctgggattacaggcgtgagccaccatgcccggcctaagctgtatacttaagatgtgtgcactctctcgtatgcaagctgtacatcaataatattgatttttaaaaatcctttaactgaggtaaaacactgatgtacagtgtagttattctgcattttctgaaataaccatagtttatatcagaaagaatagggagctacagaagatacagaatagtgcatataagttgctactttttattgataaatttttacatgtttatgtggtacatggagtagttgttacattacacattacagaatatgtaatgatcaactgagagtatctgaggtatccatcaccttgagtgtttctttcttttttcttttttttttttttttgagagggagtcttgctctgtcacccaggctggagtgcagtggcacgatcttggctcaatgcaagctctgcctcccgggttcacgccattctcctgcctcagcctcccgagtagctgggactacaggcgcccgccaccacgcccggctaatttttttttttttttttgtattttttagtagagacggggtttcactgtgttaaccaggatggtgttgatctcctgacctcgtgatctgcctgcctcggcctcccaaagtgctgggattacaggtgtgagccaccgtgcccggccttgagtatttatttctaagtgtttgtaatgaggtaggaggcaggcgagactcaactccggaccagattgaggactggccaaaactaggaagaagtgcacaaaggacctctccataagacatgcccaccagtgccatgacagtttactattgccatagcaacacccaaaacttaccacccattttctagctgtttctgaataacctgccccttaattagcatggcactaaaagtgggtataagatatgactgcaaaactgcccctaggctgcgaccctcagcacactgcctatggggtagctctgctctgcaggggcagccagccagagctatagcactgcctccaccgcaagaaagctgttttcttccactaccagcttgctcttgaattccttcctgaggaagccaagaacctgccctgcatcagtagcatttcaagtcctctcttctagctgctctgaaatatgcaatacattgttgccagctacagataccctactaccctgctatggaatgttagggcttatttcttctacctaaccatatgtttgtacccattagccaacttctctttatcctcctcccacccacacatgcttcccagcctctggtatctatcattctattctctccctccatgacatcaactttttagctcccacatatgagtgagaacatatggtagctgtctttctgtgcttggcctatttcacttaacgttatgatcatcggttccatccatgctgctgcaaatgacgatttcattcatcttatggctgaatagaattccattatatatatatttatatatatatatatatatatatatatatatctatctcacattttctttatttcttcatctgtcagtggacacagtttgattccatatctttgctgttgtgaataggagagtgctaccactgttaaaggatctatttacatacatgcttataaataaatgcatccaggatttttgtaaagatctatcattactttcactcttttgtagcttttgaattttttcatcatgtgcatccacttcctaaaaacaaaatttctttttttaacttttcttttctttttctttttttttgaggcagggtctcattctgtcacccaggctggattgcagtggtgtgacctgagctcactgcaacacgtacctcctgggctcaaacaatcctcctacctcagcctcctgagtagctgagactacacactcatgccaccacacccagctaatttttgtattttttgtagagatggggttttgttatgttgccaagactgctgtctaactcctgggcacaagcaatctgcctgccttggcccaaagtgctgggattacaggcatgagccaccgcacccagttgtgtttttttgtgttttgtttttgtttttgtttttgttttgagacagagtctccctctattgcccaggctggagtgcagtggtgctgaaacaggaaaagttcccgtgtccccctcgcagggcaggcgatgggggtgtggttcgcttcttcagtgccccactgctcaaaccgctaggggagcatacagatgggcaggctgtggggctccggccccagggcaatgtctaggggttaatgtttacagccaggacccagtgggcatgtgctactgtttgctcttttagttttgctgtctataggtggcttttgttaaccagttcaattagaccctctaggcctggcatggtggctcatgcctgtaatcccagcactttgggaggccgaggtgggcagatcacttgaggtcagaagttcaagaccagcctggcccaacatggcgaaaccccgtctctacttaaaaatacaaaaattatccgggtgtggtggctcacacctgtaatcccacctattcgggaggctgaggcatgagaatcacttgaaccccagaggcagaggttgcagtgagcagagattgcaccactgcactccagcctaggcgacacagggagacaccatctcaacaaaaaacaaaaaaaaaaaacaaaaacaaaaacagaaaaaaaggaccctgtaccttgttgcgaggacagaggacttcctgtatccgggtttttgacttggtgtaccggaagaattggatcacacgtgggcttggagaatgagtgcaaggttttgttgagtggaagtagctctcagtagatgggggagccagaagggagatggagtgggaaggtggctttcccctggagtcgggtcgctcagcagcccaggctctcctcgactgccctggccaaactccacgtcgttccaccagtcgagagcctgccagtgtctgccagtgtgctcttctgccagagtgctcctttcaacatcctctcaaagtccagcggcttgcgtctccttctgccagtgtgttcctcatgatgtccagccacttctgtgtctgcctgctagggtcttgggggttttcataggcacatcatggggatgcagcaggccagggcattctgggtaaatgcaatgtttgggcaggagtgcctatcctcacctaggtacatagtggtggagctctagccagggaccatgccctcctctacccagcacttctcttccccactcctgtatcatttaaagggaccacgctgttcccttcccagcacttcccttccatatcagcgctatcattagctccctgcagccacaaactcctgggctcaagtgatcctcctgcctctgcctcccaagtagccaggactaaaggcatgtgtcaccatgcctggctaatttttttaaaaagttttgtagagatagggtcttgctatgttgcccaggctgaattaactggactattgttcaggaaaccaaagtaccaggcagtacaatgctagatttgaagtctatgaaaatagtaccctctgaatcattaaggcgcatcttcctatgagaggtggcttgagccagaccctggtggccaggggcagtgtctgtctggaccttcccaccaacaggctgtgcagccctggccagcccctattgctcctgtactctttccttacctgctaaacacacccaaatcacagcagaaatccaattcacttgaagacaagggctaagcctttctcataaccaaaggccgtgcgcttcccagagcaaaagtctgtatttgtcccctcatgttctgagctgccaggcagtaattctagcctacagttactcagtgtgacctaaaataacaattacccaagaaatgaaattctgataatttcaagtagaataaaatggaacatattttagtgaatggattgtaaggaaaagcctaaagatttggaactgcccatacgtggcactttaaaaatcttgggccctttatttcaggtaatcagttcatagagtaaaaacccatgtgactgccaagactggttattagttcaagcccaagaacacatcttcaaaggaagagaatgaatttatccacagttctgattgttttttacgttctaaaatcacacttattattaaaatataattcacttaatggtgatggtaattacatcagccaattcacttaaaatgaatgcgcaaagatgaatgcacaaaaatgcaccatttttcaatgaattggctgatgtacttaccgtcaccatcaaaacgcagggtgttcccctttccccgggaagcttccttgtgctgcagtctctgtcaaatcccttattcacagacctggccaaacactggtcactagagattagatttagctttcagggtttcacagaagtggaatcattcactctatgctgcttcttgtctggtacctttcgctcagcacaatgtttttcagctttatctgtgttgttacatgtgccaaacctttattcctttgtcgttgttgttttgaaacagtcttgcttcgttgcccaggctggagtgcatcggtgccattgtagctcactgcagccctgaactcctgggctcaaattatcctcccgcctcagcctcccaagtagctgggatgacaggtgtgtgccactgtgccctactaattttttatttttattttattttattttattttgagacagagtctcgctctgtcgcccaggctgagtgcagtggcgcaatcttggctcattgcaagctccgccttctgggtctacgccattctcctgcctcagcctcccgagtagctgggactacaggcgcccgccaccacaccaggctaattttttgtatttttagtagagacggggtttcaccatgttagccaggatggtctcgatctcctgacctcatgatccacccgcctcggcctcccaaagtgctgggattacaggtgtgagtcaccacgcccagcccattttaattttttttagagatggggtcttaactatgttgcccaggctggtgttgaactcccggcctcaagtgatcctcccaccttcgtctcccaaagtgatgggattacaggtgtgagccactgcacccggccacatttattccttttgatcgctgaacagtactcctcaaatgattttttaaaaataactatcttcttcctcatgacctgctggtaactcctagaacagtgatggaggagaattatggaatggtccttctaagctcctgaataattaaaccagtgagcagagccactgtcccatcccgttggccacaccagacacttgggaattatttttggttccttcttctacctcttttcaattccaataattaccaagttctatcaattttaatcccctaatatctctctaatcgatctcttcagttgctatttaagtaactcttcatttcttctcacctgtgttactacagaaattcatttttctatagttttgccttccatcaatcccttctccatcttaaaccaaactgatcttactgagaggaatgttgtgatttcctctctctctctctctctggaatgaatatatacatacatacatatatatatatatatatatgtgtgtgtatatatatatatatatatgtgtgtgtgtgtatatatatatatatatatatgtgtgtgtgtgtatatatatgtatatatattccagaaccttttcatcaccctaaagagaaactctgtccctaaatcccattccccctcccctagcccctggtaaccaccaaccaccatctcactttcgctctacaaatttgattattctaggtaccccatataacgactcgtacggtatttgtccttttgtgtctggcttatgtcacttagcccaatatttttcaggtttatctatgttgtgtcatgtgtcagtatcaggatttcatctctttctgaggctgaatgatgccccactgtgtttatccattcatctgttggacacctgggctgcttctatctcttgctattgtgaagaatgctgctgtgaacatgggcgcacaagcttctgttccagttcctgctttaattatctagggcatacacttaggactgggattgatggctcatatggtaattctgtgttcaaatttttgagaaaccacctaactgttttccacagcggctgcaccattttgcattcccacaagcaatgcgcaaaggttccattttctccaaaactggatacagtgaacaacaatgaaggtttttggttttaaacatatatacatatgttgtttatatgctctacacacatctctgtgtgtgtatcttaaaatgggtgccagtgactcgccattcagttttgggcaacgtggactctcggtgcctcagtttcctcacccctaatggaggtactgatactgttatcattcttgaagtgattgtgcagtttaaatgagcaaatatatgtaaatgacttaagtgggacctgacaaatgcagatgctataatgtaaggatggctgatctcattattgttgtcatactattactgaaaatcagtgtgaatgaaatctctaaactttgcaatcaacactgctcacctgggtctccgtagaagctgcagcgagctggggctgaggcagacaagcctgtggacatgagaacagatgcatgtgctcctcagacagacagacagtagggtgttgtggaaggggtcatctttagaggccacatactgtagtccatctccctcacagagcaggaaggtgaagcttgccaagcctgagggaatcctccagcccagacatcctatgagggcattgccaggacttgggggtagtgccctcgctccaggcatgtcttttccccatcccttgagcaggaagaagcacagcagacagcagggtgcatgcagagtacctggcagaatcgcctcggtagtgagaacaagcctgcgtgatgctgcaggtgcccctgactgtgactgagcctggcttcacacacctgggtttcctcatggctgttttcagcaatttggttactgtggtcccaggatgcatagcctctcaagattccacagaacagcctggtccagcatgaaggctacacggtgcctggtgccatctctcaacgtgtttgttaaaagggaagctttgtggcctcttcatctaatatagagggccttcaaattatagacttccaagtccatagctatagagattttcattttaaaatatatgtattggctgggcataatggcttacgcccgtaatcacagcactttaggaggccaaggcgggaggatcacttgaggccaggagttcaagaccagcctgggcaacagagtgagaccctgtttctcctaaaataaaaattaaaaaattagctaaggatggtggcatgcacctgtagttccagctacttgggaggctgaagtgggaggatcatttgagccaaggagtttgaggctgcagtgagctgtgatttcacactgcactccagcatgggtgacagagcaagactctatctctaaaaacaaaacaaaataaataaaatacagtaaaaaatagtgtgttgtgttgtggggtctgatgcggatgtctacagctcttcattcctaatgcatctgctgtttttccagctccccctgaggccacgggccacacaggccacaggggctctgcctgcccagctgggtccacaggaattctgccaagaagggctttcttttgcccttgtgggagctggtgggtcacttcctggtttttttctcatgattattgtttgtgaagtttgaatagaactgactcctggcttgttttttaattattaaagatttaagaacttttgaaaagattaaaaaagaattttgctcatattcctgccagccttgcataataattgttttcatttctatagacttttttctggtcttttctcatgctgacacagattttacattgttgtaatcattgtgtggggacaatttaggttctttcttctcagttttgtttgtaaacatctctttcatatcacattatttattattattattatttgagacagggtctcactctgtcacccaggctgcagtgcagtggtacaatcatagctcactgcagcctcaacctcccaggctcaagccatccttctgcctcagctccctgagtagctgggaccacaggtgtgtaccatcatgctcggctaatttttacattttttgtagagatggagtctcgctatgttgcccagactggtcttgaactcttggcctcaagggaccctcctgcctcagcttccacagtcctgggattatagacatgagccactgtgcccacattatttatttttgacagccaaatagtaatctgtcaggttaacatactgtaatatattatagagaagagacattcctctctgactggtatttaattttacccaaattttcactatcgtgaattttgtttaactcttcttggttttatgcaatttgtaaaaaatcactgttcataatttgtcttccatgcagttcatgccacagcatttgagagtgggtgctgccctcctccaccgtccctcttctatcagaattccgccacaagaaatgtcctggcattaacattttggaagctgctttagtgagggccactcttggggctggacaaatggctacttgagggtggtatctgccatgaggttggtcaggtacaggggcttggctggcctggcctggtgtggactattccaaggtcacgtcatcaacaacaaggtgggttagctatggtgcacatactccgctaccctaagcagctggaaacctggacaaaatgtctgaatcaactgttttcaggtgttgagaaacaggccatgcagagctgtgaccccagagtctacagaaatgagatggcaaggcgccgcagctgccctgggtttctgccttggtggggtcgggggtgcttcatgcacatcaagcagtgcgagtggcttggctgcattgaggagcggagatggggggctctgaacagctgtggtttgtgggctgagtcctggagggatgggaacactgcagagagggggctccagtaatcctcagggttgccccgagcattgggagatcctaagctgtgtgtgtgcggtgtgcaacgtcgtggagacaggaaagaacgagtgaccaggagcagaaaggcagctgagtccaagagttcacctgttctgggagatgctcgggtggcagccagactcagtggatggctctcactgaactcccgggatgccctagagacccctgaagagccccaccttagtagtggagcaaataagctctagagtaagggtgtcttagaccctcccctgcagagcttaaaacaaggcttcaaagtgaggttggaggcgggccccaatctggaggcttggctcatgcaagggaccaaattgaggcctagctaaacagggagggggcagaagcagctttccctaagatacacccaccagtgtgccatgtcagtttaccattgccatggcaacacccagaattgacctctcctttccatggcaatgaccggacaacccaggagttcctactgcttccctagaaatttctgcataaaccactcgttaatctgcatgtaattaaaagtaggtataagtatgcctgcaaagctgccctgagctgctactctctgcctatggggtccccctgctctgcaggagcagtcacggagctgcaacactgctgcttcagtaaaagctgtttctcctaccaccagcttgctcttgaattctttcctgggtgaggccaagaactcttgagggctaagccccactttagggctcatctgccctgcctcaaaaaaatcaaactagtctgccagtgactttgctgcttaaccaggcttggaagaaaagaaaactatagatcaaggtccttcatgaacacaaatgtgaaaatcttcaacaaaatattaccaaatatgactcagccatgtacaaaaaggattatacaccataatcaagtagagtgtatcccaggagtaaatggttagttcaacattcgaaagtcaatcaacacaattcttcctatcagccaactcaagaaggaagcatttatgatcggctcaatagatccagaaacggcatttaacaacatccaacacccatgtgtgaccaaaacacaggaagccgggaattaaagggaatttccttaatgtgataaaggcatctacaaatgccctacaactagcagcatgcctaagggtgaaagaccgaatacttttcccctaagggccagagcaaggccaggttgtctgaccccatcatttctattcaccattgtactggaggttgtagcaagggcaaaaggtgagaaaaaggaaaggcatacagattggagaggaataaacaaaaccatctttattcccagatgataggattttcagtgtagaaaatccgatggaatctacagaaaagctaccgaaactcacaaggaaatatatctactagcaaaccactgaaaattgaaataaacatgtccatttatgacagcaccaaaacacaaatttggtcatgaatcctataaaatatatgcaagagctacatgctgaaaacaataaaacttggccggtgcagtggcttatgcctgtgatcccagcactgtgagaggctgaggcaggaggattacttgaacccaggagttcaagaccagcctgggcagcatagcaggagcccatctttataccaacaaggaagaaagaggccaggcacagtggctcacacctgtaatcccagcactttgggaggccgaggcgggcggatcacttgaggtcaggagttcaagaccaacctggccaatatggtgaaaccccatctctacaaaaatacaaaaattagcagggcatgatggccggtgcctgtaatcccagctactcagaaggctgagacaagagcatcgcttgaatccaggaggtggaggttgcaatgagctgagatcgcaccattgcactccagcctgggtgacagagcgagactctgtctcaaaaaaaaaaaaaaagaagaaagaaaaagatatataaaaagctataaaatgctgataaaaaaatcaaagaattcctaaataaatggagaggtatattgtgttcttgtgttggaatagtcaatattccaaggtttacaagatgtcagttctcccacactgatctagaaattaaactaagtcccagtgaaaatctctgcaggttttttggtagaaatcgacaagcggactctaaaattcacagagaaaggcaggaagctaccatagacactactctagagaagaatatggttggaggacacacactatctgatttgaagacttactacaaagctacggtcatacagacatggtggtgttggagaaggcatagacagatagatcaatggacagacaggcaggccacagaaatcgccccacatggctgtggtagattgccttttgacagtgtgaggccagtttagtggaggatggattgtttcgggatgaagttcttggttcagagggtctgagactcaaggaggagttctggagcccagagacaccgttttgggaggtgtagacttagagttggaatggaggacgtaggaagatgtgagcttccccagggagatgggaagatggaggagaaagctggggtcctgactctggaataggagagagacaggattaagagagggacctaaaggcggggaagctcacgtctgcacaatggggaacgtatctggggaaggagctggcacatgctgtcaggtgcttctttgagcacaagatggcccaggccggaaaagggatttcagggaggtaaagaaatgcagaagaatgggagagcagggtggagacacaatggtgctgcacatcagcctggtgtcaccctctgctgcacatggagggatgggggtcatgccaacaaacagccatacagttttccttcttagctgcttgttttttttgagacatggtctggctttgttgcccaggccggagtgcagtggcacaatcttggctcactgcagtctcaatctcccgagctcaagcagtcctcccacctcagcctcccaggtatttgggatcataggcatgcaccaccatgcctggctaatttttaaaattttttgtagagacagggtctcactatcttgcccaggctggtgttgaactactgggcctaagtgatcctcctgtctcagcctcccaaatcatgctgagattacaggcatgagctaccaggcccggcctctcaactcttttttttttttttttttgagacagagtctcgctctgttgcccaggctagagtgcagtggcacaatctcggcgcactgcaagctccacctcccgggttcacgccatcctcctgcctcagcctcctgagtagctgggactacaggcgcccgtcaccatgcctggctaattttttttgtatttttagtagagacggggtatcactgtcttagccaggatggtctcgatttcctgacctcgtaatccgcccacctcagcctcccaaactgctgggattacaggcttgagctaccgcgcccggcctcaactctttaaagtaagatctatcatccccattttacggacaggggaactgaggctgggttcctgccgccagcgagtgggacccctggcctttgagccccggcccttcccaccaccctctgctgctggggctcagccctcgggcacgtggttgtgttaatggagagccatggccatgacttggagggcccggagagcgtgcacatcatgcctgcttcccatgatgccctgcgaggtgggcagaggccgggggtgctcaggccgagcccctgctacagcagatctgaggcaccagcagggactggctaggtcctcccaggcaggccaatgtgcccgggtcttgggcctctctctctcactcctcactgcctctcagctgcccaggcagcgtcccctgcagagcagccctggagcctggccccaggctgtgttgctgcctcttgcccccatggggctgcctctgcagggagcctgagtcgtttcctccctgggcaggtttcaaaatggctaagtccagtggagaaaagaatggctcaaagggaccacaggcttgaatttgaaaaaataaaaatgctcgatgccaaagcgtagacgcacatttatttgaacgacttacactttgacctgaaacagttttttccaaattgttttccacagcggtaatctcttcaaaatgaacacatgtgaggtcttcgaatgtatgttaaaggccagtatttgtttttttttttttttttttttttgctttggaagaaccgacctcatcgtttgcatgagaacctgatattcttggtcctctgtaccttttgtaacttcctctgaatgagaggaaatatggtttccagttatgtttaatttactttaaacaaatcaaagcacagatttctacttcctgcctgtgtaatacttgactgcaggcagcttcaaagggcagaatcactgttcttgtgactgtgcctctgtcgtgttctgttataaacagttcaaagctctgcattgtacaggagcgcgcggaacagcatgtagagatctttttctctgtagtggcggcagagctgtgtgtgcccttttgctttgccttgtgctggtggtggattaagtttaggttttcatagaatatatatttatgtagagactcagagtttatttttcctgttttctccagcactgcttaactcattctctgaaatgtttatcacaaatggcaggtggggctcagaggatgtctctatctttgttccttggcttaaactggcaggttgttgtaaagggcagtgggagggaaagaaaactaaggggaaaccaaattacttatttagggcttgattttctggcaggtgaattgggcttaggaaaccccacctagattagcagctgttcctgaccggcccctcgccaaagctgcacccctgggtggtggtgggggcttcaaattagggtgtcccaagggctggattgttccagcaaaggtgttcctggattcccaaagcaagttcacttgttttaggaacagttccctgaggctctgcaggggctgctgggctgccttgtctccccaggtccatgacgccaggccaccatccatgcatcctgttgtgtgctgggacggggtgccagatgctggcatccaggaacagagagtggattgcatgaacatggctaccatgcagttggttctctgctgctggggtgcaggcacctgaaagacacggaggagctaacccagctgagaagggtgtgtgccagtcaggacctggggtgcaggacacaaacatcacaccactgggttgcacaagacttggaggaggggcccaggaggatgacatcaaggtctggagggggttgctcaacaacacacctggatgtgcagtgcaggcatggcacctgcctctgcagcagggcccaaagactcgatggggctgccatgtggcctgatgtgagttggagtgaggctgtgacccccgggtgaaagctgcagcctgcatgcatcgatcacaagcgagggctggctgtgtcctcatcccaggaagggcggggtgagggcctcaccacagtgtgggcagggcccactcacgccctgggaagtgaatcaggaggtggcagcaggcactggggctctctaatctcttgcccgtctttgtccagttattgtgagagctccaattccctgttcttatttttctgaaagtgctgataagatgggtacagaataaatcaaatgcaaagttacgtttcctggcttaggaagcaaaaacctaagtataaccttggaagtgctcctgggtactcctttctttccccaaggtgatttttccctcttaaacacattacagtaaaatacatacaacattcactactttaatcatgttttgtttgtttgtttgtttgtttgtttgagacagggtctcgctttgttgcccaggctggagtgcagtggagcaagcacagctcgccttctgggctcaagtgatcctcccaagtagctgagactacaggtgtgagccacagtacctgactgattttgaaaaaaaattgtttgtagagatagggtctggctatgttgcccaggctagtccaaacttctgacctcaaactatcctccaggctgggactcccaaagtgctggaattacacacgtgagccactgtgcctggcccactttaattttttttttttttgagatggagactctgtcacccaggctggtgtgcagtggcacaatctcgactcactgcaatctccacctcccgggttcaagtgattctcctacctcagcttccctagtagctgggactataggcatgcgccccatgcttggctgattttttttgtattttttagtaccaacaccatgttggccaggctgttcttgaacttctgacttcaagtgatccacacatctcggtctcctaaagttctggaattacaggtgtgagccaccgcacctggccccactttaaccatttttaagtgcattaaggacattcacagtgttgagcagccagcaccatcaccatctccagaacgtcgtcatcttccgaggctgaaactctgttcccattgaacaccacctccccactccccatggctgtctcaggagctggcctgagcactgctgccctcaaggtcactctagaagtggagcttcagttcggcccccacttcctgtggctctatccctgcaggtgtgcccgggatccagaggtggccccatgaggccttgtccgagcaggtctggctggacccttgctcctcttggagctgggtagggctgggtgggctgcgtagggatgttcagggcagtggtcacctgttgcccagctctgggtggagccctgtctgaagacagctgttcttttctaaagaaagaagatctgtcagacgttagtcatctgcaccactgtcacagctgacgttgattgagctcctgtgtcctgggcactgtcccaaaagccccctgcatgcagttcttgccatttagtaccttttgttttgtgtttactgaatggatacagccggaagctagctaaatttaactcacgccctcgacttgggtggaggtgaggaaggggctttctgaggcagggaattgggtgagggctttattttataggcatactttggagatagtgtgagttcagttccagaccacactgcagtaaagtgaatatcataatgaagtgggtcatatgaattttttggtttcccagcacatataaaagttatgtttacactaaactgtagtctattaaatataggatagcatcacatctaaaaaaaacaatttttatatgccttcatttaaaaatacttggccgagcgtggtggctcatgcctgtaatcccagcattttgggaggttgaggcgggaggatcatgacctcaggaattcaagaccagcctggtcaatatggtgaaaccccgtctctactaaaaatacaaaaaaaaaaaattagctgggcatggtgtcgcgcgcctgtaatcccagctactcaggaggctaaggcagaagaatctcttgaacccaggagacggaggtggtagtgagccgagatcacgccattgcactccagactggatgacagagcgagactccgtctaaaaaaaaaaaaaaaagaaagaaaaagaaaaaaaaactttactgctaaaaatactaatgatcatccaagtcttcagtgagtcagaatctttttgctggtggagggccttgcctcggtgctgatggctgctgactgatcagggtggtggttgctgaagggtagaggggctgtgacaatgtattcaaatcagacaacagtgaagtttaccacattgattgactctgcctttcacaggagatggcccccggcactggaggctgcttgataccattttacccacagtagaaggtctttcaaaattagaaatcctctcaagcctgctgtgttttttcggttatgaaatattctgaacgctttgttgtcattgcaaccatgttcacagcatctgccccaggaggacgttccgtctcaaggaaccactttctttgttcatccctaagaagcaactcctcatgtgttcaagttggatcctgagattgcagcaattcagccccttcttcgggctccacttcttttttttttttgagacggagtctcgctctgtcgcccaggctggagtgcagtggtgcaatcttggctcactgcaagctccgcctcccgggttcacgccatcctcctccctcagcctcctgagtagctgggactacaggcgcccgccatcacgcccagctaattttttgtatttttagtagagatggggtttcaccgtgttagccaggatggtctcgaactcctgacctcgtgatccacccacctcggactcccaaagtgctgggattaccagtgtgagccactgcacctggtctaggctccacttctaaatctggttctcctgctgtttcccccacatctgcagtgactttctccactgaagtcctgaaccctcaaagtcatccatgagggttggaatctacttcttccaaactcctattaatgttgatattttgacctcttcccatgaagcaaaaatgttctcttttttttgagacagggtctcactcgttgcccagtctggagtgcagtgatgtgatcgcgaggacatcaacaaccttctgggctcaggtgagccctgcctcagcctcccaattagctggaactataggcatgcaccaccaaacctggctagtttttttttttgtttgttttgttttttttttttataaacagagtctccatatgttgccctggctggtctcaaactcctggactcaagtgattcttctgcctcagcctcccaaattgttggaattaacaggtgtaagtcaccacaacttgctgcttttcatggcatctagactggtgaatcttttccaaaagattttcaatgtacttcgcccgaatccatcagaggaatcaccatctatggcaactatagccttatgaaatgtatttcttgaataataagacttgaaattgaaattactcttcagtccatgggctgcggaatggatgttgtgttagcaggcatgcacacagctttcatctccttgtccatctccatcacagctcctggatgactaggtgcagtaatattttgaaaggattctttttttttttctgagcagcatttctcaacagtgggcttaaaatattcagtaagccctgctgtaaacaaatgtgctgtcatctaggttttcttgttccatttctagagcgcaggcagagaaaatttggcatgattcttaaggccctaggatttctggaatggcgaataaacattggcttcaacataaagtcaccagctgcattagcccctaacagagccagcctttcctttgaaactttgaagccagtcattgacttctcctctctagctaggaaagtcctagatggcatcctcttctgatagaaggctgtttcacctacattgacgatctgttgtttagtgtggccaccttcatcagtgatcttagccagatcttctggataacttgcggcagcttctacatcagcacttgctccttcaccttgcacttttatgttatgtagatggcttccttccttaccctcatgcacaaatctctactagcttctaagttttcttctgcagcttcctcacctctctcagccttcatagaattgaagagaagtaggatcttgctctgaattaggctttgacttaaggaaatgcatggctggtttgatcttctatccagaccactaccacattctccatatcagcaataaggctgtttcactttcttatcatttgtgtcttcactggaggagcacttttaatctccttcaggaactttacctttgcattcacaatttgattatttggtgcaagaggtctagctttcagcctgtctcaacttttgacagccttcctcactaagcttaatcatttctaacttttgacttaaagtgagaaatgtgcaacccttcctttcacttgaacacttagaggccattgtagggttattaattggcctaatttcaatattgttgtgtctcagggaatagggaggcctaaggagagagagagagatggggcatggacagtcagtggagcagtcagaacacacatattatcagaagttcactgtcttatacgggcatggttccgggcccaaaacaatgacaatagtaacatcaaagatcacaggctgggtgcagtggctcacacctgtaatctcaacactttgggaggctgaagcacgtagattgcttgagcccaggagtttgagaccagcctgggaaacatggtgaaacccagtttctacaaaaaatacaaaagttatccaggcatggtggcacacgtgtgcctgtggtcccagctactcgggaggctgaggtgggaggatcgcctgagcctgggagattgaggctgcagtgaaccatgactgcagtactgcactccagcctgggtgacagagtgagaccctgtctcaaaaaaaaaaaaaaaaatcattactcatgaggcaggagaatagggtctggaagcagggaacctaaatcctcaccttttctgcactggcagatgggaaattggctgtcttcaacaaatctgactgattgccggtggagtctttgtttgcaacttggtaacttcactctggccttggaatggttgctgtccacaatcaatcagactgattgtgggcagagtctttgtttgcatagaagtataactctgtaacttcatcctagcctctgattgctttttgcaaccaatcagatgtttgcacaggagtgtgacctttgtaacattacttcagcctctggttggctgctttctgcaaccaatcagaatgattgtgggctatcacttcatttacatgagatgagcatgaagtggccaatgggaaacttcttgggggtatttgaacccaagaagattctgtatctgggccctgagccactgcttgggcccgctcccacactgtggcgtgttctttcattttcaataaacacctgctttcattcttttgttgcttcattctttctttgctttgctgggtgttttgtccaattctttgttcaaaacaccaagaacctggacaacttgcagtcacgaccctctaccggcgacagtcaccgatcaccatgatggatacctaataaggaaaaagtatgacatattatgagaattaccaatgtgacacagagagccagaggtcacatactgttggaaaaatggcaccaagagacttgctagacacaggcttgccacaagccttcaatttgtagaaaacacaatatctataaaatgcaataaagcaaactacaataaaatacaggtgtgcctgtattctattttgccccaacctccacaacaaccatgaggtgcaaagatatttcacccccattttgtagaccagaaaacaagcagagagaggctaactgtaagggtgtgtttttagatcccaatgccaggaagggtcagagtgcaggttctgccacatttgacatcatgcggtccagggggccactgcacctgatgcccgtgtcatcagggctgggatttggtctccaatgcacctgtgtgatcaaggcccaggatgtgtgccggggggtggctttccttcctgggggaatgtgactggcccataccatttctggtttaactttctagtgaatcgattttcatgtctttagagtttaaactgtgcaggcagcctcagggagagccaagagttccgtggacagtcttgaagcttgatgggctcttctgagtgacagcgtgagcgccaggcacgagtccagactgtgatatgggctttgaccctctgacctcattgcctctctgtttatccgctttgcttcctctgcagctgatgtcattgtggttcacatttcgcagtaggatgatccctggggagtgggtagtgagggacacttgttggggagggcctgtctggacctagggacagagctgggatcatcagctgtgacctgttggccagatcccagcaccgctctaccccatggctcaggagcttactatgtttgttacattgctaaatggtcagaaagaaggaagaagaaagaaggagaagaggaggaggattattattcacgattggcctaaggggctcacacctgtaatctcagcactttggaaggctgaggcggtggactgcttgaggccaactcaatccccgtctctacaaaaaattaaaaaattagctgggagtggtggcatgagcctgtactcctagctactcagaaggatcgcttgagcccaggagttggaggctgcagtgagttatgatcgtaaaaaataaaaagatttcatgacatgtgaaaacgatctgaaattctaattcactgtccataaatgagctttactggaacacagtggtgcccattccttttgctttgtgtgggctgttttgctcccacggcaaggttgagtagctgggacagaggccatgtggcctggagagcctaacatatttaccaactggcccttcccacaagacgcttgccaagcccaggccctgcgttccctcccttcctgcgatgacaaagtcaggttggtagtcacatttcatggggttggcacaaaccgttggtgcttaatcggagtggaagaggctgtgctgggggccaactgcacaactgcacgggttccagagagaaggcagcggcccacatgccatcaactgtcccacacctgtggctgccagggcctgcctccgagggacgcccccctccgcccgccgtgtgttcattaagagggccggggtctgtggtggccccacaggcagcgggcctctgtcctgtgctcaggtggtgctctttgaagggtggcagggccgggggctcctcttgtgctgccagagctggtcccagagacccacctgcccagggccagcccgtgggatggcagccccgtgcgtgacagtggccttcgcatagtaccatctgctcccagtggggcggttctagacttgctctgggaagcagcctttccagataacaggagacaccccagccagtcggtggggaagcaggcctggggtcggccacggggactctggagggtctcttcaggccacggctggtgtttcctgaggaagtggggccgacacagaagggccagggccgcgtggttgagaagtaaggatgaggatgatgggggctgctaagatccctggccccatcactgtgcagcttttctactcacttgtggtaacaaacgcccaacatgacatttatcatcataaccatttttaagcacccagttcgataacctaagtatatcctaagtatatccttagtataacctaagtatatccgcgttgttgtgcatccagtctccaaaatccttttcatcctgcaaaactgaaacactgtacccactaaaccacaactctcctttctcccttcttttcagcccctccccagcttaccattctgctttctgtctgtgaatttggctattctagagaactcatgtcagtggactcactccgcatttgtctttctgtgactgacttattttactttgcataatatccgcaaggtccatccacgtggcggtgtgtgtccgagttccctgcctctccaggctgagtgatgctgccttctgcggatgtgtcatcttttctttatccattcatctcctcatgggcactcaggttccctctatctcttcagcatgggtgggcatttgccccaatcctgctttcgcttcttttggatctacacctggaaatggtgtgctggatcagaggctcttcttacttttaacttttgaggagcagccacactgatttccatagcagttgcaccatctcacattcccaccatcggcacacgagggtcccaccgtctgcacatgagggtcccaccgtcttcattcacatcctcaccagcatgtgtgtgtgtgtgtttttttaatagcagtcatcctagtgggtgtgatccgttttgttttaagtaaggcataattttcatacaacaaaatgcacagatcttgtttcccataacaggagttttggctgatgaactttcatgaaatctacatcccacccagggataggacatttccggtgctctgggaagctccctctcacctttccctgtcatccctctccacccggcaccgggttgctgtcacaccggaagagcagtgcctgcccctgcccttggtgccgatgcacccacagtaaagacagaaaggtttgcgtgggcccaagcctgcctccccattaggcagccctgctcagggctgctcctcgcacccggggaggaggtgcctgtgcctccaggagcagggagagggctgggtttgcaggtgccctgcatccagctccagcctctccccagcccgctgtgtttgcttttggagggctgagcacaggatgtgcccgtcctctgcctgatgacagtggagtgatgtcaggccaggtgcttcccggagggaggcagggcgtgcagcctgctgcctggcaggggagggggtgggcaaggttcccaaagagagagctgagctacgggccgactatgcatcagcgatgtttacaacagcttcccgccctcaccagtttcgaagtttgcgtttccattctgagagcctcattttcagccccacttgctgctaaagggcagtttatcttcagaatcaacattcggatagaatcgcgcaccctctaacctgggagcagaatgtgctcggctttgacaactatacagtttttatgagcagcaggttcctgaaaagcttgtgttcccaaggccaggctggtgccacgggaaggcctgtcccaggctgagctccgtctctcctcccgtggatttactcagtaacgttgcaggagtctgagccccgacagtgtcgtgggttcattcaaccttcagcaaatcattattcctgtcagacgcttgggatacagagttgagcaggctgggaaccagggggcagactcaggggatgacagcatcacacataaatactcatatccacctaagtgtgcattcaggctgggtggtcagggggtcccttagaggaagccacaccagaagggtggatgggatttagccaatgagaagagctgaggtggtgagtctcaggggagctcggatgcagcctctgtggggaggtgtgtgaagggccatgccctaaacagcgtccagggcagtggggtggccagcccctgactgagggggttaatgggggtggtgataagccccagaaccagaattgcttttcaggcctcagtggctcagattccagaggctttggtgtctttggcagaaagagactgaagtttctatttcagttctctcagtgaaaaccagcatttctcacccaggctttcatgctttggctgagttctaggctccttttctcccaagacatggagcagattccaggctggtggccgtctctgtgtggtgcctgagctgcgtggcatcgatggctgtgagctttgtccccactggctcacgagctcacagggccacactgccttctccacaccgtaccccacagcatcgcggtgccagtgcctcctggcctccagaggtggctattggctgcctcatgccttcctcagagatctggtttttaaagtaaagtgagggtcagtaaatggagggagacagaagcaaagaaaaatgggttggacacagaaaacaaactggctgtcagagctctgatctgaatctcaggcatcctttcctttcttttaaaaatatgtgattgtggtcaaacatacagaacataaaaggtctacccatttttaagtgcgtagttcagtggtgttaaatccattctcactgtgctgcagccactccctagaactcttcatcttggcctggtgcggtggctcacgcctgtaatcctaacactttgggaagctgaggcgggcggatcacccgaggtcgggagttcgaaaccagcctgaccaacatgatgaaaccctgtctctactaaaaatacaaaaattagctaggcgtggtggcacatgtctgtaatcccaggtactcaggaggctaagacagaagaaccacttgaacccaggaggtgaagtttgcagtgagctgagattgtgtcattgtactctggcctgggcaacagagtgaaactctgtcccaaaaaaagaaaaaaagaaaagaactcttcatcttgcgtgaatattaagcattttttgaaaaacaaaaggaggccaggcattgtggctcatacctatagtcccagcacctgtattatcaaggcccagggtgtgtgcctgggtgtggcttccttcctgggaaggatcacttcagtccagaagttcgggaccagcctgagcaacatgacaaaaccccgtctctacagagaaatgcaaaaattagccaggcatagtggcacatgcttgtagtcccagccactctggaggctgaggcaggagaattgcttaagccagggaggtggaggttgcagtgagctgagattgcaccactgcactccagcctgggcaaaaaagtgagaccctgtctcaaaaaataaataaaaaataaaaaaggaaaggaaagaaaataaacagagcaaggttctcttcaaaatttagctgcagccaggtgtcgtggctcatgcctgtaattccagcactttgagaggccgaggtaggaggatcacttgagcccaggagtttgagaccagcctgggcaacatagtgagaccttgtgtctactaaaaaaagaaaaaatttaaaaaaccaggcatggtggcatgtgcctgcagtcttagctgctcagggagctgagacgggaggatcccttgaggccagttcgaggctgcagtgagctgcgattgttgcactgcactccagcctgggtgacagagcaagaactttctcaaaaaaaaaaaaaaaaaaaaaaaggccgggtgcggtggttcccagcactttgggaggccgaggagggtggatcacttgaggtcaggagttggaggtcccccctggccaacatggtgaaaccccgtctctattaaaaaatacaaaaattagccagttgtggtggcatatgcctgtaatcccagctactcaagggctgaggcaggagaaccgcttgaacctgggaggctgaggttgcagtcagccgagactgctccactgtactccagcctgggcaacagagactctatctcaaaaaaaaaaaaggctcagctgccaggagccagcatttttcctcttcccatcattccctttctgcagccaactcctgcccctcctcatgtgcattgtgggggctgtcacagccctgtggcttctgtggggcgggggcacagcggtgactgctgcccagggtagagcttgtgcagaggctggctccccatgacctgcctgctcctgagtaagtcactgactcccctgcagctcttagcaagccaagggacagggctgcttgctctgcagattggtgaggtgagggacaaccccccagcctagcggctctagtgctgtgggaaggtgcagtctgcggcagaagggcccagggacttggcctgttaagggccacgccaggctgtttccttcatgtctcacctgcagcaccaccacacctgccgctggtggagcccctcccccctcacacccccacttctgctccttagcaggtcttagttctcattttgcatcacagtgggccatgtggttttccacaaaacaagagggagaaaggcaataatacagtggctttcgatttgtttcgatttgtagtagtaaagtctttctttaaataaaatcttccctggtaattgtgtcatggaagaaataagcaaagcatctctagttgaggcagccagggtgcctccccgtgctggggcgcccccactcccaaagcccgtatgcccagaggcccctccactgacccaggaatttgtaaaccctcgccttggtgttcagcaggaagctcacacaggggcagcaacaagccccaccgccaccccaatccccccactacgcctacattgaggctgccctcgaggtgagttcatgcatacagaagtccaaatttagaccacacgttgggggtgatactgcctgaggtatgaagataggatttgtctgataggcagatgtaaaggctggaaattacctgcatgctaaaaagcaaaacagagattccaggttcccatggtggagggaagcacagaatctagtaagacaaacctcccagaaactcaccgcagcaaccaagttgaagagaggaacaaccacaggcctcgaacttcaggagcccatggtcagggagaaacagaagattcgggtgcagcagggcatggctcccaacagaggcgtgaggatgatgtgaggctggggtcttaggggctccagctcccctgctaatttggagagatgggggctagaggcagccctaggaaaggatgggaaggagctgcagccccccagcactacgagtctcggtcctgggtggctggcgagccctggggcactgtgctgagggcaccgtgggcctacactcgtggccaagcggcggcccctgggtggcctacactcgtggccaagcggcggcccctgggtgctcctctctgctgccatcaccgccttctgcctggctttgtgtcctctcccatcccctgctgggctccatcctgcacaggcccttcccatgacccactccccttcaacccatgtctgctgctgaccccccagcctagcctggggtcccatccttcctgctggcccttctgcctcccgttgcctcctcagcccaccctggtttcccaggcctgcgaccggcttcggactcagcgaggctcacattcaggagtaaagctgaggacctgcactcagagctgggcattttaaaaatcatctttatgaagttgatcagaccaaaaaaaaaaaaaaaaaagacaaagaacttgcttgcatcacaaacatcctagtgtccaccatccctcttcagaaatgagatctgacaatgcactccacatcccagaggcccccgaggtgagagtggcagtcctgaatttggtgttaacattctttgcgtgggtttgtacttctaatgcctaggcttattcctccaagtgatacagatcacactctgcagtagcacaggagatatagagacctattacctttatgcatggatagatgtagctatctctccatctgtctccctgcccatgtatgtgtgcatttctctatccattcatatatgtatgtatgtatctattccggtacatatacacctgtctatccatctagccatgtatatatgtatgtgcctagccatccatccatgtacatatgtacctatctatccacctatccattcatgtatgtacctattcatccccctgtctattcatatgtgtgtgtacctatctatctacctatccatccatgtatgtatgtacctatctatccacctatccatttatgtatgtatgtacctatctatccacctatctattcatatgtgtatgtacctatccatccacctgtctattcgtgtgtgtatgtacctatccatccacctgtctattcgtgtatgtacctatccatccacctgtctattcgtgtgtgtatgtacctatccatccacctgtctattcgtgtatgtacctatccatccacctgtctattcgtgtaagattgtacctatccatccacctgtctattcgtgtatgtatgtacctatccatccacctgtctattcgtgtatgtatgtacctatccatccacctgtctattcgtgtatgtatgtatctatccatccacctgtctattcgtgtatgtatgtacctatctatccatccacctgtctattcgtgtatgcacgtacctatccatctgtcgttctctttcttctgcagctcctttcctcacctgcagtgtgtgagcctgccacgctaactgtgacatgtgtcactccagttcattcatgaatagttgcagggttgctggggcacacagagtaccaggggaatgccagtcctggctgggccacagtgtccatcctactgatggagtgtcagcggggtgggggtgggactccagttttctgcaagtctagcacggctactgaacagtctcatgcaggcgcaaggggttccagggcaggtactgagacacgggcttgccaggtcccacggcatggctgtccttggcctcctgacaccgccacagctctggccaaggctgctctgcatcaccccccaccacaggcgtgggagccgtctttctggtttctgtggtccgttctgtttccagtttgtgaattaccagttcctgttttcccccttttcaatgggttcttggccttttcttaattaagttattagattctatgaatattctggattctaatgcttagttggctctatcctctgcaaagcttttctcccagtctgtggcttaaagtcttttcactcctttattttgtcttttaatatatagaacgtttacagtggaatgtagactaatccagcaatctgctctgtgctttcagtgttttaatcaagaagttatatttcataccaaagtcataaagccttctgcattttcttctgaaagttgtaaggttttatcttgaggtctttggagtaaggtgtgacatagagattcagttctgttttctttttccacatggacatgaatcgagtcccttctccctcctacaggctgtaatgccacgtggccatctgttacgtggccacagtttcttgagtctggtcctagactcttctccgtcctgggactgctcatctgtcctgagccggcacagcctttgggtatttcagctttgcgatccatctttatgccccacgttgcccttcagaacacatctgactgttctcggctcttggctttcccatcacatgttttagaatcagcctgtaatcccaacactttgagaggccaagactggaggatcacttgaagacgagttcaagaccaccctgggcaacaaactgagacacggtctacaaaaaaagtttttttaattgttaaatgtggggccgggcgcagtggctcacgcctgtaatcccagcagtttgggaggccgaggtgggtagatcacctgaggtcaggagttcaagaccagcctggccaacacggtgaaaccccgtctctactaaacatacaaaaatgagtcgggcatgatggcgggcgcctgtagtcccagctacttgggagtctgaggcaggagaatcgcttgaacccgggaggcagaggttgcagtgagccaagattgcgccactgcactccagcctgggtgacagagtgagactccatctcaaaataaataaataaataaaataaatagttaaatgtgctgctgtggtaaagcacacttaaaaaaactgcattttacagtcatttgtgttagtgagcctgaatgctactgaattctgaatattgctcttggctcccacacccttcagagctttctctctgacactcactgggtcatggtctgccacgtgactccacctgcctctctctttccggctcccacagccttcagctttctgacattttacatggtccaggggcatccttgccatgttgaaaatagaggtgatggcaggcatgatacagcagaaatgttaatacaagaagagagaacttattagctatgcatgactctgtgctccaacacttgaacatttcattaaaatagacaatttcctaggaaaaattaaatgttcaaaacctggatctaaaaaaaaagtaacctttctattgcctctttgggtgttttttataattattttcagcatattggccccttcttaaggggaaatcatgtagagtagaaaaaaaaaaagcgcaccgggtcactgtgatgcctccccagttaccacccgagtggctccagcagacactctggagaccagagcccggccaccagagcaccacaggggaccgccacctgtcagggctttaaaaatactgcgttcctttctctgtttccttctactctactttcactctttttgaaagtgaggttggcctttttacccaaaaactctcaaagtcctcccacacactgtcgttggccactgtcatttagcaggagggagtgtgtccagcctgggaagtgagcgactgcaactctgtgtttgcctaaacacagtttcttgttgccgatgcctgctctcttctcttatttactctgtgtaccgagggaggtgggcaggcggtgtgagtaacctctctgctcccgtcgaagctgcagccccgtccttgtgtgtgttcacagacaacattggcagtaccatcatgatgactggtgccacgtcctgaacaatcggcccacggctgtcgggatgcacctgggcttgggaactggtgtcttggatgtgggacacttcccagatcacaacgagagcttccatggagagggagtccttcccagactgtcagatggccacctcagagacagtagtctttgggatgaatacttttgtcaattttgtctgcattcctgaaggaataggacatcattttgaagaacttgggagtattattttacctaaagctaggaaaacaggaaggaactgtgttgttattttagatactgttcagatacgatatgagcattgaaatgaatagggtcatcagtcgctgtggtttgattttattgtggtaaaaacacatattatacaatttaccatcttgattttttttttgagacagagtctcactctgtcactcaggctggagtgcagtggcacgatcccagctcactgcaacctctgcctcctgggttcaagtgattctcctgcctcagccttccaagcagatgagattacagacatgcgccactatgcccagctaatttcattttttcttattttttgtagagacagtgtctcactatgttgcccagcgtggtctcgaactcctgacctcaagggatccttccacctcagcctcccaaagtgctggcaaagtgctgggattacagacatgagccaccactcccaggctttcacttatttttagattggattatttgattttgttgttgttgagttttaaaagtttttgttgttgttgtgtgttgttgttttttttttcttgagacagagttttgctctgtcacccatgaaggaaataatgtatacagtggtctatttccaagacaaagtgcattgaattggcttaggtcagcaaactacagaagaaacaggatataccaggcccctgcttggatagccaatgactgcttgtcggccttccccttccctctcttcttgccacgccccgcacccccaccctccccacccttagttgccttcacctgaaccaaagaaattcagtctaagacgaaagcttactagtcttcaaaatagctcgctttgtctgttcttttcagcctgcccagctacttaggtcacaagtcaaaaacttggagaacccctgagctaactaggattgcaatgcattgtgggctgcaacaaaatgcagcaagataactgtaaaaaaaaaaaaaaaaaaacacctacaggccctacctaacaatcagaacaatcagtaggcgatgtccgggaaggttgtagccccatagtactcactttatgaggaactgggggagggacctgcacactaggggatacattgcctattgaaactgtgctggctgtgcctgcctatcaggcaagatcgtcattaaaagtctcactttggctgttctctgggtctctgagtccattctttgggtttggatgagtgagtttgtttctcacatccaggctggagtactgtggcgcgatctcaactcactgcaatctctgcctcccgggttcaagcgtttctccagcttcaggctccctggtagctgggattacaggcgcgcaccaccacgctcagctaatttttgtatttttggtagaaatgggttttcaccatgttggccaggctgttctcgaactcctgacctcaggtgatccaccctcttcggccttccaaagtgctgggattacaggcgtgagccaccgtgcccagccaagagttctttctatgttgtggctgttgatcctcgtcagatgtatgatttgccaatattttttctcattctgtcagttgccattactctgttgactgagtcctctgatgagcagaagtgttaaggtttgatgtagtccctgcggtctggcttttgttaaaaacgtgttggcagggggagggagggggtcagaaccctgcaggaggttctattacttctggtgatgcattgctgagctggggcgttctgtgatcaaatttcactggcttttcttgatttctttccagcctgaaactcaggtgtggagtttatgaaagttcttcatgcaaaagtgagtgttgtccctgagattgctaaagccgatgccctcacctgaaggaaagggagcatagcgtaggaacgctggttcctggatgtctttctttggggcctatgtcatggggggcagagtcaggttctaatgttgattctaaaagagaagaccccatttgagagagtaagcattgctggtttgctaaaagtaagaaaagtttctactcgttagagagactgtctcctgcggttgcctggccgccctttgcacagcccgcgaagggcacgtgggaatcctgctccattccaggtcccgggccagtagctccaggccgcgccagggtcggtgcagagcggcatttcccgcccccacacaccttgacaggccaggtaacaagagaggcctttctagaaagtccctggaaaaggctctttcctcccaaaccggcagattatgctttgtatgtctgttgtggcaagaaccttttcttgttttctttctcaaagtgacaaattgatggcagggcagataaatcgtattttctttccttctttctttctttctttctttctttctctctctctttctttttttttcttggtgacagggcagataaatcatattttctttctttctctttcttttttatttttctttttgagatggagtctcgctctgtcacccaggctggagtgcagtggcacgatcctggctcactgcatcctccgcctcctgggttcaagcgattctcctgcctcagcctcctgagtagctgggattacaggcatgcaccaccacgcccagctaatttttgtatttttagtagagatggggtttcaccatgttgggcaggatggtcttgaactcctgacctcaggtgatccacccacctcagcctcccaaagtgctgggattacaggcatgagccaccatgcccagcctttttttcttttcttttcttaatagacagggtctcactttcagtcactcaggctggggtgcagagtttcaatcctagctcactgcagctttgacctcctaggctcagctgatcctcctgcctcagcctcccaaagtgctgggatgacaggtgtgagccattgttcccagctaaatagtgctttttcttctctctaacattgaaatatagaaagtatgaaaaagccactcatggtcaagcggcatgtccctgcagagctgtcagccacactgcctcccagaatccaggttgggggtttccgatgctgtctgttccatgtgacctcacagcctcctgaaccaactgatggccccaaatgtttatccccattccagatggcacctggtggtacctgaaagtgacctctgggctgcgaggtgcgtggtaatgtccctgtggcccatctctagatcgtgaagagggtgatgtgaatcatagcacactccaggacatcacagggccccagcacaattgtgtatgctgtgactccgtcacccaactacttcgagtcttcaaagacattgaattgccattgttctaatacttatttgcctttggttcccactccttcctccccgtggtgggaagaaagttggggaatgtgcacccagaagatgtcggggctggatcaagccccttttcagtcactgtcattcatagttgagatgtgaactctgcaaaggcagtgagtacagaacattcttgtttccagtgcaaatccactgtgaccaggaagctgtgcctaggtctctgactccagccacccatacctcctctccctgtacccagagccctggatgaaagcatgagtctgggatgctgggaagagggcagacaatgacagctcccaggcgctgtggaccaggcaggctctgtgttgggctttcctggcagacgatgctgtagttagttaatcctctcgaggacatgtgagatgagggtatcattaccttagagatggaggatctgagcctccagcagataagcagctgccccgctgcagagaactgaaaatgaagctaagcttgttggcttttccccaccagctgcctcccacttcctccacctgctctgtctctgcagaaaacatcaagaatgcaaatccagccccttggccagctcatttgcacacacactcacctcaggggtctctgggggtgtcttggatgcagacctccatccctcacaccctcacacctgtccgtccaagggtcaggccatgctggagtgcctgggctggcctgatggagatgctgcaccagctgagtcatggcgggaaaacagccgggaatcacccaatatctattccttccttcctttccattttcttttacaacagcaaaatgatgccaagatttttctgtgcttcccctgttataggctgatttatggcctccctcccaagttcctatgttgaactcctaaccacccagtcccaaccccatatggctgtatttggatagatctttttctttctttcttttttgagacggagtcttgctctgttgaccaggctggagtgcagtggtgcaatcttagctcactgcaacctctgccacctgggttcaagagattcttgtgcctcagcctcctaagtagctgggactacaggtgcgcaccaccacgcctggctaattttttgtatttttagtagagacgggatttcaccaggctggtcttgaactcctgacctcaagtgatctacctgcctcggcctcccaaagtgttgggattacaggcctgagccactgcacctggctgagagagggtctttaaacaggtaattcattcaaaatgaggtcatgagggtgggccctactcttgtatgactggtgtcctataagaaaaggagactagggcctagcaaggtggctcccaacagtttgggaggccaaagcaggaggattgctcaagcccagatgttcgagaccagcctgagcaacatggtgagacccccatctctacaaaaaattttaaaaattagccaggcatggtgaggtgcacccgtagtcccagctacttgggagcctgggaggctgaggcaagaggatcgcttgagcactaggaatgtggggcttcggtgagccatgattgtgccactgcactccaatctgggcaacacagcaagatcctgtctctaaaactaaataaagaaagaaaaaggagaggagattaggacacaggtatgcccagagggatgaccctctgagggcatggcgagaagacggccatcgacaagcccgggagaaggtccccggaagacataaccctgcccacgccttgatcccagacttccggcccgcagaatataagacaataaaggtctgcggtgaggccaccagccagtggcactttgtgatggcagccccgggaggccaaaacagctgcctgttccccacgtccctctcccagcagaagcgcatgggctgctcttgagccccagctgcagtccatcactgtcagtgctaatgcgaagctcccctaagactgacttgacaatattggcgagtgggcttgacccaccagcctgcatccggtgccggtgaatgggcacttacgttccttattgaaacgctacttgtggccctctgcttcccggagctcctggcaacagcccaactttatgttccaaataggaaaaggctgcttgatttaaagactcggacttcattaggcgttaccttgatttatggaaaaataatactgaatggttgcataacaatggcccactgctcacctacgtgtggcctggggttaataaaaccggcacatttgtctctcccacgatgacgtcaacgtgtaccagcccttctcttccacatgggaaacgtgttatgttgttccaattgtacattcacttggtgaagggttgtgttaagtgattccaaaaattgactgtgtatattttctctagggaagttattgtatattattttagctgggaacatctctcgcacacaattactaatcagaagtgaaaatcaggatttgtccccggcccacctggcggatctgatgcagcgccagggcagcccgtgaagacgggcgctcttcctccgtgactctgggccaggcagaaggagccttggagaggctgcaggaggaagcccggcttgaggccattcctgttttgtcttgctggaattcaaagatatttgttaatcctttccccccacttgagttgagaaggcctggaatgaggtttcacaagctgtgccctgtagagctcctggggaaactggctcgaaagaatgacttctcgagagggaaactaatatttgcttattttccccccactaacttcccaagggaaggctaatctttagaaacacagaaactttggaggccaataaaattgagagcaagagaagcgagattgtttcattgttgccaccatgaaggagagtttgtttttactggatttctttttcccttcaggaaggctctggtaagagtcctgatagattattctcgcacccctggttctggctttccccccattgtttcaattgcccttttaatcaccacgatctcagtcaaggtcaaggctgctgtttcatgtacccgtgccccgcctgccctcctctgccgcggattcccatggggatgtgtgtggctgcatgaccacccttccgtgtcaccaatcacaccgagcagccctgaagccagcgtggggtgtcggcagggtggtggcactcggcatttcccagcctcttcttggatgcctggggtcctctctgcagggtttggtgaggccctgctggggtgagagcccttggcagccccaactgtgtctgatcacaggcgaagcatttatgaggcagctgggtcccataacagaaacagggaaaccagaggcagaagtgacattacgaagtggcttacggcgctgctaagtcagggttggggtagcaaagcgtcatatagggaactgaaatgcttttcagcgcacaatagcagtgaactggatgggaatcttcgggccgagagaagtccaggcagaggcgttaaaaagtttaggcaaggaaaaggagtgaagggctggacctggtggggtggggtcccattcccaggagagtcggccctgccccagcagcttccagctggagccttcaaggacctggagggggcaggaccaacccctccaccctccctgcccttcaccctcaagttcacctgcagggctgtcttcttgcttactaaggcctgggagagtttaattccaaagcagaggatgatgactggagaaacggatgcctggttgagtcacttctgggggctcagcattggaatccctctgtaacctcccagaagcagaagtggtggcgtccaaggctgcccaggcccctccagtgatgaggagcccagaccctacaacacgcctttgccccctgcacacccttcctgctgacagccccatcccatgctcctccccatctgacccgtgtgtgtgtgtgtgtgtgtgtgtgtgtgtgtgtgtgtgtgtgtgcgccccccacccccgcagacctcccgagacagctctggcagccccacctgccaggggtcaagtgcaattcctctggaagtagcatctttcacatggaaacgttcctttattttcagtagttatggtcgtcagcgagccctcttaaaggagtcaggtgtcctgcttttgttaaaatgacgttgtctcctaactcttagagaagaggaaaaatgtctctgcccagctggcatgctggggcacagaccactgaagccaaggctttggactcgggggttctggaggctggaggaagggagaaggggatgcagcgcagcgtgttgtgtgtgcatagtgctccagggactccagaggagaaaggagtccctggggaagagacatgggtctgcctcttatcctaagtgctttctggtgctccagggagaagtgtttcttgtctgagatgtggcagacatttagaatcattgctcagaactgtctcatcttaaaccttttaaccagaaagtacagaaccattgctccaggggaaatacaagcttgtgagagcttctgtttgcaacatttcattcactaatccatacataaccttgttgtgtgtctgtttctgttgaaagacactttaatatatattattgcttctttaatgtattcaccaccagcaacaccataactcttgcctgaacgcagctcatctaacacacatattttccgcatacagttcattgcagccttttttttttttgagatggagtctcgctttgttgccaagctggagtgtagtggcgggttcaagcggttctcctgcctcagcctcccgagcagctgggatgacaggtgcctgccaccacgcccggctaatttttgtatttttaggagagacagggtttcaccatgtcggccaggatggtctcaaactcttaacctcatgatccacccgcctcagcctcccaaagtgctgggattacaggcgtaagccaccacactcggccttttttttttttttttaagagatggggatcttgttctgtcactcaggttggagggcagtggcatgatcacaggtcactgcagccttgacctcctgggctcaagtgattgcccacctcagcctcccaagtagctgggaccacaggcacacgccaccacatccggctcatcacagcctgtttgtgcttaggaacactagacagccctcaaggtctttacctataaagtagagatgtcagagatgtcagaggcacttgaaccagagcaactccatcttgaataggggctaggtaaaataaggctgagacttactgggctgcattctcagacagtctttttttttttttttttttttttttttgagacggagtctcactcggtttcccaggctggggtgtaatggcgtgatcttggctcactgcaactaccaccacccaggttcaagcaattctcctaccttagcctcctgagtagctgggactacaggtgtgcatgaccacgcctggctaagttttgtatttttagtagagacggggtttcgccatgttggccaggctggtctcgaactcctggcctcaggtaatccacccaccgtggcctccgaaagtactgggattacaggtgtgagccaccactcctggcccctccggttaggcattctaagtcacaggatgagataggaggttgctgcaagatacaggtcataaagaccttgcagattaaaacaggttgcagtaaagaagcaggctaaaaagccatcaaaaccaagatggtgatgagaatgacctctggtcattctcactgctacactctcaaactgtcaacaatttgacaatttacaaatgccatggcaatgtcaggaagttactctgtatggtctaaaaaagggaggcatgaataacccaccccttgtttagcatataatcaagaagaaaccataaaaataagcaaccgaggccgggcatggtggctcacgtctgtaatcccaccactttgggaggccgaggcgggcggatcacaaggtcaggagatcaagaccatcctggccaacatggtgaaacccaactctactaaaatgcagaaaaaattagttgggtatggtggtgcgcacctgtagtcccagctactccggaggctgaggtaggggaattgcttgaacccgggaggtggaggttgcagtgagctgagatcgtgccactgcactccagcctggcaacagagcgagactccgtctcaaattaaaaaaaaacaaaaaacaaaaaaaaaagcaaccagcatccctcagggctgctctgaccatggagcagccattctttattccttcactttcttaataaacttgctttcactttactctatggactcgcccctaattctttcttcctcgagatccaagaaccctctcttgggatctgaattgggaccactttccgggaacagagacagcagggcaatggccagaggccacatgagacagtcagtagtgtatggaggcggcagcaggtgcccagaggcatccccggcccacccccagagcctggcctgacatccaggcctcgcaggcttcaggccaggaccctaccagcaaccccccacccccgagcaccccaggtgtgtatgggtgggtggggcctcccgtcagcccacccaggggcctgtcacacccctgctgcacacagcctctgcactctggactgcatgctggagcccgtgggcatcagagccacgggctgggcttggcaggatgcacctcccagcaacggtgtgctcacttctcctgtcctcccctggctctgatgacactgtgaggcagcaaaccagggtcctgaagggacctctaaagatacagtgtgtgcagggaccctgcccagggtgagagcagctggagctcttgccgtgatcatctcaggctgcccaggtgaaggtgtttccccaacagccctggccacagaggaggccaggcctcttccctgcccaccagtctcatggccctccagccttccctcccgccacctgggccagggccaagagtcttggagggaggttcttattgctaccaggtgacccctgctcctggctggcatggagcaaagtcacccttgctatcaatttaacacagatgaaagatcatgcttgttcccattcccaccacctggacatcctcctctcctggaccctacagcctgcgtggggggtgcatttgcaggaatggaccttgcctccctggagtacctcttggcttacagccccatcctccctggggtctgctatcctactgacctgagcgtgcacactgctgatctcctgacccactgtttaggaaaatcactcctttccaagcctcctgtttccttgcaaatgctctagagcaggggtccccaacccctggggtcacaggaatgggccacacagtaggaggtaaggcgcaggcaagcaaatgaagcttcatctgtaacagctgctcactgcttgaattaccccctgaactctgcctcccatcagatcagcagcggcattatattcccataggagcacaaaccctattgtgaactgtgcatgtgggggatccaggctgtgtgctcacgagaatcgaatgcctgctgatctgtcactgtctcccatcgcccccagatgggaccatctagttgcaggaaaacaagcccagggctcccactgatgctacattatggtgaattgtatagttatttcattatatattacaatgtaataacgatgtcataatgagaatataataataacagaagtaaagtgcacaataaaaatgtaatgcacttgaatcatcacaaaaccaccactccaccctcggtctgtggaaaaattgtgttccacaaaaccagtccctggtgccaaaaggctggggaccgctgctctaaggcatagcagtctttaaccttttggggcaccatggagacttgcatagcctgatgagctctgtggaccccttagaactgctgatgtgtgtcgcttacattcagagatggagaaaatgctaaaccttagtgaaaataaagatgctttttctcccatccaagctcctgagtgccctgaatgccacccatggggaccttggggaagccctaggacagggatgtaggtacagattgacagtccagagctgccatcagggagaagcatttgcaaagcacaggctctgcaaatggggtctacttcctccatcccccaagcctgtcttctgcttcactttgccaagactctgccttgccccagtgttggagcaggatgccagatggcaagatgggcttatgggctgggtcttctgtttggtcgcggcagagcccatggcagctgtaggaactttgacggggaaggggcaggggcgggagcaaacctgtagcgtgaaagtatgtgaacgctctgtcatggagggcaccccaggccgtgtccaggccagcttcaccctgtctctgggagaaggaagcctggtcagagctgaggaggctccagggcaccaggccttgtccctcttgcgcctgggcgtgatgctccccaatggcgtgcgccagtcctgggaccattgctgccggccgtgtgtcttcttccagggtgcagaatcccttgtcaagctgggtggtttgatgccagcccctgggcctcgaagctcccttcctgatggagtgctgccatttggaaggggtaactttcgtggtcatttttttaaatcatggtaaaatatacataactacataacataaaatttaccattcttccttttcttttcttttcttttcagacggagtctcgctctttcgcccaggcgggactgcagtggcgttctctcggctcactgcaagctccgcctcccgtgttcacgccattctcctgcgtcagcctcccgagcaggggactataggcgcccgccaccgcgcctggctaattttttgtatttttagtagagacggggtttcattgtgttagccaaaatggtcttgatctcctgacctattgatccgcccgcctcggcctcccaaagtgctgggattacaggcgtgagccaccgcacccggccaaaatttaccattctttctaaccattttaaagtgtacagttctgtggtattaagtacattaacactgttgtacaaccagcaccactgcccatttccagaaggtcttcatcttcctaaactgtaattctgtgcccattaaactccccatgtcttcttctcccagcccctggcaaccacgattctactttctgtctctgggaatttgacgactcttataattggagtcatgcaacttttgtgtctggttggttttactcagcagaatgtcgtttcatccatattgtggcctgtgtcagaagttccttcctgtcaaaggcggaatgatactccatggcaggtttacaccacattttgtttttccactcatccgtggagagacactgggtgggtccctccttttggctgttgagaatgatgctgctgtgaatgaagtggttagaagggggctttcagacgtgtgaaaggtgtctttgggaattttaatttcagctcccacaaatgagtaaaatttgtctttctgtgcctggcttatttcacttaacataatgatctccaattccatccatgctgttgcaaatgataggatctcactcttttttcatggcttcgtagtactccacggtgtatttgtaccacattggcttcacccattcgtctgttgatgttcgacaccttattattatcgactgtagtcaccctgctgtgtaatagatctcttttcttttttattgatatttcagaattgtgcatattttggggcacatatgatattttgatacatgtatataatctataatgttctaatcagggtcgttgggttattcatctcctcaaacatttgttttttctttgtgttgggaacattccaattctagttattttgaaatatacagtccgggcgtggtggctcatgcctgtaatcccagcactttgggagactgagacaggtggatcacctgagatcaggagttcgagaccagcttagccaacatggtgaaaccccgtctctactaaaaaatacaaaaaattagctgggcgcagtggcaggcacctgtaatcccagctactcaggaggctaaggcaggagaatctcttgaacctgggagacggaggttgcagtgagctgagattgtgccactgcactccagcctgggcaacagagtgagactccgtctcaaaacaaaacaaaacaaccccagaaatacacaattcattatcgttaactataactttcctactctactttcaaatactagaacttattccttctacctatattttttaatccctggtgatctcttttcttatgggagcagtgtgcgccctgatggtgtaaggtggaaacccgccccttgttggaaccaggattgaatatcaccgcacaggagctgaaggttcccacccggcaacgtccccccttggctgtgaagcagagagcccagggctgctcgtttccagtagtcctcctggcagagcaccgctgaggagggtggtgaggggaggagaagatgcattctgcagggagaagcatcatagtgggggccggggactctcctgcgtctcctaattgcccgactgtcatgtgaccgatcagtgcactccgagcattacacagagcagtcatccaaagagaggcagcgcctcacagcccttggctggagaggagaatggaggctggaggctccagaaatttgggatgggaggagaaaaggaaacagaggtgccccttcccctgtcttattgcagggaatcagtaaaacgactactggagttcactggcttctctgaatctttgtagaatttctcctgcacctctgatcccatccagctgcagacacagtgcctgttcagcagggtgtgtgtgcagaccacggactcacagacggggaccctggggaccccaggttctctcccctcactgaggacaagagaggggcccccaccccatgttaatgatgcggggcctgcagggaccttaagttgcattagcatggcatggaacaagagagaaaattcagaacctccagcttgtgatatgcaacaaccaaaaatgtggctgagtgtggccgccttgcaaaggcctgggccctctttaatgggtgcttgctgccctctagtggagagatgaggacggggggtgggcgagcttgctcaaggacactcactggggaagggcggtttgcagacaggtgtcgtgttttggtatatatgtgtgtatgtgtgttatgtgttaggtgctgcgagcatatgaaatgaattacaacgttgttatgggctgtactgtgttcccccaaattcacttgttgaagtcctaagccctgctcccttagaatgtggctgtatttggagacagggtctgtaaagacctgaatgaattaaaatgaggtcattagtgtgggccctgatcccgtatgacgggtcttcttcttcttcttctttttttctataacatctaaagtgagatttatttgtgttaagctttcagaacatttcagaacatttgctgcgactcaggtaaaaataggtaagtattcacagaatatgttaagtctagagttcagaaagttatttcaactaaaataggtcaatcctcacatctgaaatcacttagacattactgatgtatttggaagtgtttctgtatagatattttaggctgacggtgctcagtgctttagggggtcaggtaaacccagttctcgtttgttcagcggtgcctcatttccactacataaagcttgttctccagttccaccaccaatgcctactttacgtgatgttgcactgtgttggtgccatgtaaggtgattatattatgaaaggcctctagaccaccttgttcaaatgtaacagctggtttcagtaattccaggagcaagggaactgtctccaacaattctcaggttgataaatttgattttccaagtattctccacaaaagggcagcaggtgagcccaaaactttgttcaaaaatgcccaagcaagtgttccctcgatgtcccagcagttcccagcagttccaaccatcaccagcccatgaagagaagaagtacatttctacattgggctgagaaaaagaaattcttcttttactagtgacggcaaacggagactcatgatttctgtcccatggtagtccatcccttttttttttttttttttgacggagtctcgctctgttgcccaggctggagtgcagtggcatgatctcggctcactgcaagctccacctcccgggttcacgccattctcctgccttagccttcccagtaggggactataggtgcccaccaccacgcccggctaattgtttgtatttttagtagagacggtgtttcattgcgttagccaagatggtgttgatctcctgacctcgtgatccgcccgcctcggcctcccaaagtgctgggattacaggcgtgagtcaccgcgcctgacctcttttttttttttttttgagacagagtcttgcttggttgtccaggctggagtgcagtggcgtgatctcggggcactgcagcctctgcctcccaggttcaagtgattccctgactcagccttccgagtagttgggaccacaggcatgtgccaccacacctggctaatttttgtatttttagcagagatggggtttcaccatgttggccaggctggtctcaaactcctgacctcaagtgatccacccacctcagcctcccaaagtgctggtgtgagccaccacacccagccagtctatcacgttttgttctgacttgttgtaatagaatctaagctgagtctatcacgttttgttctgacttgttgtaatagaatctaagctggacatcatgctgtggttcccattcatcttgaggtggtcccaggaaagaattgtgagaattaagaagtccaaagacccggtgacagaattctcccaggcaatgaaaatcaaccttttcagctttttaatcttttgcctgctgtcgaaagagctggatgtcctctgtctttgtaactggctctggtgtttccttcaattttggctgtgattgcttttatacgctaaataagactgtgttttttagtaactggaggtataacaaccaccccctggtgttgccaagtacttaaatgtgaccagaaaggtggacgtttttacgcctcagaagttctgcccttggactgtccactaacattacatgaaaggtgctccaaatcctcaaatcagcaagtgctgcccatgacatggataatcccggaagctgcgccattgtcactgccaccacctcctggcgggcccagctgcctaagcctgtgtagtggttccgaaacgggaaaggttcctttgtccgccttgcagggtgtgggatgggggtgtggctcgtttcttctgtgtcctgcttctcccaccgctagagggggcatacagatgggcaggttgtggggctcaggccccacagcagggtctagagatgaatgtttacagctgaagccccagttggcgtatgctactgtttgttcttttagttttgctgtctataggcggcttgtgttaaccagctcaattagaccctctacttgtcgcgtggacagagggctttctgtatcccgggttcttgccttggtgtaccggaagagtcggatcacacatgagcttggataatgggtgcaaggttttattgagtggaagtagctctcagcagatgggggaaccagaagacagatggttttcccctggagtggggcagctgggtggcccagacactcttccgactcccggccaaactccacgtcattccgcgatcagtggcatgcctgtgcctgtgggcgcattcctctcgccagccggccacttgtggattcctccgccagtgtgctcctctccacgtccagccgctcctgtctctgccttgctagggtctgggtttttataggcgcccgatggggcgtggcagcaagagcggtcttggaaaatgtaaggcaggaaatgcctgtcctcacttaggtccgtgggggtggagccttagtaagaaacggtctttgctttgggaggccaaagtgggaggatcacttgagcccaggagtttgagactagcctggacaacacaataagatcctgtttctaccaaaaaaattaaccaggtgtggtgttgtgtacctgtagtcacagctactgagaaggctgaggtagcagggtcagaaaacgccctcctatacccgcacttcccttggcacttcccttacccccttccgtatcatttaaagggaccatgcttctcccttctcagcatttccgtatcagtttcagagcagtggatctgccatggtggcagggattccccaggattctgcctaagcggggtctgagactaactgggttctaggccccgaaccccctccactcccaggctccagtgacctggggtcagcatgaggcttgggaaggagtggctgtgttccatggcacaggtctgcccttacattggtggtctttgggctgcaccaggcaattggtgacggtgctgcacagggccatgaatctcctcattgtccagtagcccaagtaggttacgacagccctccgtctctggagagctgagtcctgacatctcgacccccgggacagagggagaggacgatggcaataatgttgcccctgtggcccaccaggcccgcaccttggcaacacacaccagaagtcatggcaagtgttcttataagaagaagagattaggcctataatcccagtgctttgggaggccaaaatgggaggatcgcttgagcccaggagtttgagactagcctgaacagcagagtgagatcccatttctaccaaaaaaaagttagccaggtgtggtcttgtatatctgtagtcacagctactcagaaggctgaggtagcagggtcacttgagcccaggaattcaagaccagcctgggcaatatagcaagaccctgtctctacaaaaaattcaaaaattagcctgggactatgcctgtagtcccagctacttgggaggcagaggtgggaggatcatttgagccctgcagtgagctacgatcatgcgactgtgctgcagcctggatgacagagcaaaaccctgtctcaaagaaggagaagaagagattaggacccagacaggcacagaggaaaaggaaagaccccgtgagaacgcagggagagaacggccattgacaagccagggagagaggcctgagaaggaccaacccttccagcctccaggactgcaaggagtaggtgtctgttgtttaaggcgcccagcctgtggtacttcatcatggcagccccagcagactaacacacacggattctgtccttcaggagccagtatttgtagataaatcatgactgaatggcagtggtgagcaaaacttaatggcccttgccagcttccaaacgcccagcgctttctgcgtgcaccctcaggcagtggcatcgggcacacaaccattcctagctcaggaaaccaaggggaagaggttccgctgcaggcccgggagcccagccgatcccaaagactaaagacctaagccccgggcttcccagaggaggggcacagccttttgaaagcaagaggaacttctgacaaggtgagcagggtgaggaagttattgattttgattttgatttcccctgaattctctataaaaatagagggggcaaccagaacccaggtagtgaaaccaaagcccatgttggaatttacaacctagtgaggggaggccgcggcctcggggcgaatccatgaggggttggcatgtgtggtggggggagtgctgggggagactgggggacatggcagcgggatggggaggggaagataacaccaagcagaggagaacgaggacgcaaggagaaggagacggcggactgcagaacgagcagaggagcgcaacagatgctggcaggccgcagagaaggggcaccctcctttaagtttaaggacgcaaatttcaaggtcaaatcctatgcaaaggattataagtgtattacaagaaaaaagaaaataggacgaataatgtaaaatggatgaaaactatgccctaatcatcatgtccaaacaaactttaaacaagaaactgatacaagatacgtgacaacatacatacatttctctgaacttaaaacttttaaaaaattgaaaatgaatggcaagaaattaggaaagggttgtaatgaatatttaaatatcatttcagagatgaatattaaacaagaaagacaggagcaaatagacaagggcctaagagaaatagaagttgaaaagaaagaaaatctttgagcataaagaaaagagaaacacgtaaaatctcactacagaccagcgctaacagaagaacatttcaacttgatgacagggaacactagttttgaatcttgattaagcaaaaagtttctcctgtgcacacaagaggaattccaaggataacaagtgttgatgaggtagtgggaaattagaacccttgtgcactgttcatgggaatgcaaaatggtacagtatggggattcctcaaaaaattaaaaatagggccaggcaaggtggctcacacctgtaatcctaccactttgggaggctgaggcgggaggatcacttgaggccaggagttcaagaccagcctgggtaatatagtgagaccctgtctctacaaaagaaaaaaaaaaaattagccagacaaggtgatatgcacctgtggtcctggctactcaggaggctgaggcaacaggatcacttgagccaaggggttcaattttgcagtgagccatgattgtaccactgcactccagcctgggtgacagcaagaccctgtttcaaaaaaataaataaactagaatgaccacgtgatccagcagttttatttgtcagtatgccggaaaggtttgaaaagcaaggtctccaggaggtacctgcacacccatgttcacagcagcatcattcacaacagccaacctaacctgggttgcttggggaggagcaacctaagtgtcagtcaacagaagaacagatgaacgaagtgtggtttatacatacactggaaaatttagcctcaaaaaggaaaggaattctgatacatgccctaatattgatgaaccttgaggtcattatgctcagtgaaataagccaatcacacaaaagacaaataccgtatgattccatttatatgaggtgccatgtgtggtcaaacccatagagacagaaagcagaacggtggttgccaggggctggggaggtggggatggagcattggcatctaatgggacagtctcggttttacacaatgacaaagctctggaggtgggtgtggtgagagccgaatgtgaatgcacttattgcccctgaactgcatgcttagaaatggtcagagtggtgaatgttatgcgtattctaccacaatttaaataacttaattaaaaacaattccattcttctcattagtagacctatcttatgaaaaactgtactcttattatatttgaatttcatcaataaaaattgtgtggaaatgtgtttgtctcttgtgatgtaagtacctacatggtatctccagttttggctcttctcctgcaaggtctgaaacatattctctctggccccgcacagaaaacagttccggacccttcctctagaacagggttcggcatgcggcagatgcccaggaaagagtgaaggaccaagcttcctcccttcttcaccggatccctctggcagcttcgggtccagtgaaagagaacccaggccagtcccttctccgtgagcctcgccccacaaacaccggcctcccttgcctcatctctcgcatcttaaatctctttcacctacgaaccgactcaagcatcagccttagaaggatgccctgggccccgttcctctgtccatgcacatccaggctctaccccgggagttcaaggccaccttcagttcctatatcctgtccctgctctctgtgacctctgaccccacagccccaggtctctaagcgtcctcccacctgagccgctgctcaggccagccccgagcagccctctgtgggtcctgattcccaaagagcatgatcccaggtctttctgggtccctcccaccttgccctacttcatgcttccgtgcctagccacacccctgcacaacctgtgatctggcctcaggaaatctgtttctcatgtctgctgtataggcttggctgcccatggcagcaggaagaacctcgcctcccttgctcacacagcaaaggcgtttaggcctcatattggggaagcccagggtgggaggcccctgactctttggacccatgacgacatcaagagtatcttcgtatctgtgctctgccatcctcagctggctttcctcagctgccatttcagtcttcacaccagatgtgatggtgtcccaggaagaagaggccatctcttcccatggctctcttcgtcaatagagagtacattctagaagccccgtggtaggcttccctatggcttgcacaggactgaatcacagaactgtgtcctcagcagtcactggcaggggacaggggtcacccgaactgggtggaggcccgaacctgacacccctgagctgtgctaagcagagggctcctgaacagaattgagattgaggccacagggccaggctgactccctcctgccccacgtgctctccggtgagaccctgcttggtctgcaaagccgagctcgatgccctccctacctcttctctcctaggcctcatccacggccttgtcttgggccagacagccatgtgccatgtctgtcctcccatgcagcatctgcaccgtgggggtggggggggagattctctgccacgttcagcacctcaaaggcagggggtgcatttcactcagctctgcatcctgtgcaccctcagccatgccggcagagcatgtgtggggaagggcccgagggaccccagggaaggaagagcactgtgtctgcatccagaagaaagttctgaaaaaaatgggaacctctgtgactacaatgaacttgtaacaaaagcaatgactttgctcttccaggaggcacaaaaggagccccaggcagtgcgcaggacccccaggcagtggtcaggagccctgggcagtgaggaggagccccaggcagtggtcaggagcccagggcagtgaggaggagccccaggcagtggtcagggggcctgggaagcagccaagagccctgggcagtggacaggaagcccaggcagtggccaggggccccaggcagtgagtaggagccatgggcagtggccaggagctgcagcgtgccagtgttcgctctggcactcagtcagggacatctggaccagcatcctgcatgggctgggtctcaggctccttgctccatgaattagcagaatctcaggcacctgctcttgaatatgggaaggtgacatagcacttctagtaggtcttttcctaacctcttccctttgcagttattctttttcaacctaagcatgccaggtgatgaccttgtgattctcctaacatacaaatggcaggcatggaatagttcctacccagggtgctgtgctggccaaggcttttccagcttggagcagacctcatgctcagccaggagactgcccacggccttggtgagttccagagtctcctctccctgcaggggtgtcttcaggagcccacaacccagcaagtccctcttcagtgaaatgtgcgggaggaggcactgcaaggccccaggcctccaggaagccggaaggtgctgatggggtgcaaggcagggcagggctgggggagggggggcgcaaggttcacagaggcagtgagtggagttctgttaacagggaaatgaattaaaatatgtggtgcgtggactttgggtctcgaggcccagaaagctgaggcaaggtggcctgagtcaaatggacagggattgtctgcccaggagctggttcagccgacatcagagatcatctgtctgcacaatggcctgctagtaaagattttcaagttgttcacacgtgttacccttgagggtttagaaacattccctgggcactcccagggtgctcagacagatgctgtggactggtggccagtgagcactaatcatgacttttatttttctttttgagacaagggtctcactttgtcacacaggctggagtgcagtggcacgatcacagctcactgcagcctcaaactcccgggctcaagtaattctcctgacttagcctccagagtagctgggactacaggtgcataccaccacgcccaactaattttctatttttagtagagatgaggtctcactttgttgcccaggctggtctcgaactcctgacctcaagtaatcctcccatctcggccttgaaaagtgcttgaattataggcatgagccactgcacctggcataatcatgctgtttatatgttatgatgttttgatatcttgggaggccaggctggctgggaagagactgtccctcccagagacagctaaatcctacagatgataaacaacttgcctgggagcctgtttattcacatgcagaccaacccatcccaagtccatactcccaaccaccccctctatctaactcttacaaccaagccattatttcctgggccctgaatcccacagggccaggcagcaggcactagggatggccctataccctggccagccagccttattcagaccagctggtcctgagctgttcacctgccccaccttgaaaggctctggtctcagctttccctgtctcctctctgcttcctgacccaacctgggtcacccactgtggccttgtgggtggggtgagtgtgcccctcctctccagaaatacgaataatgaagtctttcagtggcgctggccactctctgtgggtgctgacacctctgtaagttaaactcccataggcacgatggagacgccttgtgactcagctcctcagtgccaacacgggctgccccgtcggccacagcgcggccaaagagcccagagagcgttagtatctgtagccaggcccctgttgccaccccagctctcccgtaacctcacatgcatggcgctgctctacttcacctcagaaaaaggacacacatttacgttccattttttacttcaaataattgtttagattgtggtaaaatacatataacacaacattggccatttgaaccaattgggtggcactaagcacatccacagattgtgccaccatctccaccatccgtctccaggacttttcaaccgtctccaccatctggctccaggactcttcagcttcccaccacaaactatccccatgaagcactcattccccatccccattctcctccccttgcccctggcgcctaccattctatttctgtctccgtggatttgactcctctagggtacctcatgtaagtggaaccatgcagtatttgtatttgtctttctgtgactggtttatttcactgagcataatgacctcagagttcatccctgttgtaacatgtgtcacaattccttctttcttttttttttttttttttttttttttggcaaggtctcactctgtcactcaagctggagtgcaatggtaggatcatggctcactgcagcttcaaactcctgggctcaagagctcctcctgcctcagtcttcccagtagctgggactataggcatgcaccaccatgcgtggctagcattttatttttgttgagagagggtctcgctaggttgcaattctcccatcttagcctccaaagtgctgggataacaggtgtgagccactgcacccgacccagaatttcctccttttgacggctgagtgatgttccattgtccgcacacacacattttgtttatcctttcatccattgatggacacttgtgttgcctccacctactcgtagcaccctggctgttatgagtagtgagtgcactatctcttgtgtgcagttgtctcatggagaccttgctttcctgcctgtggcgttagtgcaggtggcaggcaggtcggtgggcaagcaggtgtgccctgtggatgacgagaagctttttctgcttaaagccctgcatggatcaaaagttggaaaatatatttgatttttacaatttgttcaaaattaatcaagcaaacactgattttcatgtattttctgagatctctgctataaaacagaaaaccaccaccctctttccagggaagcatcttcttcctggctccctccttcccttcgggccatggcggcatcctcggatcctccctagcccattcatatcacacggcttttcctcctctgcatctcgataccactggctcctttgggaggttcctctgagccacccatgcgcggggtgggttgtcatgaaaagtcaccagttccacctccagccagaagtcccacaaaagcgaagggcactgaagacaaaaccacccttcccttctctaaaggaggaggggcggtgcttcagagggtgtcccccaaacccgttctttagagcagggtccccaacccctgggctgcggagtggtacaggtctgtggcctgttaggaacgggcctcagagcaggaggtgtgcggtgggcgagtttaccgccgagctccgccccctgtcggatcagctgggcattccatgctcatgggaggcaaactctatcgtgaactgcgcatgtgagggatccaggtggtgcgctccttccgggaatctaatgtctgatgatcagaggtggaacaatttcaccccgaaactatcccccacccaaccccatcggtggaaaaattgtcttccacgaaaccggtccctggtgccaagaaggttggggactgctactttagagcatgtcctcggagtggaggtacctgctctccacgcagtacagcatctggctgtgtggtggctgcagtccagtgggtctgagaggggtggagggggaaggtggagaaggagaggagggaggaggggagggagggaaaggtgagaggggaagacgaagggaaggagaagaggtgggggagggggcaggggggcagcattggccaggtaagggcgtgtccactgtgaggcaccgtgggattcctgggcgaggactgtgagacactggtgagcgtgtgtgcagggctctttcgggcttcctctgtttttaatgacatcagagtgcgtgccatgcatggggctgtcctggtgttggcactgaccgcttggagcccagctgctgccccctttctcaggccacagatgcgcccaagagcagggtttgtccaggcccgcctgggcccgctccacgccatcctgcagtgcccacgcagcagcggtgccaggtcttccttcagcacccatgcgtggttacctgtggccgatgtggcaggcgtgtagggtgtgactgcagaactgcatggaccaagcaccgtctgcctcctaagggagcaatgggaccgaggaagtgggccccatgttggccttgaccagctgtgcccacctccttttgggaacagatgtgccaagaacaaccaggctaaggaaacgtggctcgcacaccgggagccctggggaaagactacaacgatccttttaataatactttttactgactgtagtcatagtgtaataatttcagaaaattcagaaaccatagaaaagtatacagaagaaaattaaaattacctggtgcccccaccaagccacagtgatcattgttcaagcattaacaaattttcctggattttggtaaacagatataagtgcatattttaagtggaaatattctatatttagttttgatccttgttttcatccctttaaaaggatttttcatattattcaatcatctcctaaaatacagttaccagtaactgccttcattccattagatgctgaaatggatttaactgttctctggtggttagtcatatattcttgtttctttcttctttcctggtatacataatattgggaacatcttggaacaagatggctgtactcaattattgaaattcctaaacgataaatgactggaggagaatcctggatcaaggaggggctcctggaagtgctctgggccctgctggaggcacaggccttggccacaggccaccacacataccctttggaaagagactttgccattgtgatcggccaaaaatgaaacctcactttattttattgtgagacagtgtctcattatgtcacccaggctggactgcaggctcactgcagcctcgacctcctgggctcaagagatcctcccacctcagcctccctagtagctgggaccacaggtgggcgccaccatgccaggctaattttgtattttttgtagagatggcatttagccatgttggccaggctggtctcaaactcctaggctcaagggattcgctcatcttggcctcccaaagtgctgggattacaggtgtgagccaccacgcccagcctttttcacttaattttgaagcttggagataagttttatataggcccatatacggctgcctgaaacctcactttaaaactaggtatatttgtttgctgcctgctgaggctgagtgctcattgcctgttgcttggctatttgtaattgtcttttgtgaattgctttttcttatcatttgcccatttttgtactggaatgtttacctcttcctggctgatgtgcaaaagctcttcaattcccttgtcatatgccttccagcatgttatcatggcctttgcacgtctatgggtttccatggccagacctctggcttcttatcttcacggcatcacctttgctcctatgcttagacgatgcttgcacatttgagggaaagggagcattttcctgtttttcccctgtatttggtttattacatttggctcttaaatccggtggttcccagttaggggtatgcatcagatttcccaggagggcttttctaaccataagtgcctgcctcagtccatccagatcttcccatcagcccccagggtggggcgggtgatggcgggtgggggtacagccttgttttggaaaaagtgccatagatggtgcagatgcaagcctctgattatgggcttcttccttctgccacatgtgtgatgtaagataaggatgctatttttattggcttatattttaagaatagctgattgcacaagtatatttattgtgcaaacgtgccttctttccccactcagtgacattatatctaaaccaaattctcaattataacacgggaacgtttccctttagcctgcgaagatccagtgtctcggttatggtgtttctggttccccggccacttggaagacacctggagctctgtgatcttggtggggacctcaatgtcagccgggacctcaatgtcagcagaccctgtgtccccagtgtggctgggctttgctagacctgtggagcaatagctagtcaggcttgtggccccaatccagccagcatcacacactgtccagcctccctctgacatcagcataggtctaatgtcagcataggccctctgccgcagggctgtgcccaaggacactctcctgctctgggtcctaagggagggaggatctcaggagaggcctctcctcatccctggcagatctctcaaaatggcctgcagccgggattccagacacctgagctggtgtgagcccactccccaccgctggctctcaggctggagtggggccaggatgtcactgagctcctcagagtttgcagaccatttgcccctcagctggacccctggcccaccagggacttgagcaaagctgttccatcaacgcaggggaggtgagaccacatctaatcaggggtctgatgtacacacagcaccatcaccatctcagaaaggttcatcacccaagcacaaagaagctggacttggacatctgacagcaaagcatgacccattttatgtgaggcaacgagtctgaaagcaggtaaccgggacacccaaaagctgaaagcacagaggggttggcgaggagtgcctggacctctccctccccaggggtgtcttcctgtcagagttatgcatgctcttgccagagagggcaagcttgacagccaactgccgcttgatcagcctgcccctcctgcctcacctcctgtgcctcagcacgtggccatgtccccatgcccccccaaatctcgcaccctctccaccgcacagagctctgtcttaggtccccaagggccacatgggcagcctgagtccttcccttacttcgcaggtttttccacagcactggtgttgattgctccctcccttagggagctctctcctgactctaagctctcctctcgagctcctgcctctcgctccctggctgggcacctccctttcctctctgagatgatgccctccagggctctttctctgcagctttcctcactcaaagtgttttcattctttcccagggccttgcctctctttttatatgggggccccagaacttgtttggagccacagacctgttgtccccgctgctctaggggcctctgcaattgggcacacatagatctttcccagtttactcccaccccagtgagcggtcccacagcctcctgctgccttcacaggcatctgggggcacacacattcatgtggtctgacggcatctcaccttgcacttcttcctgctcgcctgttggaggtgccacagaggcccctccatgccacgacctgtggctgagtaggtttccacacttacttttttttttttttacagttttattcaggtattatttacttaactccaaatacacccattgtattgagtttcagtaaatttatagagtcgtgccactatcccctcagtccagttttagaacatttctatcacccaaaaaacattttcttgtgcctgtttgcaatccccactctctgccccacccctggctcaaagcagaccccgatctgctttctacctgtagatctgccccttcaggatcttgaacatttacttttcgccagttcactgcaagaggttgagtctcagcaagagtaaggaatggctccggagaggtgacaccagctaaatggtggactaaggacctttggaaattctctcctccagaaacttgacgacaatgctggcaaaaaatcatcataatcagctgtttcaaaactctggaaattaaccaaaggcccacagaaatttagggaatgcttattcaagaaaaacagctgactttcaataagaacaatggacttcgtggtgttttgtgggtttttttttgagacaggttattgctctgtcccccaggctggagtacagcggtgccataatagctcgccgtaacctggaactcctgggatcaagggatcctcccaccttaacctcccaaaatgctgggactgcaggtgtgaaccaccacgacttgctaatttttaaatttattatagagatggggtctcactatgttgcccagactggtctagatctcctgacctccagcaatcctcctgcttcagcctcccaaaatgttgggattacaggtatgagccacggtgcctgttctgtgtgatgttttagcctgcactgttctcatcattctcccctcagctccacaatggtcttggagactaacagcccaccactatggtgaaaatgaacatatggcagctgctgaaaggtgtagagagggttggagccccatttccacagaattgtcattatttgaccgctctggtggttccataaagaccccacccacaagactttctttatttgatcggacttgggggatgcccagtataaagagctgtttccctaggagcatttgttgaaaacaaccagaggtgattgttgtatatcatggttgcctgaggtggtgtataacagttggagcaaataacaagctaacccagatatttaaaaggaaaagctgggaaacaagatgtctataggggctttgacaagctctgacacattcttgggcatctagaaggccatgtgcagggatgagtgtatactcaggagaacctcacctctcacctctggctaaccttgaagctctgcagaagtgggaagtaaaaagtaaggtggagttgccaactgcttggctgagggtcaaaagtgtgcccctacccatacacagagcccctcggcaaaggctaagagacatactggttccaggtatctaaaaatatttgtgtccagtcatttagctgcccattaagctaactgaatagagacttcagtagccacacacaaaaacaaatacaaattttacataattagcccaggaaagtcactgaacaaacaaacagcaacaaaccctggggaggagggggtgcaggaatctgatttccagagttgccatgttatattattttaaaatatcagtttttaacaacaaaaattatgagacactgtccatgagaaagcccagattgttggattcaccgtacaaacaccttaaatgaactgcttttaaatatgttcaagaactaaaaggaactatgtctaaagaactaacaaaaaatatgagaatgatgtcttaccaaatagagaatattaataaagagaataatttttttttttttgagatggagtctcactctgttgcccaggctggagtgcagtggtgtgatcttggctcacttctgcttcccgggttttcaagcgattctcctgcctcagcctcctgagtagctgggattacaggcatgtgccaccatgtccagctaatttttgtatttttagtagaggtggggtttcaccatgttggccagactggtctcaaactcctggcctcaagtgatctgcccacctcagtctcccaaagtgctggggttataggtgtgagccaccatgcccagccataaattatttaaaaaacaaaaagacattctggagtgaaatgtatgataactaaaataaaaaattcaccagagaggctcaacagcagatttatggccaggcgtggtggctcatgcctgtaatccaaacactttgggaggccaaggtggatggatcacctgaggtcaggagtttgagaccagcttggctaacatggtgaaaccctgtttctactaaaaatacaaaaaaattagccaggcatggtggtgcatgcctgtaatcccagctacatgggaggctgaagcaggagaatcacttgaacccgagagttcaagagggcagtgagccgtgatcacgccattgcactccagcttgggcaacaaaagcaaaactctgtctcaaacaaacaatcaaaacagcagatttatgtgggtagaaaaaagaatcattacacttaaagaggtcagttggggttatctaaggaatagaaagaaaataattgagtctgaaaaacagaaagaacaggatgaagaaaaatgaacagagttccagagacctgtggtacaacaaccaagcataccaataaatgcataataggagtgccagaaggaaaggagaggagaaagggataaaacaatatctgaagaaataatggctgaaatttttgataaaaaacatatatgtatagttcaagaagctcaagaaactccaagtggagtaaactgaaagacatctacacctagatgcatcataatcaaactgtcaaaaaccaaagacaaagcgagcatctcagagcagcaggacagaagccacttgtcacacacaatagagcctcaataagattgacagctgatttctcaccagaaactatggaggccagaaggaagtgacatattcaaagtgctaaaggaaaacaacaaaacaaaacaaagcaaagcaaaacaaaacaaaacactgttaaccatcaatctatatcagccaaaactatcctgcaaaaatgaaggagaaattaggacattcccagataaacaaaaacagagtttctcattagcagagcagccctacaacaaatggtatcggccgggtgtctttcaccctgaaataaaaggacattaggtaatatttcaactccaaataaagaaataaagaactccaagaaggataaccacataggtaaatatcaaaaacagtataaatgtatttttatttgtaactatttttttctatctaatttaaatgacaactgcataagcaatcattataagtttaggttgatgggcacacactgtagaaagatgtaatttgtgctactgtggcatgagtggaggacacagctatacacgcacacacacattcatatatatataagaaatttctatttctcagtcatttgaagataattaaatggtacacatttaacacaaaagaagaagtggagaaatgaacaaaacagacataaggcatgtacaaaacacataacaaaatggcagataatcctattcaagagtaattacattaagtgtaaatgtttaaagagcccaattaaaaggcagaaattggcagaatgaatataaaaacaagatccagttatatgttctcccaagaaatataccttagatttaaagacacaagtatgttgaaagtaaaagaatggaaaatgatataccatgcaaacagtacccaaaaaggagctggagtggctatactaatattagacaaaataggttttagcacaaaaaatgttactagaaacaaagtgggaagttttgtaataataaagggtatattcatcaagaagatataacaatgataaacatatatgcacttagcaacaaagtcccaggatacatgaagcaaaaaatgacagattaaagagagaaataaagaattcaacaataatagtcatagagttcaagaggtcattctcagaagttcaacaagaaaatagaagagttggccaggtgtggtggctcacacctgtaatcccagcactttgggaggctgaggcgggtggatcacgaggtcaggagattgagaccatcctggctaacacggtgaagccccatctctactaaaaatacgaaagaaaatcagccaggcgtggtggcaggcgcctgtagtcccagctactcaggaggctgaggcaggagaatggcgtgaacccaggaggcggagcttgcagtgagctgagactgtgccactgcacttcagcctgggcaacagagtgagactccatctcaaaaaaaaaccaacaaaaaacaaacaacaacaacaacaacaaaagaaaatagaagagttgaacaatattataagccaactataactaacagacatctgtagaacactccacccactagcagaatatacattcttttcaattgcacatgaaacatcttcaggatagaccatatattaggccataaaatgagtctcaataaatttaaaaggactgaaatcatacaaattgtcttctcaaatcacaatggaataaaattagaaatcaatagcggaaggaaatttgggaaattcacaaatatgtggaaattcaacaacacagtaaccaatgggtaaaacaagaaatcgtaagggaaattaggaaatactttgagattaaagaagaataagacacagcctaccaaaacttatgggatgcactaaaatagtgcttagagagaaatttaaagctataagcacctatattagtaaacaaggaaaattcaatttaataatataaactttcaccttcagaaactagaaaaggaagagcaaaccaaaaataatgcaagtggaaggaagtaaaaaatacagattacagtggaaataaattttaaaagagaaaagaaaataataatcaataaaaccaaaagttgacttttcaaaaaagatcaacaaagttgacagccttttgctatactgactaagaaaaaaagtcagactcaaattactaaaattaggaatgaaaaagaaaacatcaccaccaacattacagaaaaatgattataagggaatactatgaacaaatgtatgctgtggcaggtggcataatgttcccctaagatgtctatgtcctaatccctggaacctatgaagatgttaccttaaatggcagatgggattttgaagatatgattaagttaaggatcttgatatgggagtcttaacttggattatctggatgagctcaagataaccacaaggattcttacagacgaaagagggaagcaagagggttagagtcaaagatttgaagatgctatgctgctggctttcaagatagagaaaagggtcacaagccaaggaatataggtgacttttagaagccagaaaaggcaaagggacagagtctatcctggagcctccaaaaggaatgcagccttgctaacaccttgaatttagctccttgaaatccattttggatatctgacctcaagaactacatgatattaaatttgtttggttctaagccactaagtgtgtggaaatttatcagtgcaatagaaaactaatacacatgccaacaagttagataaactaaataaaacagacaaatttctagaaagttagaaacttctgaaactgactcaagaagaaatagaagatctgaatagaactacaagtaaagagattgaattagtaaaaaacaaaacaaaacaaacaaaacttcccataagcaaagcctagggtgagatggtgtcactagtgaattctaccaaatgcttaaacagtatttaacaccaatactttacagactcttccaaacagtaaaaaagaagagaacatttcccaactcattccatgaatacccacaaaacaatgccagacaaaagcacacacaaaagaaagctataagccaatatcttttaagaatttaaatacaaaaatcttcaacaaaatactagcaaacaaaacccagcaacatatacaaaggattctgtactatgagtcagtagcatttatgtcaggagtgcaaagttggtccaacaatcaatcaatcaagtcaatcacattaataaaaagatgggcaaaaaaacacatgagcatattaataaatgcagaaagcatctaacaaaaatccatcaatctttcatgataaacactcaacaaactaggactgtaagggaatttctcaacctgataaaaggcatccataaaaacccccacagctaacatcataatggtggaagactgaaagctttccccctatgatcaagaacaagacaaagatgttcactcttactacctctattcggcattgtaatagaggttctaaacagggcaattagataagaaaaaccacccagattataaagaagcaaaactatttctatttgaaaatgatgtgattttgtataaagaaaatgctaagaaatccaaaacaaaagaaaacaattactaataaactagttcagcaaggttgcaggatacaagatcaatatacagaaatccattgtatttctatacagtagcaataagcaatgtaaaaataaaagtaagaagataattcgattataatagcatgaaaaaaataaaatacttgggataaatttaacccaaaaagtgagagacttgtacaaaacattgttgaaagaaattaaggaagacccaagtaaatgggaagacatcctgtgtttgtggattagaagatgtacagttggccaggcatggtggctcctgactgcaatcccagcattctgggaggccaaggtgggcggatcacttcaggtgatcctgaagtggtcaggtcaggagttcaagacctgcctgaccaacgtggcaaaaccccatctcgactaaaaatacaaaaattagccaggcatgttggtgggcgcctgtagtcccagctgcatggcagactaaggcagaaaatcgcttgaaatcaagaggcagaggttgcagtgagctgaaattgtaccactgcactccagcctaggcaacagagtgagaccgtgtctcaaaaaaaagaagaagaagaacatgtacagtagacctttgaatgatggtggcaattcggggcacaggtgaaaatccgcatataatttttgactccccagaaacttaactatgactagcctactgtttcctgaaagccttaccaataacataaaccatcaattaacacatattttgtatgttatgtgtattgtatactgtatgttacagtaaagtaagctagagaaaagaaaatgttattaagaaaatcacaaggaagataacatatgcttcctattcattaagtgaaagtggatcatcataaagatcttcatccttgctgccttcacatccaaggaggagaaggaagggtggggttagccttgctgcctcaggggtggcagaggcagaagaaaatgtgttcatatgtggacctgtgtcattcaaacctgggttgttcaaggatcaactgtaataatgcaatactccccaaattgatctacaaactcagtgccacctgacttctttgcagaaatgggcaagctgatcttaaattcatatggaaatgtaaggggtccagaataacaaaaacaatcttgaaaaacaaaataagagcaatgttgaggactcacacttgctgatcccaaaacttgctacaaagctatagtgagggagacgatgtgacactggcataaaaatagacatataggccgggcgtggtggctcacacctgtaaccctagcacttagggaggccaagatgggtggatcacctgaggtcaggagtttgagaccagcctggccaatatggtgaaacctggtctctactaaaaataaaaaaattagccagacttggtggtgtgcgcctatagtctcagctacttgggaggctgaatcacttgaacccgtgaggcagaggttgcagtgagcaaaactctgtccaaaaaaaaaaaaaagaaagaaagaaaccccatctctactaaaaatacaaaaattagccaggtgtagtggctcatgcctgtaatcccagctactcaggaggctgaggctggagaattgcttgaacccggaaggcgaagattgctgtgagccgagatcgcgccactgcactccagcctgggcaacagagtgagactctctcaaaaaaaaaaaaaaaaaaaaagacatatagatgaatggaatggaatttagagtctagaaatagaccctcatatttatggctaactgagttttgataaggatgccaaaaagacttaatgggggaaagagtattcttttcaacaattgtgctgagacaactggatatatccacatgcaaaagaatgaagttaggctccacctcataccatatacaaaaattagctcagaattgatcaaagactaagtataagaactaaaactataaaagtcttaaaagaaaatagaggtatgaatcttcacgaccttggatttggcaatggtttctaagatacgacatcaaaagcataagcaaccaaaaaaatagataaatgataaattattaaataaattatttaaaaataaaagtattcattaaatcaataaatgtaaatacttttatgcttcaaaggactctataaagaagtgaaaaagacaacacaaagaatgggagaaaatctttgcaaatcatacatatgtaagtccctgatggaacttgtaactagaatataaaaataacttttgcaactcaataataaaaagacaacacaatttaaaaatgtacaaaggagctgagtgtggtggctcaggtctgtaatcccagcactttgcgaggctgaggtgggaggatcacttgagcccaggagttcaggaccagcctgggtggcattgtgaaatcctatctctactaaaaatatatacacacacacacacaaaatagctgggtgtgatggcacacacctgtagtcccagctactcaggaggctgaggtgagagaatcacccgagcctgggaagtaggggctgcagttagccgtgatgacatccacactccagcctgggtgatgggagtgagatcctgttttaaaaaaaaaatgcacaaaggacttgaataggcatttctccaaagatatgcaaatggccaataagcacatgaaaagatgctcaatgtcatcagccatccgggaaatgcaaatcaaagccacaatgagataccccctaggatgatggctataatcaaaaagatattacaataataagtactggcaaggatatgaaaaaactggaaccctcatgcactgctgatgagaatataaaatgatgcagctgctgtggaaaacagtttggcagttcctcgaaaagttcaacattgagttatcacaagacccagcaattccactcctgggcatatacttaaaagaattaaaaatgcgtgtgggacacagtggttaacacctgtgatctcagtgctttgagaggcaggaggttgacttgagcccacgagttggaggctgcagtgagctacgatcgtgccactgcactccaacacaggtggcagagcaatatcctgtttccacatatatgtttataaacatatatacataatagtcaaaagatggccatcaactgatgagtggattaaaaaaacgtaaaagatccatacagtggaatattatttagtcataaaaaggaaaggcccaggcgctacctaaaatataccaagccccaggtttacatagggccccaggtcacactaggctctaggtagacactggactctaagtagactttaggccccaggttcacagccacacctcaggaggataccacaccccaggtagctgtaagactcaatccagacaccagtcccccggtggagaatctacgccccagctggacatcaggttccaggtaaacaccaaggcccagttgggtttactggatccattggtggacatcaggcaccaggttggcacagagcccccacatagatatctacaccacaggtggacatgaggccccaggtacatacccagtccgcaggtgactatcgggccctaggtgaacactaggtcttagatgaacttcgggacccaagtggatacccaggcccctggggaacatcaggctccaggtggacaccaggacccatgtgggcaaccaggtccagaggtacatcaggttccacataaacacccaacctccaagtggatactgagcccccaggtgtacacaccagtccctcgacaactgaaaggtcacatactctcaggccaaatgcaatagagtcatctctcccaaaaatatgtatttgggaaagcgaaaactacacttctcaatcattctcaagtcaagggactcttaatagaaggccaaatacacactgaaagaaccaaccatgaaattcccacatccaacaggagtgcaatgctgctcaactagtcccagagcaagacccaccacaggctttgcatggaggacacacagattagaagggaagaatggaaatgtgggacctgagattgcaatacaagaaaagagaaaaaggcaaccgtgcataccaagaaacccaagaaagaaagggtgacgtggagaaataactaacccaggcccagttttccaagaaacattagaacccgcactgcgaatgaagtggcaggccgaatcgagccctgtctagattttcaggtgtgggtctctcctagatgacttaaaagcctacaaattgctgaggtcaccctgactatgtccgacccaccttgcagaaattcaccactgggaaaagacacccaaaccaatgcagttccggagcttaccttggagaagcttcctgcagtccctgggtgccactggctggctctgcggctttcttggagggcccgcggcctcagcccggctccctccctcagctctggtgcgtggccgcagatgacccgagcggcctgggcttgggcttctggtgccctcgaggagccgccctgtgtgctcacacaggctcctggcggcgggcagcacagcactctcacttttggtcaccggtcctttcccgagggcagtctggcggggcacggctccagggccccgagtccagcacctccctgaaatcttcacgccacaggcaaagcagtagggcaacttacccaggctctgcctgagccaagatggcgccttcctcacagcctgtgcaggagggcgaggtcccagatgatgaggcgcgggacaagggcaactcgccacccattcttcccagaaagagggcaggtgcatgggggcacaccccctacaggtggacataaggccccagtggacaccgaggccacgggaaaacatcaggccacaaatagacactggacatcagacaccaggttgacaccaggacctgggtggacaccaggtctcaaggggcctccagtccctgcacagacatcaggccccaaatggacaaatcaggtcacagtttggcacataggcaggccccaggtggacaccaggccacaggtacataacaggccccaggccaaaaccaggtcccagaaggacatcagacatcttagtgtatgtcaggtcccaggttgacatataggccccagtggaacaccaggccccacttgccagtttccaagtggatatccagaccccaggtaaatatcagcgtcaaggtgaacaggaggccccaggtggacaacaggcctcagctagatgcctaggcccctggtgaactccagccccctgatgaacattaggccccaggtggacaccctggccccacgggaacatctagttccaggtggacatcagacccaaggtaaatacccatccccaggtaaacgccagaccccaggcagattacaggtcccagaaaaacacccaggtcccatgaagaaatcagaccctaggtgaactctggtctgcagggggacatgaggctgggtatccacctgggacctggtgttcatggggtgggggccgatgtccaccttgggcctgttgttcatctgtggcctggtattcacctgggccctgagagtcaacctggtgcctgatagccacctggggcctacatagccacctgggggcctggtggtcacttgaagcctggtgtcctcctggggcctgttaccaacatgcggtgtaggtatccaccaggggcctgatgtccacctgaggtctggggttcacctggagccttggtgtcaccctggggactaatgtccacctggagcgtggtatccatctaaagcctgtggtctgcctggggcattattatgtcccttgaagactaagtatccaactagggcctgattttcacatgaggcctgggtatctgcccgaagccttggtatcctccttgggcctgaagtccatctgtgacattctgtccagctagggcctgggtgtgaacctggtgcctgatgtacgcctcaagtccagcgtgcacccacctgggacgtgatggccacctgaggccatatatccacatggagccagggtgtccacttggggcctaatgttcaccaggaacataagtatccacctggggcctcatgtcttcctggggcctgggtgtcaatgtggggcgtgggcatccacctgggggctgatgtccacttggagcctggtgtctacctggaaccaatttttcaactgggaacctgatgtccacctggtgcctgatgtccatttggaaactggagtccacctgggaactggcatacacctaagacatagtgttgagccggtgtttgatgtccaatgttcaccaggctccaggtggacaccgggcctcaggttgacacccagactccaggtggacaccaggccccagatgaatgccaggtccccggtgaacatccaggccccaagtggaaaccaaaacctcagatgtctaggcattagaccccatgtggacatccaggccccaggaagtcatcaggccccagtggacactcaggccccaggtggacatggagtcccaggttgacacccaggcctccagtgaacagcaggccaaggagaattccaggcccagcaggccccaggtggacagcaggatccaggtggacacaaggcccccagatggatacataagaccctggtgaacatcaggctccacatggacacccaggccctagaagaacaccaggcctcgcgaggatacgaaaattcaaataaacactaggccccaggctgaaatcagttccaaggaggacactagacctcaagtgacaacctggccccaggtggctatgtgggccccagctggacggcaggtaccagaattgacatccagggcccaggtaaacaccaggccccagaaggataacaggcacaaggtagacataggccccaggtgcacaccagatcccacgtggatatctaggacccaggtgaacaacaggcccaaggtgagaatccggtctccaggagggcaccaaggcccaggcagacaccaggtcctaagaggacaccaggatacaaatggacaccaggcctcgggtggacaccaggctccaagtggacatcagcccccaggtgggtatctggccccaggtgaacacccagtctcaaggtagacaccaggccttaggtagacagtagccactgggtgaacactgtgccccaggtggacaccaggtctcaagtagacacccagtccccaggtgggcaccagagaccaggcagcctgatgagtccccaggtgggcaccagagaccgggcagcctgatgaggctccaggtggacaccagagaccaggaagcctgatgaggctccaggtggacaccaggctgcaggtggtaccaggctcccagctgatacccaggccccaggggaacacccaggccccaggtagacagcaggaagccagtgcaccctaggcacccaggtagatactaggcccctggtgaacatcgggcctcagctggacacccaggccccagggaaacacccaggccccatatgtcaggttgttaggtcccatatggacaatcaggccccaagaagtcatcaggccctggtagacactgagaccccaggtgactatccagtcccaggctgacacacaggcctcaggtggacaccgggccctaggagaactccaggccccagctgaagatcaatgccccgggtggacacccaggccctagctaacgaccagtccccaggattccatcaggccccaggtggatactaaactctcggtggacatcagcaaatgcccaggtcccaggtcaaaaccaggcccctgatggaccccctgaccccaggtaaacatgaggtttcaggtggacacgtgactctaactggatatcaggccccgggtggacacccaaccccatacggatacctaaacccccgatgaacatcaagtctcgggtgcacctctaggtcccaagtaaacacctaggcctcagaagtccagacatcgggccccatgtggaaatccgggtcccaggaactcctcaggcaccaggaaacactcaggcctcggttggatatctggccccaagttgacacccaggcctcaggtggacaccaggcgctaagaaaacgtcaggccccagctgagatcaacccctgggtggtcagtactggcgcatgctaaaacatgtatgagccttaaaaacatcatgctaagtgaaagaagccaggcacaaaaagccacatagtttgtcattccatttacatgaatgtctagaataggcagatccacaagagacagaaagtgggttagtggttgccagaagctggagacaggggagaacggcgagtgactgctaatgggtacggaacattattgggaggtgatgaaaatattctggaattacatagtttatgatgtggcataacatttaaaatatgctaacaacgactgaattgtacgctttaaaaaggtgagtctttttctttttttgagatggattctcactctgtcgcccaggctagagggcagtggcccgatctcggctcactgcaacctctgcctcctgggttcaagcaattcgctgcctcagcctctcgagcagctgggattataggcgcccgcagccacacctggctaagttttgtgtttttagtagagacagggtttcaccatgttgcccaggctggtctcaatctcttgacctcatgatccacccgcctcggcctcccaaaatgctgggattaccagcgtgagccaccgtgcatggccaaaaaggtaaatctcatagcatgtaaattacatgtcattaaacacacacacacacacacacacacacacatgaggtgggtgtggtggctcaggcctgtaatcccagtactttcggaggccaaggcgagaggatagcttgagcccaggagtttgtgacaagcctgatcaacagagcaagaccctatctctacaaaataaaaattaaaaaaaaaattagctgggtatggtggcatgcacctgtagtcctggctgcttggtaaggctgaggcaggaggatcgcttgaacccaaaatctgaggctgtagtgagctattattacaccactacactccagcttaggtgacagaggaagactccatctcttaaaaaacaaaaaaacaaaaaaaaaaaactaataaaataaaaacatgaaatccaaaccaaaaagagatgagaggggaggtaggcagagagagacagagggagagagagaccaggagagagccagggagagaggaagggagagaggcttggactgagtgtctgagtctccatacagacagtcagatcactggtatgttgtgggggtgcagttggggaaatgaggaaactccaggcatcagggggccccatttgagatgtaccatccagagtgtgagaattctaatgagtaggcaggggccataaggaccattttcttcctccctcccttccttccttccttccttccttccttccttccttccttccttccttccttcttccctccctcccgccctcccttctttccttcctttttcgtttttgaaatagggtctcactctgtcacccaagctggagtgcagtgacacaatcatagctcactgctgcctcgaactccttggctaaagcaatcctcccaccttagcctcctgaggagctaggactacaggcatgcaccaccacacccaattaatttaaaaaaatttaatagagatggggtcttgccgtgttccaggctggtcttgagctcctggactcaagtgatcctcccacctcagcctcccaaagagccaggattgtaggcatgagccaccgtgtccagcctctttataaataaaagatcagtgacacagaaaatggtttggttaaaatactttatatttcttcctaaactcttcttccaaagtaaaataaatatattttcagttataagtaaatttgctggaatgtttttccacctgctggggcaaaggtcctccccttccacccctgcctgctgcccccggtcctgtcgaggggcagatttcctccctcacagggcagacaagccacatcggggcagtgtctgccgctgcttccgaactccctgctcacggactgggagcggggcctctggcccctgagtgagctggggcaacagacttcagaatgtcgcagcccgagggagagtcacctggagagccactggggagacgctgatgtgggctgatgctggatgatggaaaacactgtgtttcgtgttttttattttgtcaggtgtgatgacagtataatgggatgatatgttaaaattcttttttttttttttgagacgaagtctagctcttgtcccccaggctggagtgcaatggcacgatctcggctcactgcaacctctgcctcccaggttcaagggattctcctgcctcggcctccggagtagctgggattacaggcgcctgccaccatgcccggctaatttttgtatttttagtagagacggggcttcaccatgttggccaggctggtcttgaactcctgacctcaggtgatcatcctgcctcggcctcccaaagcactgggattacaggcgtgagccaccgcacctggcctaaaattcttatcttttcatgtatctcaaaatatttagggatcaaatgtgtctgggccatgctggaaatactttagacaaagaaaacaggagagacaaagcagataaaacaaaatgttgataattttaaatctagctgatgggtatatgggggttccatttaatattttctctcctactcatatacgtgtgtttgtgtgtatgtgtgtgtatgcctttcaaaattctcattgaaaagtggctgatcggaagtgcaccctcaaagatgttttccccttttctccactaactcacttttttttttttttttttttttttttttgagaccaaatcttgctctgtcacccaggctggagtgcaatggtgtgatcttggctcactgcaacctctgcctcccgggttcgagctattttcctgcttcagcttcccgagtagctgggactacaggcatgcagcaccatgcccggctattttttttttttttttttttttgtatttttagcagagacagaattttgccatgttggccaggctggtctcaaactcctgacctcaagtgatccgcccgcctcggcctcccaaagtgctgggattacaggtgtgagccatcaatgcctggcccactaactcacttctaaatgatcttgttctctttgaacagaaataaaggatattatgatcttaccactttataaattagaatgatgaaattgagaaaaactagagatgactaagatgaagacagacatgaaatcgtgccaaaaagtgcccatgctgtatccagcagctgctgcagccacagaaatgctcgagttgtcagcgagggtactcactgcttgatcatctagcattgccagatactgtaaaccgccgcacacctatcagcagggcactggctacatcacacagattgctgtgccatggtttaaggtcacattgcagcagagcaggaagcatgtggctgggagtggcacggggccagctttcaggatgtatggtctggactgagctgcagtccttggggcctggacagctgctctggccctgagccctcctcccctccctgtggtctctccctttccatctctctctgctacatagcctcccttccctctctctgctctattctccttcccccatcccctttcccctcacccccaggtcaattttcttagatatctccaggcccaagtttggaggttcccaattagggtgcaggctggccctcaggtgcgtgggggtccaccttgtccagccatggctggccccagtgctacgtcacaatgtagggactgagagtggatgcggtggaggtgggcatttaccacactgtaagggatcagtcagtacagaccaggagcaggccgaatagtcagtacccgtgcagttccggaaaacccactcgttttgtgaagagcgtctgccagctcctgcatctgctagggccctgctgtgcctcctcccctctcctgccccctgggactccgcctccctcccctgctttcttttctcctggcgcttgtccccatcccacgctccaccgcgggatatagcaatgacttatttgtgtattgaggtcagtagatctcctctctatgaagacaggtccctcagggacagggctgtctgtgctggtggccgcagcagcccagcccctacagcctgccccacatggtagacaggcagctatttgctgagtaaatgaaggggtcaggggatcgctaataattttcattttatgttttatgctttccttttggtttcaactgttctgtaaagaagacattttatactagaaaataatattgctttaaaatgtaaatgtgcatggagcaacaggaactctctcattcattactggtgggaatagaaagtggtccagctattttggaagacggtttggcagttttttacaaaacaaaacatacttttactatacaatccagcaatcacactccttggcattggcccagatgaatggaaaacttaagtccacacaaaaacctgcgcatggatgtttatagcagctttatttataattttgtcaaaacttgatagcaaccaagatgttcttcagtgggtgggtggataaataaactgtggcacatccagacaacagaatattattcagtgctaaagagaaatgagctatcaagccatgaaaagccttggaggaagcttaaatgcatattactaattggaagactccagtctgaaaaggctacgtactgtacaatgccaactctatgacagtctggaaacagcaaaaccatggagacagtaaaaagatcagtgaccccccgccaggttcaatggctcactcctgtaatcccaacactttgagaggccgaggcaggtggattgcttgagcccaggagttcaagaccagcctggacaacatggtaaaaccctatcttctctactaaaaacacaaaaattagcctggcgtggtggggggtgcctgtaatcccagctactctgcaggctgaggcacgacaattgcttgaacccaggaggtggaggttgcagtgagccgagatcatgccactgcgctctagcctgggcgacagagcgagactctgtctagaaaaaaaaaaaatcagtggctctcataaaaacatcagtggctcccaggggttgtagaagggaggtgaacatgtggagcaggaagggctttccgggcagtgaaaccgctctgtatgattctataatggcggacacgtcattatgcatttgtccgaattctcacgaagtgcagcatccggaatgaaccctagtgtgcactgtggactctgggggataggctgtgtttacctaggttcttggacttaacaagtgcacccctctgtggggtgctgacgggggaggctgtgcctgttggagcggaacatatggcacatctctgtaacttctgctcagttttgctatgaacctaaaacacctctaaaagctaaagtctattaaaacattttaaaaagtagatttcaggctcagtgaggtgggagagggcggtgggggtgttcccaggcacagagggagcaggcacaccctgccctcgcaccctgggagaagctgggctggctgaacttggggaggcctggccctgggacctgcaggtagcctctggaatgcggacgtgcaggctgaccctgatggtcctgtgaatgccaaccaacctgccactcctgggctccctggcacagtcaccacaagtgtcaccccaggtcactcgcagatgcacccttatctccagaccagctggagacctggcctgaagctgagggttggcggcaggagaatggcccaggcaaaagttctcctcctaaagttgctttggaaggagggccggggagggccctcccggaccctggaagcatgaagacctccccactggagtgaagacagggagagagccaggcgtggcaggcacagccagggtgcgcacagaggatggctgcccggggcttagcatctgctcacctcatgaggttggcactgctgcctagacaacccatgtaataccccaggcctcaccattttggattgagagatgagctcagcgtcccctcacagggctctggagggtttagcaaaaggctgcggtgaaagtcacccggtccacggctgtctctgccacctgggactctctgcttcctttgcctgtgactctgcagccacttggcccggcccccagtgctgggcacccctctagatgagcgatttgccttcctctccgggtacagatgatgaaggggcctctcccggtgtcctgggtatttctggcaaccaaatggcccctgcccaggcaagagtcccgctaggaatcagcacagcctgcttgggctgagttcgtgggtggagggcatgagcttccgagaagcccctgcaggcgccaagctggggggccaccaagcccgttttccgccgtggctgcctgggtgcagcggcaatgcctgtggcgtgggctgctggcctggcctgtggggcagctgcaagtttcccttttaatggaaatctctctcttgcagccatacattgtgtttgactcgagtgtgtttttcttggctttaagaaacaggattagttgcactctttgtaatttttggtattaaaggtatttttaacaaatgcagtctgtatcgtgggaacatcctgaagttcctggaatgtctgtagtctaaagtcaagcctgttcccacccctggccttcctctttaaaggcttgatgttgttcgatgggatgtctatttttgttcatttaggtttcaaattgaagcgtgactagcactgggaaattggcattcccctgcagtcagctcttcttcctccagccccagatgtgggacggtagagcagaggggcaaaaggatcggacggcactgtgtgctctaggcagggacagctgaggggccaatgccctgcccctcccagccagaggaggatgcccccatctgttcactgcaccctccagtgggaaacgagcaaaacaagaggcaatgcatttgcagtcactacagtaggaagaggtattcgctttccaccagtaagtgacaaatcactcataagggagtgctgggaagggaagagcatgatccctttaaatgataccaagtggggaaaggaagtgctgggtagaggaggtcgtggtccctggctagggctccacccccacggacctaggtgaggacaggcatttttgtttgcctgcccaaatgttgcatttcccaagaccaccctggcctgccatgcccctgtcctgtgcctgtaaaatcccctgacattctaacaggcagacacacaacaggctggatgtggagagaagcggatcggcggaagaagacacaagcggctggacgtcaaggggagcacgctggcggaagagcacagcgacagaagagcacactgacagacgtcggcaggccacccaccctggcagaatgacacagggtttggctagggcagtcagaagagagcctgggccgctgagcgcccgactccaggggaaaaccatctcttgtctggctcccccatctactgagagctacttccactcaataaaaccttgcacccattctccaagtccaggcgtgatctgattcttctggtacaccaaggcaagaacccagatacagaaagccctttggccttacaacaaggtagacggtctaattgagctggttaacacaagctgccgatagagcaccctgtaacacatgcccactggggcttcaaaaactgtaaacattcacccctagacactgctgtggggtcggagccccacagcctgcctgtctgtatgctcccctcgaggtctgagcagtggggcactgaagaagcgagctacacccccatcgcacgccctgcgaggggatcaaagaaactcttcccatttcatcaccaccaacagcagcttgagatgacacccatttgcagcctcacagttccacgaggcaggaacttgaatgtggcttagctggatgctctgcttctgggtgtctcccgaggctgcagtcaaggtgtctgccagggcggtggtctcatccaaggctttgctgggtggggctgcccatccaagctcactcatgtgctctttggcaggacccagtttctctggctgctggaccaaggccccagctctcggctgtctctcggctggaggccgacttttgttccttgctgcataagccttccatagtggcagcttcctgcaccaaagccagcaagggtaagattctagtcttttgtagtctaatcacagtgtgacatcctcaatgtcgctgcgttctgttagaaggaagttactcaaggggtgaatacaagaccatgccttccatgaggcaggatcgtggggccacctcagacactgtctgccacagaagcgtgtagaaacgatccaccccttgctcatatgtgcattcaccagaaggtgctttggcccctggtccagagcgggagcaccagggtgaggctctgaccccctgcaatcctttcaactctcccatccctccatctcctcctctttagaacgggggtgatggaatccactgtgcagttttgtaatgtttttaaattagaggttgtattgggccattcttgcattgttacaaagaaatacctgaaactggataatttataaagaaaaaagctttacttggctcacggttctgcaggctgtacgggaagcatagcagcatctgcctttgaggaggcctcaagaaaacttccagtctttgtggaaggtgaacgggccgcaggcacagcgcatggtgaaagcaggagctgcggtcgcgggggcgggggatgccacacacttgaaaatgaccagatccataagaacccgctcactattgccaggacagcaccaagagcatagtgctaaactattcatgagaaaaccacccccatgagccaatcacctcccaccagacctcacctccaacactagggattacatttcaacatgagatctggggagagccacacatccaaactatatcagatgggatgagaaataatgaagagctggccttggcattttgctcatagtgggaacccagaaatccttgaatgaatgaatgagtttcctgttgacacaatataagtgctatgatacaaatgtatgtgtccctcccaaagttcacatgctgaaacataaccccaagttgatgctattaagaggttgggcctatggaagttgatggccatgggggcagagtgtccttataaaagacgctccagagagcttgttcagcccttctgccatgtgaggatgcagccaataaggctgcttggaggcagagagcaagcaagactcaccagatacaaaacctgccagtgtcttgatcttggacttttcagccaccagaaccataagcaaaaaacttctgttgtttataaactatccagtctcaggtattttgttttattagcagctggacagcccaaggcagggacaaagccccatttggagactttggcagcaagaaatacatgagaattccttcagaatatgtggattcctggggaagtgaaacccagctcagcccctagggagtgcggaaggtcaggcctctagcttggacttggccctttgttctagagaattagacactcaacaaagctccgcggtgctcacagctgaggctggagaagggacaacccagatgaggaaggaacaacatatttttttttctggcttctactttattttattttgagacacagtctcactctgtcacccacgctggagtgcagtggtgtgatcttagctcactatagcctctctctgcctcccaggctcaagcaatcctcctgcttcagcctcccaagtagctgggactacaggccagtgccactacatctggctaatttttaaacattctttatggagatggggtttcaccatgatgcccgggctggtctcaaactcctgaactcaagtgatccacctgcctcagcctcccaaagtgctgtgattaacaggtgtgagccactgcacctggcctctgtcttctattttaaaaaagaaacttttatgtggttataaaagtgatgctggctagcaggaagaccctaatggagaggctagaaaggaatgcaatcccactgcccagagaggccggcctggctgtgccagaatcatagagtgggggtacactttcacctggcacagccaagcccactcagacctgcccagtcagagctggggcagagctgggcaggaggaggttggagacaccccctgagtgattctgacaacctcctggttgcaaagtgccctctatgcagcatctcccgtgggtgaggtcaggctcttggagcagttttctttgtctgcttttccccatgcagcattatatcatccacattttccagtgatgttctctccctgtgactctcacacctgtaatcccagcactttgaaaggctgaggcaagcagatcacttgaggtcacgagtttgagaccagtctgggcaacatggcgaaaccccatctccataaaaaatatttaaaaattagccaggtgtggtagcaccgggctgtagtcccagctacttgggaggctgaagcaggaagattgcttgagcccgggagacagaggctatagtgagctaagatcacaccactgtactccagtctgggtgacagagtgagaccgtgtctcaacgtaaaattctccaggtgttctcccagcccacagccctcgtcaggttggcatatgacattgtaggccttttcttctgtgtttccataattacatatttacgtggcaatatagttttggattgtttttttctctttatataaatggtatcataccacaagtggcatcctgtgtcttaccagtttcccactgtgatatgtcttggtattttttccatggttggacatgtcactgacacatattcttttcattgcttcttggttttgaggttccaaggttccgagattccatagttccagggttagatggttccatgattcactggttccaaggcccaaggttacatggttcaaaggttccaaggtactatggttccatgcttccaagatgcaatggatccaaggttccaaggattaatagttccatgtttccaaagttccttggctcaaaggttcaatgttatcattgttccaaggttccatgtttccaagattcagtggttccaaggttctatgattccatggttccaaagatcagtgatttcaccgttccaaagctacatggtttcctggctccaaggtacaatggttccaaggatccaaagtaccgtggcttcatagttccaaggttccagggttcactggtcccaaggcccaaaattacatagttcaaaggttccaaagtactgtggtttcatgcttctacggtgcaatggttccaaggttccaaggttcaatggttccatccttccaagattccaagattccattatcaaggttcagtgttaccattgttccaaagttccatggtttaatgggtccaagattcaatggtttcaatattacagagttctaaaattcagtggatctgtggttccaactttacaaggttgtaagattcagtggtgaatggttccaaggttccaagtttacagggtttcaagtttacagggttctaaggttctgtggctctgtgattacaaagttacatggtttccttgttccaagattacatggttccaaggttccaaggtttcttgattccatggctccaaggttccatgtttccatacttccatatttcagttgctccaaggttccatggtaccaaggtttcatgtttcccggtttcgaggttcagtggttctgtggtttcaagactccacggttgcaaggtttcatggtcccatggtccaaggttccaaggctccaagtttccaaggtgccatggtttcagagttcatggtatcaaggtttagtggttccttgcttcccagtttccctggtttgttgcttccaagttatcaacatttcatttttcatttgcctccacctatttgtagacactcagattgcatccggagattttgctcttatcaacaacgccaccactatcagccttgctttttttttccttgtgcacatttaggagtgttcctgaagggcaaaaatcaggagcagaattgctggatcccaagaagtaatatgtgaaatttaatcaatagagccatattgccctctaatgcatctgtatcagttgcagtcttccagcagtgtatctgagtaccatttgctcgtcatccttgctatgacacaatattatcaaactttggtaatctttttttttttttttttttggagacagaatctcactgtgttgacaggctgggatgcaatggtgggatcttggctcactgcaacctccgcctccaggttcaagcaattctcctgcctcagcctcctgagtagctgggattacagtcacgtcccacaaggcccgggtactttttgtatttttaattgagatagggttttgtcatgttggtcaggctggtcttgaattcctggcctcaagtgatctgcccaccttggcctcccgaacttctgggattacaggcatgagccactgtggccggccaatctttgataatctgacggatgacaagaatatctcattgtaatttttgtttcacttgagtttgaactcttttacaatatgtttattgaccacttgtgtttcattgttacctgtgaattgtctgtttttattatgtaggtggtcttcttgttgctatgtaaagattcttttttttctttcttttcttttttttttttttgggacagagtctcgctctgtctcccaggctggagtgcaggggcaggatctcagctcactgcagcctctgcctctcgggttccagcgattctcctgcctcagcctcctgagtagctgggattacagttgcctgccaccacgcctgactaatttttgtacttttagtagagatagggtttcaccatgttggccaggctggtctcaaactcctgacctcaagtaatccgtctgcctcagcctcccaaagtgctgggattacaggcataagccaccatgcccagccataaagattctttatgtgttctattaccaattctttgcctttgttatacatgttgcaaacattttctcccagtccatcatttctcttgtagctctgtttttggtgagttttatgtattgcctgatgtatcagtattttctctctgggttcagaaacttatgtattgtattctctacttcaccaacaaagtttcctgtttttttcttttcttttattttttttggatggagtctcactccgtcacccagactggaatgcagtggcacaatctcggctcactgcaacctccacctcccaagttcaagagattcttctgcctcagcctcccgagtagctgggattacaggtatgagccaccacacctagctaatttttgtatttttagtagagacgaggtttcaccgtattggccaggctggtctcgaactcctgacctcaagtgatctgcccatatcagcctcccaaagtactgggattacaggcatcagccaccatgcctggcctattttcttcttttgtatctcatcagtattgatgtccaccagccaaagaccatctgtagtcaacaaagttaagtttattgctttgttgcaagtgagcctgcacatctaaaggagtgggtctggggacagagttagtcataggatgtcctgtcagcgtttggacagagtttgttaactgagggtcttactggaacaacgatgagtggtcttgtctttatgagttcgttttgttttgttttagagacagggtctcactctgttgcccaggctggagtgtagtgatgtgatcatagctcactgcagcctcgaaatcctgggctcaagcaatcctccctcttcatcatccctagtagctgggacttcagctcctgtagaggcggggtctcactatgttgaccaggctggcctcaaactcctggcctcaaggggtcctctcacttcggcctctcaaagttctgggattacaggcatgagccaccgtgcctggcctggtcatgtgtgttcatgggccaatttgtccatggcttattttaggacacatggatgtgaatgaactggtgttaaataatgacgcccactgtggcttgatctggcacagttgatgtgttttgtgagtcagggtatatttcgcaagctgtggtttctgttttaatcctcagtttccccaaacagactggatgcagcaggacccgtttacacctgagctgtggctttcccagtcattttcctggccagccttggctgaaggaccagctgttctcttctgagcgtgccatcatcgatttttgtgccaagtcaaatggtagcctttctgacgcctgcaacatccagcccccttgttctttctgttggatcatctgacaggacatcagctttgtggcagcattccaaaacgtggatatgcacttggctactgcaacacagataaatactaagacaagagtttttattcacaagtgaaacatatctcctatgttctgtgttctattaggagctttctcggatgaccaagtggtttcttccctttgatctggatgagatttgttcaactttgccagagtttgaagaattagttctgtatctggtgattgtcaagagttagggtcttggaagcaccaacaatgggggtgtccactggcaatggagtccctgaatccgcagagagggaaaacagccaggaaaataaaaaccagggacatgcctcatgcagagaagccccagcagtgggcagaagcgttctagtccgctgatctctgctcgtggacccctcggtcctgggaaccctgacccgcacgaggtccatggtggtggcattggcactgcccctaattgaattccctgtagtaccagtagccaccagagcctgggacagtccttgactgaggttctttagatgtttcatccacacggctcagttcccgagctttgtggatagcaggagccttggggagaatgtaaataaatgttctgtaaatgtcagttcggcccgtcaggtctagagtgtagtctaactttgatgctgctttgctcattttctgtctggatgatctgtccattaataagagtggtatgttgaagtcccctacaaaactctaataggtagtaagaataagtgttttttttctggatttaggaaagacaaagtcaaagaattgtcagagaacttaatatatgaataaggctagaaatggcaaattatacatacagataaatatatatagagaaaaatatataaatatatataacaaaaaatttttatatatgtatacatatattttccaagacagggtctcactccccttgcccaggctggagtgcagtggtgcagtctcagctcactgcagcctcaacttgctgagctcaagtaatcctcccacctcggcctcccaagtagctgggactacgggcgcgtgccatcgtgcccagctaattttttgtatttgtagtagaggcagggtttcaccaatttgcccaggctggtctcgaacccctggactcaagtgatctgcctgcctcggcctccaaaagtgctggaattacaggtatgaagacttcattttctttgcagtgattttaggataagttaagggtggagccagaataaacccagctgtattaaaccctgaaattccaatcctttcctctaatagctttaacacaatgtttttacttttagaaatgagatctcactctatcacccaggctggagtgcagtggcatgatatagctcactgcagccttgaactcctgggcttaagcaatcctcctgcctcagcctcctgactagctgagtaggcacacgccacgacgtcttagttttaatcttgtgctgtgtaagtagagctctttaatcagactgcaatgtatttttctgtgggatatatgatccaaacctttgtttcttccaaatagatagccagctgttgcaattttagactggtgtgaccatttttctgttcataagaacactttagagaatatcaagcatgtgtatctttctgttcacttacgctcattttctggagttaaatttcctgaactggaattactgggtcaaaggtatgagccttttgaggttcctggtgcatgttaccaattgttttccataaaggttgcacccacaggcagaagcatccatccttggatattctaattgtaaaagatatgcttttctagtgtggataagcaaagtagcttaacattgcttcaatttactcatctttttttatttttattttttatttttgagatgaagtcttgctctgtcacccaggctggagtgcagtggcactatcttggcttgctgcaaccttcacatcccaggctcaagtgattctcctgcctcagcctcctgagtagctgggattacaggtgcccaccaccacacccagctaatttttgtagtttttagtagagacggtttcaccatgttggctaggctggtctcaaactcctgacctcaagtgatctgcccacctcagccccccaaagtgctgggaatacaggcctaagccaccatgcccagcccaatgtacacatctttaaaaattagtgagaggccacttcatacccattgggggtgctactatattttaaaataaaaacagaaaacaagcagggcatggtggctcacgcctgtaatcccagcactttgggaggctgaggtgggcagaccacctgaggtcaggagttcgagaccagcctagccaacatggtgaaagcctatctttactaaaaatacaaaaattagtcaggcgtggtggcgggcacctgtaatcccagctactcgggaggctgaggcaggagaatcgcttgaacccaggaggtggagattgctgtgagccgagatcacaccactgcgttccagcctgggcagcagagcgaaactgtctcaaaaaacaaaacaaaacaaaacaaaaaaacagaaaacataagtgttggtgaggatgtggagaaattggaacccttgtgcattgctggtagaaatgcaaataatggagccactatgggttcctcaaaaaattaactatagaattcgcatttgatccagcaacccatttctgggtatagacacaaaagaattgaaagctaggactcgaacagatactcgtgcacctattattacaacagccatgagatggaagcgatgttattcataacccaaatgtccattgacagatgaatggttaaacaaaatgtaatataaacttacagtggaatactattcagcctttaaaaaggaaggaaatcctgatagatgccacaacatgaacggacctccaggacatgatggtcagtgaaataagccagtcgcggaaggacagtttctgcatggttccacttacgtgaggttcctacagtagtagaaatcatagagatagaaagtcgaatagtggctgccaggagctgggaagaggggacggtggggagcagttgttttatggggacagaatttcagtttgggaagatgaaaagtcctagagacggatggtggtgatggttgcacaacaacgcgaatgtgcttaagcccatcaaatctcacgcttaaaaatggttaagacgggccgggcacagtggctcacacctgtaatcccagcactttgggaggctgagacaggcagatcacaacatcaggagattgagaccaccctggctaacatggtgaaaccctgtctctactaaaaaataaaaatcacaaaaaattagctgggcatggtgacgggcacctgtagtcccagctacttgggaggctgaggcaggagaatgacttgaatccaggaggcggagttgcagtgatccgagatgcaccactgcactccagcctgggtgacagagcgagactccgtctcaaaaaaaaaaaaaattgttaagatggacagtctttgtgtgtgtgtgtgtgtgtgtgtgtttgtgtgtaggccgggcacggtggctcgtgcctgtaatcctagcactttaggaggccgaggcaggtggactgcctgagctcaggagtttgaaaccagcctggccaatatggagaaaccccaactctactaaaagtacaaaaaattagccaggtgtggtggtatgtgcctataatcccagctactcggaaagctgagacacgataatcacttgaacctgggaggtggaggttgcagtgagcagaaattgtgccactgaactccagcctgggagacagagtgagactctgtctcaaaaaaaaaaaagactcaccctgatcacagctcagtgcagcctcaacctgctggagcaatcctctcacctcagcctcccgagcaactgggactacagctgtgggccaccatgactggctaatttttaattattattattattttttgagatgagatctccctatgttgctcaggctggtcttggactcctggactcaagtggtcctcctgccttggccttccaaagtgcagagattataggcatgagccactgtactcggcctgtcatgtatattttatcacaataaaaaaatctgtgagaggaccatttcttccaatgttgattggccaatcctatttttgtgtgtgtgagttttttcttcattttctgagcccacttatgtccgagctctgagtcccaggaggccagtggaggagggaagaagaggactcggcctgagggtgacatgagacttgaagaggctcctggtggcataggggaggggacagcccaggggaggcagttccgtaggcctggcagtatgaaccccaggctgaggcaggtgctaaagaagaggccatctcctcgaggccctgaccctggaaggcatttgctgaacacccagtgcctggtgacatttggggtcctgagcccagccagcctccgaggatcagccctgcctgttatgcgcggaatgtttgcatccctccaacattcgttgttgaaattctaacccctaggggggtggtactagaaagtggggcccttgggaggtgaagaggtcgtgagggtggagtcctcatgaatgggagtagtcccctcatcagaggggcccggagagctctctgccctctgccacgtgaggattaaacatgaagtaaaaaatctgcagctggaagcggctcccaccagaacccaacaaagctgcgtcttggtctcagatttccagcctgcagagctgtgaagaatacagttctgtgtttaagccactcagtttacagtattttttaatagcagtccaatctaacaaagccaccacccctggctgggccccagctagacagaaagcctgtcagggcactctagggtttaactccccaagctcagagagcgtgttggggccagctggtgtcccacacctgggccacttatctgcaggacagggtgatgggggctcccccgtgtgtcgtgacctctgggggaggttttctagaaagtgcatacacttgctctgtacgcatctccaccctgatccagggtgctcccatctctgccccaagcacctgctccagaggacgcatggtcccaccgtccagggtcaagaaccccggaccaggccctggcccggttctggtcaggctcggccaccagggggcggtgtgggctgcaggaggctgctgtccctggagcttcccagttccagaccaggaccccaccccactgggtgggcgtctccaaggccctggtggattctgtaagctcggacccgttaatagaagtggttctctattgtcccagtcgcctaaaatgctggggacctctcaggtgtctgctgatggaaaggcagccagagccagccaaggcaattcccaagcccaccgctcagccttgcagaactgactgcacaagggtcacccaggggaaatggtttctaaaaatacagggacttccacttccaggaaaattgagtagaagtacttttccctgttcctcccactatgtacggctaaaagcctggacaccacacagaaagcaaacataagcggattctgaaaggtgaagagaagagcagagatccgtcagggacctcaggacccaaggatgacggggcgggcagctccatgtggtttcttttggcctcatatatctcactcctggagctgaagaagccagcaacctggaaacgccaacagacacagacaaaattactccaatgaaagctgctgtgtctagccaaaggaccaggaggcagcagcctcgcaaggtcaaaacgtttaggcgataacctgtctactccagccatcaccaccgaaacaccctcggccactccagcaaaggctgagcgggagcctaggctccccactttgggaagccgtggcaaggaaccccaacatctccccctgtggtgtcagagaggccaaggagggagccgagaccgccgcacccacccctgacccataccccattgtggaacagcctgagcttccaccccatctgccagtaatgccgccctctccccctccctgctgggggtgggggttggtgtcagaggaggcaaagcgaggagcctggctcttcactactactcagtggtaacgaggccaccccaatgggctgtcagcagaaaccacatggggagccagaccctgcccagagtaaagagaaaaagagctcccttgggtataaacggagattgagtggggaacctggacttttttccaccctgcagtaacaaggggccagagcagcgtcaaaaaaacaacaacagcacaacaccacaatgtttacaaaagcagcaatagaagactttggggccaggcatggtggctcatgtctgtaatcctagcactttgggaggccaaggcggctggattacttgaggccaggagtttgaggccagcctggccaatatggtgaaaccctgtctctactaaaactctaaaaattagctgggcgtggtggcgcacgcctgtaatcccagctactcaggaggctgaggcaggagaattgcttgaacctgggaggcggaggttgcagtgagccgaggttgtgccactgcactccagcctgggtgacagagcaagactctgtctcaagaaaaaaaaaaaaaatagagaagactgatgggtgtgtttattaccttgattgtggtgatggtttcatgggtctgtatagacatatgtcaaaactcatcaaactgcctattttaaatatgtagtttcttgggtatcaattatacctcgataaagctgtttgaaaaacagaaaatttaaatcagatccagagtctcataacacaaaaaatgtccaggtttcaatagaaaaccgctcattaccaggaagatggttctcagtatgatgcaacggactgaaactgttgaatgcaactaagtgaaaagggacaatcagtagatgccaacagtaggtggcaaagacgttagaattagctcacaaagattgtaaagcagccatcataaagatgcttcagcaaacaactaagaacgtgcttgaaacaaatgaaaaaatagcctcagcaaagaaagagagagaatatcttaggaaagaaattgaagatataaagaaattggaatggaaattttagaagtgaaaaatacaataactgaagtataaactcagtggatgggctcaagaacaggatgaaggggacagaggaaagaaccagtgaactggaagacagaacaatagaaagtacccagtctgaacaacagagaaaatagactgaaaaagaaaaaaaagaacagtctcaggtatatgtgggactgcaacaaaagacctaatatttgtgtcattggtggttaagaaagagaggagaaagcgtgcaaggctgataaagtactcaacaacggctaaaactccccatatttggcaagagacacaaacctacagattcagaatgaatcccaaacaaggaaaacccaaagcaatccatgccaaggcgcatcacagtgaaatttctaaaaactaaggacaaagcaaaaatcttgaaaatagccagagaaagcaataccaataccagtaccaatactctatagggaaaaaccatttgcattactgcagatttcccttcgggactgatggaggccggaatgaagtggcacgatatttttcaagtgctgaaggaaaggaaccatcagcccagaatcttatatgcagtgaaaatatccttcaggaatgaaagggaaatcaagacattctcaaatgaaggaaaactaagagaatttgttgccaaagacttacccaaaaacaccagctgaaggaagttatttaaatgggaaggaaataattaaataaggaaggaaggaaaaaaacctaataagtaaaaatgtgagtaaatacaataggcttttcttctcctcttcaattttgtaagttatgtctgatggctgaagcaaaatttattgcactgcctaatgtgattctaagtgtatgtataggaaagatttaagacaattacattataaatggggcaggataatgggatacaaagagaggtaagtttcctacccttcactcagactgaaaaaatgacaccatcagtagattgtgataagttgtatataatgtggaacatccactaaaaggctgtacaaggagctacattcaaaaacacgatggagggccaggcacagtggctcacacctataatctcagcactttgggaggctgaggcagaaggattgcttgaggacaggggttcgagaccagcctgggcaacatagcgagacccttactccacaaaacattaaaaaattagccgggcatggaggcacatggctgtgtcctagctacccagaaggctgaggtgggaggattatttaagcccaggagtttaaggttacagtgagtcatgtcactccagcctggggaacaaagtaagactctgtctccaaaaaaaaaaaaaaaaaaatgcaaacaaaaaacaaaaacaacccacactattgatcaatcaaaatggaattctaaaaaatgtttaactgataagaagtcaggacaaaggaaacagaaacaaaaaacagggagcaaacagaaaacagatcagaataaaatggtacaattgctgggtgcagtggctcaagcctgtaatcccagcactttgggaggctgaggtgggaggatcatgaggtcagaagatcaagaccatcctggctaacacggtgaaatcctgtctctactaaaaatacaaaaaattagccgggcgtggtggcgggcacctgcagtcccagctacatgggaggctgaggcaggaaaacggcgtgaactcgggaggtggagcttgcagtaagccgagatcgcaccactgcactccagcctgggcgacagagcaagactccgtctcaaaaataaataaataaataaataaataaaatggcacaattatatcctaacatatcaataattacattaaatgtaaatgtcttaactcaccaattaaaagagattggtaagatggattttaaaacatgtatcaactatatactatctacaagaaattcacttcaagatgtttcacacagatattaatcaaaggaaagcaggagtggctatattagtatcaaatgaggcagacttcagggcaaagaaacttaccagggataagactgacatgcaataataaaagggtcaatgcaacaagaatgcatagtaatcctaaacatttatctaacaaacaacagaactgcaaaatatatacaacaaaaagggatagaactgaaaggagaaatagacaaatccactattgtggttggatacgtcaacactcctctctcaacaattgatagatcaactagacagaaaatcagcaagaaaatagaagcacgcaatgatatcgtcaaccaacaggatctaattgacatttattgaacactttattccaacagcagattatcctttctttccaagtgcccacgaaacatataccaatatagaccatattctggggcacaaaacaaaccttaacaattttctaaaaattgaaatcacatggtgtgggttctccaaacacaatgaattcaaactacaaatcaacagaaagataacagaaaaacctccaaatacttgaaaactaaaccactcatttataagtaatccatgggaaaaaggagtttcaagagatattttaaaaaatacattgagctgaatgaaaatggagtacaaatgtcaaaacacagaaaaagcattgtggatggggaaaatttatagcattaaacacatatattagaaaagaggaaaagtctcaaatcgataagctcaaaaacctcaagaaactaggaaaagaagagcaaaataaacccaaggcaagcagaaggatgaaaataataaaagataagggcaaaaattaataaaatccttataaaaataatagagaaaatcaatgaaagaaagagctgattgtctttttttgtggggggagggggacggagtcttgctctgttgcccaggctggagtgcagtggcgcaatctcggctcaccgcaaactccacctcccaggttcaagcgagtctcctgcctcagcctcccgagtagctgggactacaggcacgcaccaccacgcccagctaacttttgtatttcagtagagacgaggtttcaccatatcggccaggctggtcttgaactcctgacctcgtaatcctcctgcctcagcctcccaaagtgctgggattacaggtatgagccactacacccagccaaaagctgattctttgaaaggtcaataaaactgacaaaactctatcaatactgaccaaagaaaaaaaaagacatagattaccaatatcaggaatgataactctactctatacatataaatttgacaacttggatgaaatgaaccaatttcttgaaaaatacaaactaccacaacttacccaatatgaaaaagataatttgaatagggaatttaattaataattttagaactcctaaaaaaagaaatctccggactcctatcgtttaaatagataattctatcaaatctttaaagaaaaatttatcaccactgttccagaaaataggtgaggaaagaagactttccaatttgttttatgcagctggaattacagtgataccaaaaccagacaaagatagtagaaaaaaagaaaatctcagaaaaatatccctcatgaatatagaccaagaaaatatttaataaaatattagcaaatagaattcagcactacatacaaataattgtacaccattaccaagtggagtttactcctggaatggatgactggttaaacattcaaaaagcaaacaatgtaatccactgaattcacaggctaacaaagaaaaatcatatcaattgatgcacaaaaagcatttgacaaaaatcggctgggcatggtggctcacgcctgtaattccagcactttgggaggctgaggagggtggatcacgaggtcaggagatcgagaccatcctggctaacatggtgaaaccccatctctactaaaaatacaaaaaattagccaggcgtggtggcgggtgcctgcagtcccagctacttgggaggctgaggcagaagaatggtgtgaacccgggaggcggagcttgcagtgagccgagatcatgccactgcactccagcctgggcgacagagcaagactccgtctcaaaaaaaaaaaaagcatttgacaaaattcaacactcattcataacagaaattctaaaactaggaataaagggggaactttgtcaactttgtaaagggcacctataaaatacctatagctaatgtgatactctttttttttttgagatggagtctcactctgtcacccaggctggatggagtgcagtggcgtgatctcagctcactgcaagctccacctcctgggttcacgccattctcttgcctcagcctcccaagtagctgggactacaggtgcccaccaccacacctggctaatgttttgtatttttagtagagacatggtttcaccatgttagccaggatggtctcgatctcctgaccttgtgatccatccgcctcggcctcccaaagtgctgggattacaggcttgagccaccgcgcctggccagctaatgtgatacttgatggtgaaaactaagttctttccttccaggatccaaagagaagatgcctgctctcaccactcttactcagcacagagctgggagttctagccagtacaataaggcaagaaaaggaaataaaaggcacacagacaggaaaggaagaaacaaaactgccctcatttacagataacatgattgtctctgcatagaaaattccaaggaatctaccctcaaaaaagccctcctagaactaataagtgagtttaacaaggtcgcaagacataagataaacgatcaaaagtcaattctatttctacatgctagcaacaaacacatgggcactgacattaaaaatacaataccatttaaaatccctcaaaaaatgaaacacttaggtataaatctaacatatatagaacataggtatgtgctgtgcactggtagcctcagctactcaggaggctgagaggggaggatcacttgagcacaggtgttcaaggctgcagtgagctatgatctatgccactggactccagcctgggtgacaaagtgagacctcatctctaaaaagatttaaaaaattaaattaagtttaaaaatgcagaatttgaacactgaaaactatacaatactgataggaaaaaaaagaattgaagtttttattgatccctgcaacaactggcataaatcttcaaagaattatgctaagtggaaaaagccaggcctgaaggatgatatactatatgattccatgtccacttacataacactgttgaaatcaacattctagaaatggaagacacatcagccattgctggaggttaggaaagggcttcggtgggagggaggtgcgtgtgaccgtaaaagggcagcaggagggagtctctggtgacagaaatatcccgtatcttgaccgtaccagtgtcagcatccaggctatgatgtcctaccgttgcaagatggtaccattgggtacaagggacctctctgtgttatttcttacagctgcctgtgaatctacaatgatctccacagaaaaaattcaattaaaaaatattttaaagcacataacaggcagtcatgtgtaatttgggtcacgtagaacaagtctggatcatgaagtctgtgaggctggtgtacacttaactgagagtgtgtctagctttaaaccggtatctgcatttaaaaaaaaaaaaaaaggcagagtcgggggccactctcagagagcactattaggtgctcaccggcagaacccagacattgcattttcaaagcttttaagcttttcagctgcactctgaggaaccggctattgatctgtgtccttggtgcacagcccttgcacttctttctgcccccacgccctgcggcccctctcggctctgaacaggggccctgctctctgggactccacatccctgcaaaatttgtctccccttccctgggttcctcccccggggctgagctgaggacaagggcctggcctcctccttggagaaccccacagcaccctgcatttcggcgtggtccatgggctcttctcaggggctcctcacgttgtgcaaaggggtaagggagcagggccagctgcagatctccctcccgctgtgacaaggacatcctagtcgaagagcccgtttatcttcgctcttaaggccaggctctctcaggtcattgttgccaaagaaatgaattgcagcacagctccgcaggtccctgcacaactggggcaagggctggcactgggccagcgggaacctgttggggaggctgcaaggtgcttctctgcatccaaggctgccacaccctgtgcacactgtggagctgggtggatggggtgtgctcaggaggggctctcggccctcggctgggagtcagaggcgtggtgggtggggcggggaggggtgtcacagctgcagggcagccttgatgtctgcacttggctttttaatttgtagtcacagccaacaagtgtggaaaccgcctcaggaccggcttgagtggagcggctgcgggagttacttcatgactgtggtctcacgctgtgtttcgccacccatccctgcctggcctggcttccttccttcctcctgggtacgttggcccttggctctctcctcattaactggcccctcggaccccggctggccagctgtctgcagcctcctgggtgacaccttcacccctgcctcctcgggggtctgctgccgccacatcaatctccctaacaccctgggcatgccacccctctggagacctccctagtctctctcgcagggcccccaacctgctcagcccaggcccactgccctctccctgcccggacacgtgctcccgtggcccggccgtgcctgcccacacacctgccctctctgaggttcacatgtggcatccaggggcccttccccaacagctctgcctggtgcagcctccccctcagcctcctcttccccccgagcagggtttgcagaggcccagaggctgccgggatgagtagatgttgggatcctgcttactgggcgtgtcttatcccccagagcaatggccttggaggtcagggacccagcatggccatgctggcttggggtttaggagctgtctcaccagagccccgcctcagcccacagccccgggcctgtttccttgaaggctccccagagccccatgcctggttttctggccagagcccttggcagtgacccctgctctccgcctgcagctctgggcgtcctctcagccccaagccctgataggtgccccctgtctctgtgcctgcagccttcaggagtggcccacacattggcttttatctctgggctctctgtcacctcctctccctcctgccaccctctgctcacaggctgcgggtgtggggcatccaggagctggccggtggaaagaggagcaggtgcccttacgcagtggggagcagacacacttgtgctgcttttcccttggggcttggggtggccactggggcaggacatgaggacagaccagccctcgtccccccagtgcagggggcagatctcactgccaggtgaaaccctgctgaccatccatgtggacccctcagcttggctggatgcaggaggtggttgcacagttgcaggtggggcatggagggagtggagcagccccttaccccaacacaggccccattcctgcttaaccggatgttccgaggagaagcacagcccaacaggtgtgcacaggaagctcccatcagtgctgtcctgggaaaggcccatcctgaatgaagtgtgttgctcagatccgaagagcgctgcatcttcacaggtcagggtggaaacctcctggtgcacggcccgggaggggcacccgtggcagggccagcccctgtgaggctgcacagatgagctcgagcagagagtctggggccggccacatcccacgtccgaccctgagctggggccctgggggagcccctgtggctttcgtaccagccacgcctgtatgtagagagctgagtgtctgctgtggaagaccacgagtcacatggcagacatgggcactcggcccaggcgatgctgacccatccatcagctcctacaggaccacaagctcccgttgtggtggccagagactcccaatggccacagacccactcagggctctctctggggtcttccggagaaaaggaaagctcaatgagctccttaaacctttcacttcaagttgttgcttttaaacattttgcttcgtggcctttcttgctccttctgtaaaaatctacattgtgctaccatttttttttttttttggcaaggtgtcactctgccacccaggctagagtgcagtgctgtgatcatgactcactgtagcctcaaactcctgggctcaaaggatcctccagcctcagcctcccaagtagctgggactacaggtatatcccacagcatccagctaattttttgaaaatttttttggtagagatgaggtcttaccatgttggccaggctggtctcaaactcctgggctcaagcgatcctcctgtctcggcctcccaaagtgctgggattacaggcgtgagccactatgcccactcaacatagtgattttctaactccttcatttcttctccatttagtagttggctttccaccgtaaggaaaactgcccagtctcccctctggctaccagtgaaggcttgtggggttttctttgattcggtgagttatattcagtggctgtggggcttgtttggatgctggctgaccggccccgtgtccctgtcatggtggagcacgcccttgcttcctggcaccaccgctgcacccggctcagcctgcactttaactgctgcagcgctggaggcagccacttccctgaggagccctgcttccttttgtttgtttgtttttgtttctttgctttgagacggagcctcattctgttgcccaggctggagcgccctggcaggatcatggctctttggctcagcctcccaagtagctgggactacaggtccccaacatcatacttgattacatttttaaaattgtttatagagatggggtctcattatgttgcccaggctggtctcaaactcctgggcttaagtgatcctcctgccctggcctcccaaagtgctgggattataggcgtgagccaccacgcccgaccaaggccagctttcttagaacagagtatttcttccacactggggtccaggcatgagttgtgctcactttaccatggtatcatttagatcctagaaaaaaattatttgtgagattattataatatgtataaataaatatacaattaataatactattaaacatcattgaattgtgattatattattaatatagttgtattattaatatgtgattgtactattaattttaattatcgtgtaattagttataatgcatccataataactcataccatgaattcacagtcactcctagtcctgcccggccctgcaggctcctccttgtgtccgtcattccgtatctgtacctccttctacaagagagccctaacttctaacagcatcactatgtctatcatctatttagccctccaaacacacaagacacttccagaatcttcttattctccagaggaaaatgtttcatcaaaacaccagaggcagccagcattttgacaagaaaacacaacaaacttcatttctttggaaatttgatctaggaaaatgtgtctctctcattttgctaatggatgtctgtttatcagtcagagaccatgaaacgactccttattttgaatatcagattttcttcttattctcaaacctcaaaacagcttggtaataatttatttggaaattatccgaaaggtaaaaataaaaacagaagcaagtaatatgccttgttactgctccttaattaggtaagagcctcatttcttgggctgctgggatgtaaattctgcataaaatggctggctttctttttaaggctttgcagcagtgttaacattcggctgccaactaagtcgattttaatcgcctttacaggaaccttcactttttctgtttgttccattccactctttcctcagtggataatcccgcatgttaagattcctgtgcagccgagggaggcggcttttggccgggagcttgtgctctgggtgtgagcgtggctgttgggaacgccttctgctcagaattccgtggtctcagcagatcgttcagtctagccactgggacggggccgaccgcacactgctggacctctgagcggaagatgtgtgaggttaggagggaaggaataaacaaagtcgccttcttccctgctgacctgccttggtatgtcaccattactcagctccttacagaacaggagcttcaagctttcaccggacaggctggcttcttcccgggagcccccgcccaaggtggggcctggtggggtggggccaccatcgctgctggaagctttagctcttttccctcagcttggcctcctttggcaactaattttttaactttttctaataggtaacagagtcccaagattccaagttccaggagcatgaaaggactcacttgtggagattcctgcctggggctcccacccacctaaggaatgccatccttgtcaccggctcacggggcagctctttggtatccttccagggtggtgtgtacaagtacaggcacatggatgcatggatgcatgagcatttttttcttttgccgacatattaatacacccggcagcactctaggcccattggcctgcaacttttcatttgattgatttttaattatttacttttttaaaaaattgtagttaaatatacatgacatatatttaccatttgagtcttttttttttttttgagatggagtcttgctctatctcccaggctggagtgcagtggtgtgatctcggctcactgcaacctccacagcctgatcctgggttcaagggattctcctgcctcagcctcccgagtagttgggattacaggcgcctgccaccatgcctggataatttttttttcttttgagacggagtcttgctctgtcacccaggctggagtgcagtggtgcaatctcagctcactgcaagctccgcctcccaggttcacgccattctcctgcctcagcctcccgaatagctgcgactacaggtgcccgccaccacaccggctaattttttgtatttttagtagagacagggtttcaccgtgttagccaggatggtctcgatctcctgacctcgtgatcagcctgcctcggcctcccaaagtgctgggattaaaggcatgagccactgtgcccggcctaatttttgtatttctgtagagacaggatttcaccatgttggctaggctggtctcaaactcttgacctcaggtgatctgccctcctcgccctcccaaagtgttgggattacaggtgtgagccacagcacccagaccatttttaagtgcacagttcagtggtattacatacattcacagtgttgtataatcgtcaccaccatccatcttcagaactttatgcatcttgcaaaactaaaacctgcccccattaaacagcagcccccctcatcccctgcccccaacccctggcaacccctattctactgtccgtgcctatgaacctcactactctatgcacctcacatacgtggaaccacatggtatctgccctttcgtcgctggcgtctcttagcataacgtcctcaaggttcatcggtgttggggcacgtgtcgggattttatggtgtgtgaatgacgtctcagtttaaaatgttctagagttacccagtggtgatggatacacaactctgaatatgccaacaacttctgactggtacactttgagtgggtgattgtatggtctttgaattgtgtcaataaagctgtcatttaaaataaaataccaatccgtgctggcacagagaaggactgggagactccgggcagtgcgcaggcccctgtgtctaggagagtgaggggcctgctgacctcgtcccgggcaggcgtcccaagagtctaagttccaggccttaggtctccttacgtgggtcttgtgcgcatggctcaggtggagtggcgacctgaacagtcggcactgctacgtgaggacgagtgtggccccagatggaaggcctgagcggaggcagcagggatgagggtggcatgggtgttgttatgcactgatttatgttctcccttccaaaactccacaccaaagccctcacccccaggacctccgaatgtgtatttggaggtagggtccttaaggaggtagttaagttaaaataaattcatgagggggtaggtcctgatcccatatgactggtgtccttctaagaagaaattgggacacagacatgtacagagggacaactccgggaggactcagggagaaggtgccacccgcaaggcaaggagagaggcctcaatcggaaccagccctgcccacaccttgatcttggactcccagcctccgagacaagacaataaatgcctgtggttaagccaccggtctgcagtgcctcaggacacagacacaggtggtgatgaagccaggcgagaacattttgaatgcatctagggatagaatcggcaggacttgctgatggatccaatgcaggacaagtaggtgaccctgaggattttatttgagcaaatggtgcagtcaccagtcagacgggggacccccgggcaagcacagtgcagtttctttgcaggtgcatccatgaagggtgtgatgcctaccagacattcaggagctgcagccaggtgggcagcccacaggggagtctgggcttctgggaggaagatgcagagccgtcctggacagggcagcagcagcaccagccttcactggagccggggcctgcagcctccattggtggcacacccaggtgaggtcttcacactgcctacactaaagcaaatgaacaacaaaaatcatgagagacccttggatcagttttgcacgggagaagtcatttctttcttttctttttttttttttcaagatggggtctcactctgacacccaggctggagtgccgtggcgcgatctcagctcactgcaacttctgcctcccaggctcaagtgatgctcccacctcagcctcctgaagctggaaccacaggcatgcgccaccacacctagctgtttgtttgtttgttttggtagagacggggtttcgccgtgttgcccaggctggtctcaaactcctgagcacaagcgatctgggattacgagtcactgcgcagggtggggagaagtcatttctatgcgcctcggggaagcagtgtggacaaggcccgcagggccctgctcttgggctgattcccttgagggagagcctaatgtgtaagtgaaaaatgaaatgtgcaggagagccactggtcaagcagcagtgctggggcagcaggccctgtcggggatgccagcaggctcagagcacagccaggaggagccggcctccagacaaaagcacatttgctaaaataactttgagaaattttttaatgtttttcaaatttttaccgaaatttagaaaaatttcctctaaactttgcttaaaccgtgctaaaaagtggggacaagcctgaacaaaggcctgacaccagcaaaggtcagcgagcagtgcagaagaggcgggaaatattgccaggaggtggccaggcaaggagaggcgagggaggtccccagagcgtctccccacccccgattggacccaaggcactgggtagtttgccgagggcagtgcagccaccttgggccagggtcccagccgcttgccctctgtcaggagttgctttcttttttttttttttttttttttgagacggagtctcgctctgtcacccaggctgtagtgcagtggctccatctcggctcactgcaagctccgcctcccgggttcacgcgattctcctgcctcagcctcccgagtagctgggactacagttgcccgccaccacgcccggctgattttttgtatttttagtagagacggggtttcaccgtgttggccaggatggtctccatcgcctgacctcgtgatccacccgcctcggcctcccaaagtgctgggattacaggcgtgagccaccgcgcccggccaggagttgctttcttaggtatctccttggatcatgagtttcagcgaggaggggtcgtctgcacaggaaacacgccccggccgttggagactcgctgctgcccccacgaggcactgctcctttggagtgagctggccaagcacaacacagagcctgctccccaaactgggcgggacagcgccaggcctacagtcaccacggaatgtgctctctcactcagcgcctctcctggagcctgagatggctccattcagcactgcaatcctcccagcgaaccccagccaacccaaacagccttgtttgtgcggggctctgtttcccagtcaggatacagggcagcagggcgggaaggagcctcagcagctccccagcagcacacaccaccggcctggcttccctgctctgttcgggaatctcctcccccacaccccccgcagcccccagccccccaggaacacttccccagtgggctctagcctcacctacacagcccccaccagacccctgcgcccgtgtctcagaggctgtcacagagacaaccgatggccctgcccatcatccagctggtcacgccgatgcctcccccacctcccgcaccacatctggtgccacacagctgtgaccaggtgtgactgtacacagggatggcccccatcccctctccactgtcagtgccctggccccaggcctctgctgtgcctttggggagtcctcccactgcccactctgctgtccagagacagacaaatatacattatccagtctgtgacagagagataaaagattcactaaaattgtttaaaaggatgagattctgcagattgtatttttcaaagatggccacaacacttccttctatcccacatgctcttccagaaccctgatactatctgtgaatctcagtgatctcattcccttataaaccatagaatgccacagaactgatgctacagagctcctgaggctggggcgcaagagataatgcagcatctgccttgggtgccagagcactatgcacagagacttggggccaccatgctttcaacgttgccaggctagcccacctgcacagaggtagttgccaggctagcccacctgcacagaggtggttgccaggctagcccacctgcacagaggtggttgccaggctagcccacctgcacagaggtggttgccaggctagcccacctgcacagaggtggttgccaggctagtccacctgcacagaggtggttgccaagctagtccacctgcagagatagttgccaggctagtctacctgcagagatgatataagacttcatggaaagaaacatgtccagccagttgctccagctccagccactgtctgcctggaatggcatgaactacccagctaagatatcctgaattcctgacccccagaaaccatgatagatagtaagactaaattgctattttaagtcactaagttttgagttgttatgcagcaatagataatgttatgcagcatttcataacagaataaagtgcacagagagacccacaacatgtagccaattgattttcatcaaagatgaaattggcaattcaatggggaaagtcaaatattttaaacaaatagcactcaaactattggataaattgggaggatgaactttgacttctacctaacaccgtacgcaaaaactaattcaaggtggggcgcagtggctcaagcctgtaatcccagcactttggaaggccaaggcaggtggatcacttgaggccaggagttcgagaccggcctggccaacagggtgaaaccccgtctctactaaaatacaaaaaattagccgggggtggtggcacatgcctgtgatcccagctactcaggaggctgaggcatgagaatcacttgaacctggaaggcagaggtggcagtgagcagagatcgcaccactgcactccagcctgggtgacaaagtgagatcctatctcaaaaaaacaaaacaaaacaaaaactaattcaagataaaattatagtcctaaacataacaataaaactgcaaagcttctagaagaaacagaggagaatatatgtataagcttggagtcagtaggcaaagatttcttggaaaggacacaaaaagcatgaaatataaaatttttaaattgatacattggattatcaaaattataaacatctgtttctcaaaagataacattaaaatgaaaataattctggtgtggtgactcactcctgtaatcacagcattttgggaagccaaggtgggcagattgcttgagcccaggagtttgagagcagcctgggcaacatagcaagaccctgtctctacaaaaaatttaaaaattagctgagcatggtggtggacacttgtggtcctagctactggggaggctgaggtgggaggattgcctgagcctgggagtttgaggctacagtgagtgatgattgagccactgcactccagcctgggtgaccgagtaagatcctgtctcaaaaaagaaaaaaaaaaaaagaaagaaaagaaaagaaaaacaacgaccaaaagccattgtctcaagaaaatatttgcaaggggcatatctgacactgaactggtactcatattttttattattgatttgcagaagttctttatatattcaaagttataaaataggcagaattaatctgtgattatagaacacaggtcagtagtggcctggactggggtgggggtgggagggtgggaattgactgggaagggacacggaacactttccaagggtaatgaaaataggatcttgattggggttttggttacatgggtttatatatttgtcaaaattcattgaattgagaacttaagatgtgtgtatttctctgcatgtaaatttcacctcaataaaataatttaaaataaacaaaaagggaaatgggtatccaatctgcagcaagtaggttaaaataacaacgatagctatttcagttcctttgcctttccatataaattttagaatagtcttatgactatttgaatatccactaaaaaacctggcttatatttttatattttgatgtataggaatgtatttgggcataactgacatctttacaatactgagtcttctaatccatgaatatggtgtatctctttctttatttagatattctttggtttatttcatccacattttgttgctttcagcataaaaatcctacccatgttttgttagatttaacacctgagcactttactttttgagagattataaatgatactgcttttttctttttttctttttttctttttttttgagatggagtctctatctgtcacccaggctggagtgcagtggtgtgatgtcggctcactgcaagctccatctcctgggttcataccattctcctgcctcagcctcccaagtatctgggactacaggtgcccaccaccatgcctggctaattttttaaatatttttagtagagacggtgtttcaccatgttagccaggatggtcttgatctcctgacctcgtgatccgcccaccttggcctcccaaagtgctgggattacaggcatgagccactgcacccagcccaatgatactacatttttaaagaaatacaattgatttttaaaatttttttatttttattttttgtagagaaaagatctcgttatgttgaccaagctggtctcaatgtcccggcctcaaatgaccctcctgcctgagcctcccaaaggtctgggattacaggcatgaggcatcgagccacagttggtttttgtatgtcaatcttatattcttcaacttgctcaagtgagaagaaacaatctgcctgatctcaaggcctattccataattatggtatttaaaactatatgggattagcagaagggtggacacatagatcagtgaaacagtagagaactcagaaatagatccatataaacatgccctagtgatgttttaaaaataaattttattgtgtatatttgaggtttacaacatgataggtttttttggtttggggtttttggggtttttttttgaaacagggtctcactctgttgtccaggctggagtgcagtggtgcaatcacagctcactgtagcctcgaccttccaggctcaagtgatcctctccctcagcctcccagacagttggggctacaggtgtgcaccaccacgcccagctaatttttcatatatatatatatatatatatatattttttttttttttttttttttttgtagagatgggatttcaccatgtcacccaggctggtcttgaacttctgggctcaagcaattctcccacctcagcctcctaaagtgctgggagaacgggcgtgtccctagtgatttttgacagaagttcaaaagcaactcaatgaagaaaggatacaacaaatggtgctgaagcaaccggacatatatagatgtgttaggccattcttgtattgctataaaggaatatctgagactgggcaatatataaaggaatgaggtttaattggctcacagttctgcaggcttcacagaaagcatggtggtggcatctgttcagcttcttgggaggcctcaggaagctttcaaccatggctgacggtgaagggggtcaggcatttcacgtggcagagcaggagcaagagctaggggaggtgccaacacttctaaatgagtagatctcatgggaactcactcgcaatcacaagaacaccaccaaggggatggtggtaaaccaatcatgagaaatccacccccatgatccaaccatcacctcaaacactggggattacatttcaacatgagattttgtggggacacagagccaaaccatatcaataggcaaacaaaaacaaaaccagaaacctcaatctcacatcttatttaaaaatcgactcaaaatagaatgacaggccgggcacagtggctcatgcctgtaatcccagcactttggaaggccgaggtgggccaatcacctgaggtcaggagttcgagaccagcctgggcaacatggcgaaaccccgtctctactaaaaatacaaaaagtagctgagagtggtggtgggtgcctggctgaggcaggagaatctctggaacccaggaggcagaagttgcagtgagccgaggtcgtgccaccgcactccaggctgggtgacagagcaagactcaagaaagaaagaaagaaagagagagagagaggaaggaaggaaggaaggaaagaaggaaggaaggaaggaaaaagaaggaaagaaggaaggaaggagaaaagaaaagaaaagaaaagagatgccatctcaaaaaaaaaaaaggaataataaactgaagtttagaatgtaaaactataaaactttcagggaaaaaaatacaggagaataatctctaggatctagagctagggaatgagttattagacttgactcgaaaagcaggagccataaaaagaaaaattgataaactggactccattaaaattaaaacttttgctctgtgaaaatttctctgttaaaagtggttctgttacaagaatgaaaaatcaagctacagactaggagaaaacagttgcaaaagatatatccaagaaagggctagtactagaatatataaagaactcaggctgggcgcagtggcgcatgcctgtaatcccaccaatttgggaggccaaggcaggcagattacttgaggccaggagttcgagaccagcatggccaacatggcaaaacccatccctactaaaaatacaaaagaaaaaaaaaattagccaggcgtggtggcacccatctgtagttccagctactcaggtggctgaagcacaagaatcacttgaacccaagaggtggaagttgcagtgagtcgagatcatgccactgcactccagcctgggcgtcagagcaagactccgtctcaacaaaaacaacaacaaaaaaaccctctcaaactcaacaataataaaaatccaattagaacatggacatgagacatgaatagacatttcaccaaagaggatacacaggtaacaaataagcacatgaaaaatacatcattaatcattaaggaaatgcaaattaaaaccacagtgatatcactatacatctattagagtggcaaaaaaagcctggacacagtggctcatgcctgtaatcccaacaattcgggaggccgaggcagaaggatcgcttgagtcgaggaagtggagctttggtgagctgcgatttcaccactgcactctagcctgggtgacagagtgagaccctgtctaaaatatatatataatttttttaattaaaaaaaaatggccaaaaaaggtgatactgttaaatgctggtaagaatttggggaaactagagcactcatatactgctagtgggaatgtaaaatggtacagcttctctaaaaagcagtttggcagtttcctttttttttgagtcagagtctcgctctgtcacccaggctggagtacaatggcgccatctcggctcactgcaacctctgcctcccgggttcaagcaattctcctgcctcagcctcccaagtagctgggactacagatgcatgccagcacacctggctaatttttgtatttttagtacagaactacttggcaataaaagagaaagctatcaacacacagtaacctggattaatctccagagaattatgccaagtgaaaaaagccaattctaaaacttcccacactgcatgattccatcaacgtgacattcaaaaaatgccaaaatcatggaagcggtgattgagagactcaggaggggaggagagtggaaaccgggcatggctgtcaaagggtgatgggaatgttctgtgcctcaccttgatcaacgacaacatctagcttgtagtattatgatattataatacagtgtttcaagatggcatcattggggaaaactgggtgaagggcacctggactctctttgcattgtttcttatgctgtatctcaaaataacaggtttcattttaaaaatatacaaacccttgtgactaatttaatcgacgtatcctactagagatacttttctggggagccgtggggagcctaccacacccctccttgtggctccattagcctcttctcacttagaccagggatgatggtgaggtggtgccaaggaacgtggtgggtgcagctcttactccaaagtcagcgaggagcaaggaggaggtgtttgcgctgtcacttcagcagtgaccagattgcagacagggaggcaggtaagactaggacttgaattgtgtgtggtcgagacgaggagttgaagagttaaatcctcatcctctggaatggtaagtcaacacacagtgctaaaactatttgccatggaaatgtctcccaccgtgaaagtgttcatacgcttctgttttgttttgttttgttttgagacagggtctctctttgccacccagactggagttcagcatgatcctggttcactgcagcccctatctcctcctgggctaagcagtcccctgacctcagcctcccaagcagctgggattacaggcacacaccacagtgctgggctaattttttgtattttttatagagacagggtatcgccatgttgcctaggctgtctcaaactcctgagctcaagtgatctgcctgcctcggcctcccgaagtgctgggattacaggcgtgagccaccagcgcccggcttccctctgtattttaatagtcttcagcatgatgttggccctgtaataaatatctagacaccaatgtctctctatataaagatatggatagactgataatatcatagataaaacgatattttatgattaattattattattattattttttgagacagagtcttgctctgtcccccaggctggagtgcaatggcgcaatctcggctcactgcaacctccacctcctgggttcaagtgattctcctgcctcagcctccccagtggctgggattacaggtgtgcgccacaacgcctagctaatttttgtatttttagtagagatggggtttcaccatgatggccaggctgatctcaaactcctgacctcaagtgatccacctgcctcggcctccaaaagtgttgggattataggtgtgagccactgcgcccgactgattaatttttaaaaatcacagtgggtagctagtatttgtggagccccttctctgaggccccgtggtcccatctggacctcgctgcactggggagccaccttccactgttgtcccactgtacggatgaggagcccaagctctggtccaggtgtgagcaagtgacaaggagccaaggagcccttcccttcacaggtgcttccctgcaggtggggtggccaggtgtcctcagaccgggtggctctccctcagggaccggggtggggcaggaaggaggaaggagttgttgcgcattcggcacaacccatgcctgctctgctgccagccgcgtggaagcttgattgccatacagcacagactgctgcctttctatgttgctgactgtttttaaagaggggttttgggaggggtggtatgaaattgattgtttctctctttcctcattactgttcgcacctattttgggtgttttgtttttccctgtgcttcctgtcctctgtgcactagggaagcctctcaaatggcaacagaaagtggttggtttctttgaagagcatttgaactgagtgaattttcaaaaagcgtggcattgacagaacaatgaaagtcccaggataaagtccaggccagttgccatgacagacggcatctgttgttgacagaaacatggagccaggctgaaactccggcggcaggagggctgcgcacctgggcagggcagtgccgagcacagctcccagtttgggtagccagtgggactgggtctggtaccagccttgatttcggactggagcagagtcacccagttgtgcctctgttttgttttctgtggagcagtggggggcccaccacacccctcctcgtggcttcattagcctcttcttgcctgaaccagggataatggtgaggtgatgccaaggaacatggtggatgcagctctgcctccagagtcagccagcagcaagaacgagccatgcaccatcactgctgcagtgaccggactgcaccccgcagagctctgatcgcctctctgggggctgccgtaagaaaacacctgggtggtctcagaccccagcactcgggtggctcctctgaaagagatgttgttcccgactcccagcctgtgggtagagaaggtgccaaccccacgagagtctccaggccctgggcctgcttggacctaatctgcttacagttcatgcaggttctctatccaggccttgccctcctcccagctgtttcctagtctccttcatcctgcaggagctgcttttggtctcactgtactttgttgagtaggaggcatagcagccttgagagctagaagggtccccagccatcacctgggccaagtcccgccgtggacaggtgagtgtctactgttttgtaggggcagagactcagcccagggtcccacgggctgctagcactggcgtgaggcagaccattcacctttgccgctgcacgggtcatatcctcccctctcagccaacgtgctggcccagcctggactggcccagcccctcttccctgcttctggggtcctgttcaccccacgagccctctctccagctcttcttggataaagccccatgcccaacatggtcccaggcaccggcttttggggcagtcctgggatcgccagcagatggagctcaagggggtcatgcagaccccacccaggcctggctcccaggggctcccaggagggaacttcctacccattgaaatgcaaacgctggaattccaagaagcacttcagatacatacaagtcctgattgtgtttgattcctcctctggatggaaggcttccctctctgaagtcagacgacaaagcagaggcctgggactggtggtataacccagagaccctgcctgcctggcactggtggtacagcctgggaccctgcctgcctggcaccggtggtgtagccagggaccctgcctgcttggcactggcagtgtaacccagggaccctgtctgcctggcactggtggtgtagccggggaccctgcctgtgtaccctctgtccaagtcttggggtgcccctgtattgtggtttgaatgtttgtctccacaaattcatatggtgaaaccctaccctccaggtgatcgtactagaaggtggggcctttgggaggtgattaggtcacgagggtggagccgcatgaaaaggattggtgcccttataaaagaagactggaggccgggcgcagtggctcatgcctgtaatcccaacactttcggaggctgaggtgggtggatcatttgaggtcaggagttcgagaccagcctggccaacatggtgaaaccccatctctactaaaaatacaaaaattagctgggcatggtggcaggcacctgtagtcccagctactcgggaggctgaggcaggagaatcacttgaacctgggaggcagaggttacagtgagctgagatcgtgccactgcactccagcctgggagacaaagcaagactctgtcttaatcaatcaatcaatcaatcaataaaagaagaagcctggggtcagacacagtggctcaagcctataatcccagcactttgggaggcccaggtgggaggatcacttgagcccaggagttcaagaccagcatgggctacaaagagagatctcgtctctacaaaaaatattttaaaaattagccagatgtggtggtgtgtgtctgtagtcccagctactccggaagttgagatgggaagattccttgagccagggagattgaggctgtagtgagctgtgattgggccactgcactccagcctgggcaacaaagtgagactctgccactacaaaaataaaaataaataataacaataataataaaagagggtccgagagatacccttcaccccttccaccatgtgaaattatagagaaaatatgatcatctatgaagtgggctccactctctccagacgccaaatctgctggtgcctcgatcttggacttccagcctccagagccgtgagaaataaatgtttattgcttaagccctgcagtctaaggagttgtgtcatagcagcccaaacagactatgacaccctgtattcgtttgctgaggttgctgcaacaaggtcccaccaactgggttgcttaaatgaggcggtaatgatggagggcgttcagcctgcactcagaaaggtctttgcagatggctggaggccctggagcctggaaggaggtggatctcaggaatttcacccacacacacacacatatctctggccaaatcaagttctttgcccatttttgaatcagactgtcttgttgatgatgatagtaggctctctttgtgattctcaaaaataacctcgaggatcagggcagccaagacagtcccctgaggcacaagtggggcatgggcccctgccccatgctgcaagatgactgggccctggcatgggacaggggcttctgaggatgcaggggtctgtagttggacccttggtttgaccagtgtctgtcacagtgtctgtctgggagtcacgggcccagaccctgggccagaggtcgggcaaggctttgcaggctgttttggtagcaaggcccaaacctggccaattgcatgctggccctgcaccagaagaaggagacctgcccaacaaggccctcacccaggccgagcccctgtgcatcagccctgcctccctcaccccacctgccgtggccagcacctgcccagggcccctctgctgggctccaggtactcccccgaactctaagccagcactcgaggcccagccccgctttcctggctatgcaggcttgtggcatgttgatcccccaacgtgaagccccaaggaaagagggtctctgccaccactccgggtgtatggggtcttctgatctgtgccgctgtgagatttgcggctggcagctgcagtgcagaccagaggtacgagtcctgccctcaccagtgccctccgcctgcaccccttgctggttgggaagtcctagagggaggactgggtggcacgctggcactgtcctgccaagagggccacacgcagctgctcaccaggcgagagggggcaggactcactcaagacgggcctgcagctgaatggctgtgaagatccctggctgcagaacgagcccttcggcaagagccccggggaggggacagagtaactcctttgccctgcaaggccccgcttgggtctccccaggttcagctcccaggtgcacctgatcatgcttccttctttggctgaaacctgctcggccacctctgaggggatgctggtcaaagcatgcagggttgagggctgagcctcgtacctcctgcctgcttttccggtgaggacaaggggcccctcctttcctgcaaaagcagcccctgtcttaggggctctgtctcctgctgctcccccatctctaggggaccctaaaagcctccaccactttaaaggcagcctttggaacaaggaggggcaggaatccacttcagtccaggacgtgacagccggctggccactggccacggaggtccagcgacatgctttccccagtcaagtggaaggactttggcggcatcctggtacagggtgtgtctgtctccaccaacggggaatcccctgctcagggctgatcatggctccagcctacaatgggtgcaacacatgcttgatgggaaatggggtccaacctggggcaaatgaggagcagggcagagctgccaccacgccctgcaagtgggagcaggagccctcacgcaggctggccccgctctgccaatggccctggccatggcacccggggatggcagctcctcaccctcctgacccacaccatccgcccccgcagcaatgtgtgctgtgcattctggggcaggcagagctctggctgtcctccatgggagaggcggcctctgtggcgttcagtccggggggctggagaggacacaatggcagggaatgagctgagactggggtcctcatcctcacccaggtatggccatcacctgaggcctcgaaaccaggtgatgggccgccaagttgagggctctggcaaccaccttccccgtgggagcctgggtgtgcaacaggcagtgcatttgcacgcagcaccagggtccagggaacagaggtcctgaagacgggacagtagggtcctgtttattccagagtgattttcagatctctcttgcctgactgggaggtagatgcagtggggagctggagccagtccctggagcccagcgctgagctctttgtgatggaggggtggggtgagccgcaggatctaggtcaccgtgctctggccctgctctctgcctttcgcaagcgcttgctcccgtgggatgtttgtcatgcttccatgcatgacacaggagaatatcaacattggtgccatttcacatctcttcattcatctgctattcttccaccttcagcttctcataaaatcacagaactgcagtgaggacctctgcctgccgggacagcctggggatggtcccgtgcagccccctcaggcagcatccctgtggagggttcccctccgccccctaccgtggggagctcttcccagctgagtcacactgcacgcctggtccctaccctgggctgctctctgtgttatcttgcaggcgccgtcccagatccttcaggggactctgaaggcccatcagatgtggctgcagacccacctccctcagaccctcagctctggatccaggctggctccctgccgtggagcacaggcgccctttgtagcactcactccagctgcccagggaatcggggacttggtgtggactgagactcagcccccttgaagccctattctgtccaccgctgcaagacataggcggctttaagcaggaccaggccgcaccctccaggcagagacagctgctgtgggttctgtgctcttctaatgggcatgtcttcccatcggtgatgaggactgatttgtgcagtgacccccttacatttttctgaaaaggagatcaaggaaaacattcttcagtagaatcctcactgtgcacacacttccccttgtgctcggtgacagccactgcctttgggagcagggaggacgccccagaacctcctggtctccgcacacccccctgagctgggctgagcacacaagcacccctctgcagacagtagaggttttgggattcagaatatgcagtctgaagctccccagagcctggctctttagtcaggccctccttgcccgccctgtgaatccacgcctaggagcctgtgcccccacccagcaggagctgatgctgctgagcttcccaggtgccagacaggggctgagtgtgggggccagggagccagtcgggagtctgctgcctggcaggccatgtcctgcagaagagaggccagcatagggcacggtgggcctggaggggctggagacagtgctgctgggtcggcagagctagagaagggcagcccaggcagggggcacactagtgccaaggtgcaggggcatgaagctgcaggtcacacggcctccctcggagcccccaggtactgggggtgggttcaaatctcacagggttggcgggcgagggcttcaggaacagcagggacaggagcatgagagcagtagaaaaatgcaggggtcaggaggatcatctgggacccaccaggttgctggtgaattcaggggatagaagggatgtgagctcaggcctcgagcagctgcctgattgggacagcccctggctgggccgcgaccaggtcacagcactttgcaggagtcaggcctgggctccacggtcgtgggttctagtctcggctgtttagtctcaagcagatctccaccgcgccctgacctccacttcctgcgtctactcagggtgaaaaaacaccccattcccagcacaggtcagggttgcccgagttgatcatgcaggtaggcctgtggggctctcaggtgcctgacaccctgcatgcatcttggcctcttccctcatcctcagcctcagatggactgagccatctggaacctgtcagtggtggcctcagccctaactgcagatgacaggcttgggagtgtggcgacatgtgtcacctggagcaaactgctccccctctgaagcctgtcacccacaagacctgctcccaagggccaatggcaggtgccttattctttcgtcgccatcaccgttgccacctccccaccagctccatccttctccgggtcccagccctggggcgctcactcccctgtgtgctgagggaggcccagcatggttcaaatgcagcctctggagaatttcttcactaagaggctttttctgaaaagagtcaagctatttgtagcccaagttggttgaacagatttttcttggtgtagcttatttttttattcattaacttcttttccttatgaattaaaaaatagcatttttttttccacaaaggagtgctttatttacttctttttgtaccacagccagcgcttcctctgcctgctggggaaagtggatgcacacacccactttggcaggcagttttctttcaagccatggcatcttggagaggtaagtgtgtgtgttcagaccactgccctgtggctccagcccccctgatatcagccacagccccaaggcttgggtgttgtttgtttgttttttcattttttttgagacaaggtctcactctgttgcccaggctggagtgcagtggcaccatcacggctcactgcatgcagcctcaaactcccaggctcaagtgagcctctggcctcagcctcctgagtagctgagactacagactcatgccaccacagccagttttttttttttaatttttaatttttatagaaacggggtctcacattcttgcccagactggtctcaaactcttggcctcaagtcatcctcccaccttggccaccgaaagtgctacaatgataggcgtgagccaccaggcctgcctggttggctttttggtgaacaggagcataataagggtttcactgggctgtcagcctccattgtggtggccagtatctcaaagcctcacctggcagaactggagacgcgtctgctgaccgatgccctcatgacccattttcctgacttcagaaatgtcccatgcagacactatgccatccagcaggcctcccagctagacagggtgcagcctcgatgtgtctgtggagggactcgggctgtccctgcactcacagtcatggtgaccaaagtcccagagtaagggagcagatgccgcttcccccttccagcccaggcattttacatgaggcgctgacccaggaccacccttgacttcactcttccaaggagtggctcccagtcctatatattccatcagcctccaggctggctgtcccttaaacactggtctccaatctaactgcatttctgtaagtaatcttttgggacagacttttttaaaaaagatcatgtttatgccgtattcctcatctttcttgtcttctatctccagatttgttttaaaacctattactcctgtatacatgtgcctcccaccctttgagctatgcccttgacctgctatgcacttgtctcaaggccaagttcaaaccccctaacccaaggctgtccagagctgccctgccacctgagccatggggaggggcgctgagctggtgcctttcacaggctgcctgcctccccctgggcagggctcctgtctctcctcctttgtctccacaagcacaggcttgcatgggtcagcacgtggtgaacagccaaccatcattttccaattctttccaaaaagtcctgtctatgctcagaagtcctgcctggccctttgagtgcccctacccccacacacacattcttttttttttttttttttttttttttttgagacggagtctggctctttggctcaggctggagtggagtgcagtggtgcgatctcggctcactgcaacctccgccttctgagttcaagtgattctcctgcctcagtctcctgaatagctgggactacaggcatgtgccaccatgcctagctaattttttgtatttttaatagacggggtttcaccgtgttagccaggatggtcttgatctcctgacctcaacacacatttctttatcgaaattccaaattctccaaagctcagaaacataaaggtttttcaaaactcagtggcaaagctggacctgaacgatgcgccatcacttactgtctttatttcttccagttcacctgaatacatatgttttgccccgaaaatataaatgggtctgattatgaggagcagccccaggttccaaagaggtgccacataatgtatgatgtatacaaaaaagcctgagttccaaacacatcttggatgagaggttgggactgtgggggatccctacactggttagagttctagacccagagcagggttatggtcaacggcgctctggccacagaatgcagcagagcaaggactgtggaacaaagacgcggcttacatgaatttttcacttaccgtgctgggtgctggtgattcagagatggaaaggccctagcgacacccccctccacccagggagcccacgggccagcagagggaccaaggggcacaggacgggtggggagcagaggcggattccctggctgtggaggtactgtctatacggggtgcaggagacatctccatacaagggggccctcacctggggaggtggtgaccgcaagcctgacagccccaaagccttcagagatgccgcctggggacactttgggaaagtccaggcggaggacacctgggaatgtgatagtgacacaaatgaccggagagacttgctctcagtcactgagtctggctgactcactgaagattagggcctgaacttccccctctgtaaatggggtgcaggccctggccctgccttcacagtgcccctcggtcccctacaagccttctccgcagggtgggatcgggtctgcctggagcatccccacagcctatgggtcagcagagaagcaggcgcagagctggggtgagacggtcagggccggtcctgccagacacctcagatcactcctcttcacaaataatcccattttacagcccaggaagagagaggccggaccactgcccaaaagcctgtggcctacagcctgccaggtgcgtctgctcgcagagcaggtctgcgcagcaccgagcggtcagcaggggcaatgctgggcactggccagccgcgccaggaccatccctgctgacctcggcggggtggggcggagcgtgcagggtctggcccggaaagccagggcaggctttagagaagggccaccggacggatggtccgaggaccggcatggacccgggtcccagcgagggcggggggagcgtaaggctgggcctgggctgcggcaccggggaggtggcggggaggaggccggcaggaacagccgtgcagggcgggggcggcgcgggtctggtcgggtgaccccgggcgcggccagggctgtaggaggcgagggcgtcgccccgaggccgtggtctcgggtccatggtgggggacctgggtccccgcccccccgggccgccctgggtcgcgcgtgggcgcggcgggcgccgattggctgccgggcgcgcgggcggagcgggcggcggcggcggcggcgcggaggggccgctcaccccgcagcccggcctcggcctccgccgcttgtcgtcgcgccccgcccgcgagcccgccccgcacgtcccccgccggcggccaccatgagcacaggcctgcggtacaagagcaagctggcgaccccaggtgagcccagcgcctgcccgcgtgcccgcgcgcgcctttgtccccgccgcccgcgcgcctctcaccgtgtctctccgtctctcccccgcccgccggcccggacccgctcggaaccggacccggactcgaccccgaccccgaccccgcagaggacaagcaggtacgtgcgcagcgccgctcccccgccgggagacccggccggctgtcacccattgtgacactagcgccttgggcgcccaggcgcgaccccgcccccgccggccctcacccagccctgtcgcgatcaccgattgtcagccgggcagtgccgccgcgcctggggcttcagaggagaggagtgggggccctggtccccggacccgcacagcagggaccctgcgcccctccccaggatggggggatgggcagagtgtccccctcccacagggccagtgccagcatctcctgctgacctggcctgtaggccatgagctgggggtcctgggtgaggccatggtcgtggcaggccacgctgggggaggggagtcaggctccatcagccagcacagtccctgaacagccctacagcagagggcctgtggtcaccacccacctcccctgcaccttcatgcccctttccctccccatacacaaatttgagtgttcaggtctgcaacagggactcttccccagattgggaacccccagggtctggtctgagtcattctgggtgcccagatgggtcctgggaccctgtgggtacaaataggcttgtggcttctcaaaagggttggccccaccctccaggaaagcaagactggacaggaggctggtctaggcacctgggtgaaacccagccgagctcagggttaaacaatgctgtgaggcccctggggtggggcgggggctgacaaccaggtgggctgggggggctggggaaagcctgctggtgtcctctctggcttgagctcagccatctttggaggaaaaaagaagagcccaattctggcaccagggtggcactggcagcccccatcagggatggagtttctcaggagccatggatgctgagtggaactccagagtcctggcccagggtgcagcaggcagggcaggagggcgggcaggggggccaggagctgggggagtcactggctgaccagtgccattctcctggaagggacacaccccacccagaggtggatgaggctctctgggaggggccccttggggagccaggctgggagctgcctccccatcacagcaggtcagacaaagcctgagatgcagggacacatgcgtcaggctactgtttgagggaaatggaaggaactgaggctgggaaagccaggaggccaggcccctgaggcttctcctgtgcctgcaggtgtccccagcttgacccaagggcactctgagaccctgggctccagccactgctgttgggtgcagccaggttctcttgcccattactgcagggtggggaccccctcctgctgaggtgcccatcgtttgaggtcaaccgggagtccacctcaccccatcccaggcctcccaggcctccaagcccagaggaagaaggcactgtgtggccaaggaagggagccccggagcaggagccaggccaggtgtctgggtgaccagtgggtctgggggagctggaagcacatggcagcttccctgctaccaccgttgctgagcctcagcctgtccaagcattctttttgctctttgaaagggggctgtagaggcattgggggagttccgtcactacgctctgtgcccccacctcctcacaggcagcaccggtgatctcttggccctggctgctgctcccagagctgactcgggtgattctaagaatggaagtgccagagaggctcaggcattgggaggagatgggcgcagctgtgtcatatggctcaggaagccctgggagtatcttttgtcacttggggaccagagaaagggggtggcaggtacggccccttccttgaggctcccccagggaatccacaggccctgactgggccccagtgggtggcagggcaggtgggttgaacgctgagagtgagattcttgccctcctgacctgggcctccccagaggctgtgccttaccaatggggaaactgaggcaggcagtctgagagccacacactctgttagacacctcctagcctgaggcctaggcccagggctgtctgtcttcctggagatgccctgggcctgagatgccagcctgtctgggtgggtgctgggcttcgaggtgtggaccctcagttggaaactgggtgggactcagcctagaggcttcctgcaggtcagggccatggaaggctggggccagtgaggaggctttctggcagcaaggactgagggatgcactggtagagctggggggcctggagctgccccctttccctgggatgaaaggctctcctgttcccagctgtgggcctgcccctcctccccaggtgccagtggtccaggccccacaacaggaccagggcctggacaggaagtggaggaggtctctcagccaggagagcctaagggagggctggtggcgggtggggtggggtggggttggggcctccagcttctaatgttctaatgtgcaggggcttggcctgaccagtcctaccctggaacctttccaggccccatgtcctgctccgctgggcttgcctgttgggattctactggggtcatggaggtgggtggcccacagagcggagctcgggagacccccgcagtccctggagtagccacatgggagggaggcccggctggcaggagctcccagtccctccaatcctgtgggtcagagctggtgaggatgctcagagggcaagggaatgtccacagaagcacgtgggagatgggtcccatcccacccccacccctgtctctgagggcagggccacctgagggctgcagggcagcgcatgggtggccggcgtttattcagcaggctggcgggggcttccaagttttgcagggacctccagtactccggcagcctgcacccttcctttcccttcccttcccttctgtccaccctaagcctcctaggggacaggcaggctggacttcagaaaaggtgggctctgccctcctccggtcccccgaatgtcttgggaaagagtccaccaaacacacatgcacacacccgcgcacacgcacatacccaatgcatgcacacacgtacacacacacgcatacacgcatgtatacacgcgcacacacgcaggcattacacacacacacattacacacacacacccgcacggacgcgcacacacaaacgcgcgcacgcacgcacgcacgcacgggggaggtcagccccaagcagggctggggaggggtgcagggcgcggcgtgtctgtgggcacttggggcgtcgagacgccgccgggaggttttcgggcaagtctgcgagaagacggcgggccctgaactgggcgggtacccgcgctgttgcgcgtgggtcccgggagcggcctccggcgccctctggcgggcggaagccgcgcagcacctcttgggggcgggacgcgcggtggctaccgactcccggcccgccccggcccgcgtgcaggacccggtcgtcccctcctgctgtcctggagcccggactgaggccccgggggcgcggcagggctcccggtccacgcgagccatggcccgaccgcgcctcggctcagccctgccctccgcagccgctttcgggtggctccgcccgcggcccaatttccaggcgaccgtttcccggcgacggcgggcggggccgtctctgccgccccccgccgcgcgctccgcgggcgcctgcgacgccccgcctctggctcgggtgcgggagcggggcctgcccggactgcgacgccgccacagcttggggccagttcgcccagtcagggggatggctcggtcggcctcgggggtcgacgatcccccgggtaggcgacgtgccctgtccaggcctcacttcccgcgtccgcaaaacggggtggacaacgcagcctaaggcagagccgcgccaaggtccctcgctgtcgccgggctctggcggcctgaccgggcctggggtccgagcgtgcccccgggcctgggggggtcgccgcgatggactcgctggcagcgccccaggaccgcctggtggagcagctgctgtcgccgcggacccaggcccagaggcggctcaaggtgcgtgtgtggagagggcggaacgtgggtctgtgaccccgcgggctccgggactcggcatggggtccccgtccccgcgcgccacggcccgccagcgcctaggctcagcccttccctccgcagcggcctcgcaggtccgcggccccacggtggggcgacgtgccctgtccaggcctcacctcacgcgactccaaaacgcggcggagaatgcggccgtgggacccctccaggggccccaagggtctgcgggggctgggcgcctgggcgcgcgggcgggggaggctcggcgccgcggtctataaataggcgctgctccgccaccgccgctgccgccgcccccgcggctggatccgggccaggtggggcctcccgccccctggcactctccggaggggtgagtgtcgaggcccccagcttctccggcttatggagggccttgagtgtgtcccaggggtcccaatcctgctgccctctgcccgaggagggaggacatcgcctgtgcctgctgcggcctgacatctccccacggaataaatacagtgtcggtccctgcagagccctccctgggattggggccaggggtgccttctcctgccaccacctcgcctgccttcttatctccaggcttttgcccacgggccctccccttatttttgccaacgaaatgccccaccctgggaaccgtaccctctgctgtctcctcataccgcatttggtaagagacagggtattgggcttctggagaaacctttgtgtccctaccctgttccatcctgtccccaggacattgacaagcagtacgtgggcttcgccacactgcccaaccaggtgcaccgcaagtcggtgaagaaaggctttgacttcacactcatggtggctggtgagtgggccaggctcctcgggggagtggctggggtcactggccagccaagctctgtcgttggagccccagacctaacgcagctccttctctgtacctgtgtgcaggtgagtcaggcctggggaagtccacactggtccacagcctcttcctgacagacttgtacaaggaccggaagctgctcagtgctgagggtgagtggcccccaggaggccctggcactgatccccagtccccttccatgggacctctccaaggactccctttcaggtccagctcccactgttctgttctcgcggtgtgggtcccctgggggtagggccaaggcaccaagatggatgaggacgagggtcctggctgccaagggtgaggggctgagggttggagaggcccttccagtggccccttccccgtagagcgcatcagccagacggtagagattctaaaacacacggtggacattgaggagaagggagtcaagctgaagctcaccatcgtggacacgccgggattcggggacgctgtcaacaacaccgagtggtgagtgaggcctgctgagaaaggccttgcctaggcggccacagcactcgaggcctggcctcacctccctcctgcccacagctggaagcccatcaccgactatgtggaccagcagtttgagcagtacttccgtgatgagagcggcctcaaccgaaagaacatccaagacaaccgagtgcactgctgcctatacttcatctcccccttcgggcatgggtgtgtggctgtcctggggccaggctcgggagtgcagcccctacaatatggccccctggctgtgcctatgcccacccttggctgctctcggcaggctgcggccagtggatgtgggtttcatgaaggcattgcatgagaaggtcaacatcgtgcctctcatcgccaaagctgactgtcttgtccccagtgagatccggaagctgaaggagcgggtgagcctgccgtcgcacaggggcctggccagggccctggggctgagagtaccagggggacttgtctggcctcaaatctgatggtccttgccccaccacagatccgggaggagattgacaagtttgggatccatgtataccagttccctgagtgtgactcggacgaggatgaggacttcaagcagcaggaccgggaactgaaggtgaacatgcagactggtggggcaggggggatggagctggtgaggggcagaaccagagggctttgtctccttcacattgagcctgctggaggagggccaggtcagcccagttgggtgcaagagtcatttgttctaggagtagaggacctgtacccccttcatccagggctagaaggtaaaggtcaccatgtctttgcctggctggggtgggtcatgtgggccccgtgtggtgcttggcaggtatggagcacttgcccagatccagaggtgcagcagtgggccaggcccccaaccccaaccctcttcccatgggtcaccagaggaaggggctgccccagtggcacaccctggctcccagatttctgagctccagggttggtggctttgggtgccccggcagctagagtgatgatggagaccatgccaggggcaggtggccaccagggcaggggcatcagcatggggagacataggctcagccctggggagggaaggggcagctggagggggtggttcttgatgagggaggagatgaggagggagcatgcctggttgggcatagcctggaaaggccctggaatgtgagccacatgggctctggctccagccaggggcagagaggccagaaaggggcaacgccaggatctctttgaggagagatagttgatggtgatgctggaggggtgccccgggagttacatgcccgtttcccatcagtaaccgtgcaattacgctcaccgggtgtgagcctttctccctccttcccccaggagagcgcgcccttcgccgttataggcagcaacacggtggtggaggccaaggggcagcgggtccggggccgactgtacccctgggggatcgtggagggtgagtagagtcttggggtaccaggtctggtgggggaaggctgtcctgggccggcgccagcccactacccacccccaccccgcagtggagaaccaggcgcattgcgacttcgtgaagctgcgcaacatgctcatccgcacgcatatgcacgacctcaaggacgtgacgtgcgacgtgcactacgagaactaccgcgcgcactgcatccagcagatgaccaggtgcgcgccccagccgcgagccagacctcgcccctctggccccgcccacgtctccataactgagggccggtcctgtcagcccacccagacttgaactttgcaccattccctaagccccccccctcccccagagcctggtctccctagaaccaagtccagggctgtgagggctccggagggcagggcctcagcagtggcggggatgggccaggcatcgccagcccacgctgagcctcccggtggcgccgccccgcccatcctcccccccgccccgcgcagcaaactgacccaggacagccgcatggagagccccatcccgatcctgccgctgcccaccccggacgccgagactgagaagcttatcaggatgaaggatgaggaagtatgtggggcggcgggggcggcggaggcgggcgtcagggatgctcctccgcggtgctgctcacccgccgggttgtctccgcccgcagctgaggcgcatgcaggagatgctgcagaggatgaagcagcagatgcaggaccagtgacgctcgccgcggacacaccgtccgtctccgggacgccctcgcacccctggacaccagaccggactgttcccgacccggagacgcggggccacagcccccagctgaccctaatttattctcagcaccaccccctcccaggtcattgtgtctgtttccgaggggcctggaccgtagcccccgcccagctggccctctctgaccttgggggatcaggagcgaagttgggcgggacttcagagatccgcctcccttgcccttcccccgcccccggacggtcacagcacccaaaccgcaggccctgctctggcaggcaggcaaagctaggcagaagaggattcccaggatcctgggtctgttccctgccccagtgctgcagaacggacttgggagccctcctttgcctgctcccgcgggtcacccagcgagtgctgagaccccattttctgtcgaggcgggccgagtcttcccttatccccagacgcctagcgggcagggttgggctgaatcaaatgggagccctccagacataaggaggccagaggctgcaaggagcggggtcgtgaccgcttacaccccttctccacagcccggcccgacctggagggcccccggggcactgggcggtgagccacctcctggcaactctcggtgccgtcccctgccctcgctcgaggcctcttctccccagcaccgctgtggtgtgccgggatcctgagcctaggcctcccgatgttcccacccgcatgatcccttcccgccacacgatgctccgttttcttccgttgtgaatgccgcgtcctgtcctggtgacaggagaacaatgttggtgaacgtcgcagcgggtgtccgagtgctccgtgtgcccctgagagcgggtgggagcggaagcctgagcggcctgcggcctccggcgatagtgtgctatctgccgctgcagcgcgcgtccgcgcggcctctgggctatttctggccaggccgcagcactgtggtcggtgcgggcgtggcaggggcggggcggccttatcgctcggctctcccgcctacgcctcccgctgcagagtaagccgggctgccgtcttctcgccatgggctccggtgagtctggagtccggtcgggcccccggctgctccctaggccgacccgggttgagaggagctctggtcgtttggctgcagctgggagagacttgggtcagacttagaggggacttccagccggcgtgcggggtggtcagggtggagaggctggcgggctaccgggacgccgggcatcaggggctggatggagccgggccggcagtctgggtactcagagatgtcgcccaggtgcccgccgaccgctcggcttactgcggcgcttcccttgcagggccgcgcggggcgctgagcttactgctcctgctgctggccccgccgagccgcccggccgcaggttgcccggcgccctgtagctgcgcggggacgctcgtggactgcgggcgccgcgggctgacttgggcctcgctgccgaccgccttccctgtcgacacaaccgagctggtgctgaccggcaacaacctgacggcgctgccgccggggctgctggacgcgctgcccgcgctgcgcaccgcacacctgggcgccaacccctggcgctgcgactgccgccttgtgccgctgcgcgcctggctggccggccgccccgagcgtgcgccctaccgcgacctgcgttgcgtggcgcccccagcgctgcgcggccgcctgctgccctatctggccgaggacgagctgcgcgccgcttgcgctcccggcccgctctgctggggggcgctggcggcgcagcttgcgctgctgggccttgggctgctgcacgcgttgctgctggtgctgctgctgtgccgcctgcggaggctgcgggcccgggcccgcgctcgcgccgcagcccggctgtcgctgaccgacccgctggtggccgagcgagccggaaccgacgagtcctgaggagagaaccggtgcgtcctgaggagagaaccggcgctgggcaacacgggcctgcaaactcgacaggaccctgcccgaggggccctcgcgccaacctggaccggtccccgcctcctccgctgcccaatctctcagacccaccccacctgcaggcccagaccacgtgggacagaactcctgcccaccctaccccgagggaggcgaacccgcacttccaggcttgggaggaccatggggcacaatgcggtccagaccctgctgcgtctcccttccaaactctggtgctgaataaacccttctgatctggtcttctctgcacgactgacctggaaattcccctcgccaaactcaggaaaaggccccaggaggcggttcaaggggacacaaacacatcctcacatgcccaccctaacctcaggggcagacaggagtcagtgggtgacctctccccttccagacacactcccaaaaggccacatgggaaggcatgagagagatgctaagtgataacgtgggggccagtgaggacgttgtggggacactgaggaccctgtgggggcagtgaggatgctgtggggatgctgtggggacagtaaggacactgggggcagtgaggacgctgtggacactgcggacgctgtggggacaatgacgctgtggacagtgaggacgctgtgggggcggtgaggacactgtggagtgaggacactgggggcagtgaggacgctgtggacagtgagggcgctgtgggggcggtgaggacgctgtaggggcggtgaggacgctgtgggggcggtgaaggcgctgtggggatggtgaggacgctatccggggcggtgaggacgctgtggacggtgagaacgctgtggggacactgaggatgctgtgaggacgctgtgggggcagtgaggacgctgtggaccgtgaggacgctgtggggatggcgaagactctgtgggggcggtgaggactctgtggacggtgaggacgctgttggggcagtgaggacgctgtggaccgtgaggactctgtgggggcggtgaggactctgtggacgcggtgaggacgctgtgggggcggtgaggacgctgtggacagtgaggaggctgtggagacaatggggacgctgtagacaggacgctgtggaggcggtgagggcgctgtgggggcggtgaggacgctgtggacactgacgacgctggaggtaacaatgaggacattggggacaatgagtacactgtgggggcggtgagaacgctgtggacactgaggacgctgtgggggcggtgagggcgctgtggacgcggtgaggacgctgtgggggcggtgaggacgctgtggggaccgtgaggacgctgtcggggcggtgaggacgctgtggacgcggtgaggacgctgtggggacggtgaggacgctgtggggaccgtgaggacgctgtcggggccgtgaggacgctgtggacgcggcgagggagctgtcagggcggtgaggacgctgtggacgcggtgaggacgctgtggacgcggcgagggagctgtcggggcggtgaggacgctgtggacgcggtgagggcgctgtggggacggtgaggacgctgtggacgctgtcggggcagtgaggacgctgcggacgttgaggacgctgtgggggcgatgaggacgctgtcggggcggtgaggacgctgtcggggcggtgaggacgctgtggacgcggtgaggacgctgtggggacggtgaggacgctgtggggaccgtgaggacgctgtcggggccgtgaggacgctgtcggggcggtgaggacgctgtcgggacggtgagggcgctgtggacgcggtgagggcgctgtgggggcggtgaggacgctgtggacgcgatgaggacgctgtggacgctgtgaggacgctgtgggggcggtgaggacgctgtggacgcggtgaggacgctgtggacgccgtgaggacgctgtggggacggtgaggacgctgtggacgcggtgaggacgctgtggacgcggcgagggagctgtcagggcggtgaggacgctgtggacgcggtgaggacgctgtggacgcggcgagggagctgtcggggcggtgaggacgctgtggacgcggtgaggacactgtggggacggtgaggacgctgtggacgcggtgaggacgctgtggacgccgtgaggacgctgtgggggcggtgaggacgctgtcggggcggtgaggacgctgtgggggcggtgagggcgctgtggacgcggcgagggcgctgtcggggcggtgaggacgctgtggacgccgtgaggacgctgtgggggcggtgaggacgctgtcggggcggtgaggacgctgtcggggcggtgagggcgctgtgggggcggtgaggacgctgtcggggcggtgagggcgctgcggacgttgaggacgctgtggacgcagtgaggacactgtggggacagtgaggacgctgtggacgccgtgaggacgctgtcggggtggtgaggacgctgtgggggcggtgaggacgctgtcggggctgtgagggcgctgtggacgcggtgagggcgctgtggacgcggtgaggacgctgtgggggcggtgaggacgctgcggacattaaggacgctgtggacgcggtgacgacactgtggggacggtgaggacgctgtggacgccgtgaggacgctgtcggggcggtgaggacgctgtcggggaggtgaggacgctgtgggggcggtgaggacgctgtgggggcggtgagggcgctgcggacgttgaggacgctgtggacgcggtgaggacactgtggggacagtgaggacgctgtggacgccgtgaggacactgtcggggtggtgaggacgctgtggacgcggtgaggacgctgtcggggctgtgaggacgctgtgggggcggtgaggacgctgtgggggcggtgaggacgctgtcggggcggtgaggacgctctcggggcggtgagggcgctgtggacccgatgagggcgctgtgggggcggtgaggacgctgtggacgcggtgagggcgctgtaggggcgatgaggaggctgtggacgccgtgaggacgctgtggacgcggtgaggacgctgtgggggcggtgaggacgctgtgggggcggtgaagatgctgtggacgcggtgagggcgctgtgggggcggtgaggacgctgcagatgttgacgctgtggatgctgtgggggtggcgagggctctttggacgcggtgaggacgctgtgggggcggtgaggacgctgcagatgttgacgctgtggatgctgtgggggtggcgagggctccgtggacgcggtgagtacgctgtggacagtgagggtgctgtggggacagtgaggatgctctggggggcagtgagggcgctgcgcggacagtgagggtgctgtgggggcagtgaggacacggtagacagtgaggacgctgtgggggcagtgaggatgctttgggggtggtgagaacactctaggcagtgaggacagtcccagcagtgtgtctcgtcctctgagcatgttcaggggctggttcttgtggacagtgccggccttgaggacaccaagagcatttcaagggttgggtttcctgatgcagggactgcggcgttggcagcattcagttcactaggggagcgttggggcaggtgaccagggctggttcaggtctgttgctccatccgggatccctggaccatccgaatgagaagatggcctctatgtgacagagtcacatgcggtgggggttcttggagggccccacagcgatgagtggacctcaggggttgcagggtctctggaatcattgtgttctggagtgaacttgcccccccacaggctccaccaacacccccaaaccctcttcctgccatccctccccatcccacagcagcggccctggccccagaccccttctgccagggctcagggctggcagcctgctcctgccagccaagagccgttcctgtccctgcccacagctgctgccttccccaggctcccaggctgcaccacacggggcctgcatgttccttctgactggcacaaggtactctccatgccactgctccttgctcatctcctgtgcctctggcgagtcccccaccgggccaccacttccctcaggaaggcctctccgactgcccagaccagcaaggggcttctcagagttctccagtctctggcctcccactgccctgcccggattctggagctgagcaaacaggtcagcacatggtgcccaacttaggaggtgactgacgccttcctcactatttgggctggcctggggtgccagggacagggttcctctgccaccgtccatgtggcccccacctgtctggccttatgaacaatggaaactattctccatgcatcccagagaggccccagatgaggagcctcaggtcctggctgcccggcccaggaaggccctcagcccccaatggccatcactgaccaccactgaccgggtcggggaggctgccactgacatggcctttgtcctggcctttgtgggacaagacagatggccctcctgtggggctgatgctatctcgaggctgccagtcagacgtgaggcaggaaccacccctgcctttgtgagcaggtgcagggcatccggcccattgtgggctgcagccgactgtggttgtccatccggccttatcaccacatcgaggacagtggccccctttatacaaatgaactgcccagcttgccctccccagcggtggcctggcacctccagaggtcctagtgtaggtcagaggtaaccatcgtcataacaccgtgcatgtgcaacactctaaactcagtccaagcagggcaggggagggggtgtgctccccactttctctaagaaaccagatcccagaagggggctctctgctgggccccagagcattttttgtgtgaactggaaacagggctgaggcaggcctcttgcatcccttctctgcctcactgaggtctttggggtgcaaatgtacagcccaggagaaagtggcccagggtcttaggtggcccccagccaagagaaggacgctcctctggtctgtgggaaaaggccccagcaggagatagggggagtgggcagcccactgcttgcaaggcttgaggtctcctgggccagtgtgtcgctcagggggtggcagggggggccctgaagggcaggagctgcagaggcagagggactcctgttgaggaaagctactggaatcactgtgtggttagacctaaggaagaacttcctgcctgctggtcggcggggcagccgaaccctatgattcctccacaatccctcctcttgccggctctccgtggtttagactggttcgtgccaaggtactgactgtggaaggcacagggcttccctcgctggctgaccttccttggctgcctgggagcccccagtccccatgcctgactctgagctgaccctccacacactgaccctggggcctcagcctccaaggggtgtggggaagtgagtagtcccagttcagtatacctgaatggccctgtggggacgggagaaaggcacaccctccctgcagatctgggcaccaccttgatcccagcattgtccttcatttcacagacaacacacctgccccaggaccccctccccactgatgagctgggcccctctgtgacctcagactcttccttctaggcaggaacaggttgggggtcccgtctccaagccctgcctggaccccgcacctccagtcccaggctagctgattcagggctccttgccctgcagcccaagggccctctcaccaccattgcccaccccacctccctgggctcctgggatctcagccttaggtcaaggcccagccctggtgcaccctcccccatgggccaggccctccatgcctttgcccgcgccagtccctccacggggcacgcccttcccgctgtggctactcctcaatcttagaggcccctcccaagcccattctcacagagcttcctaggcctgccctggcctgacacatagtgcaggacagtgtccaggcctgtgtccccaagacccatctggggttcaagccacatcttgggcctatacacagccagctagtgagtgagcgagcgagtgagtgaggccctgcaagatggtcatctgtcttgtcccgcaaaggccaagacaaacgccgtgtcagcggcagcctctccaacccagtctgtgatggccagtggtggtcagtgagggctgggccgcgaggctcacagctcaggccgcacccgccggtttcacagaccggccaggaagctcccagggcgagggcctagtcgtgtcctccccatgggcgagcaaccctaggcaggcaccagagggcgctcgcggtctgcagaaaacgctggctaaggggggagcgcggaaagaggtgggcactgtgggtgcagacagctggggtccgcggagaaacgaaggcctggagcgggggcgctgggttgtccaggctggcggcgagctgcaccgagtgggacgggcaggctgcccctagtgagggcggggagggtgtcgccgcgtggcggctgacagacggggcgggatgagcgtagcccccgcccctgccctggtgcactgacagcctgtcagccgggaagataagggacttcttccgctgggcgtggggtgggggtcaacccaggtgcgctgtccccctcccgctggtgtttgctcggtaaacacttattgggccccgggctgtgcacaccgccgcgggggaggggcgggcgacctgaaggcctggactccatggcctctgccagggatgccgggtccatgggccatcaatgatgcaggaaaagaggctctgtcacctctggccccgcctggagagagttgcctgtggggtccttcgtgggccccctccagcctggggtggccctagcctcagcttcagagctgggctgacccccgactagccgaggcattaatggggccccgtggaggaggtcctgggaaggtctggggagctgaagtcctggccacgtgggggggactgcaccccctgcccagacggagcaacaacattggggtgggtggcggggccctgggggcccatagctcagcgcagcgtctgcgcccaccccctgtgtttccgatggaagacaggctgaaggtgataaatcaccaggtcccacccccacccaccctgccaacgggtggggaaggggggctgcatgtgacagagatggggaccgagacagagatgggagccaggtctagaggagagaccagagacagtggcactgtggtggccccgttgacacgggccaggacccttgcttgggtgtctggcctccccgctctgggcgccccttccacaaagcccatctggaaaccagctgagagccaccgtacccccaccccggctgacccccaacagggaggtagaggagggagggagacctttgcagccataactccgtcccccgcctgcccgcccccaggaggaccataaatcagcaggggctctcaaagcactacctccacaggctgaagggagggcttcagggccactggtcttagggactaggcctgtccttggctgtgtctgtccctctttaaacagccctcaggctgaggcaggcatatcacttgaggccaggagttcaagaccagcctggccatcatggtgaaaccctgcctctactaaaaatacaaaaattagccgggcgtggtggtgttgggcacctgtaatcccagctactctggaggctgcagggggaggatggcttgagcccaggaggcagaggttgcagtgaccccagatcacgccactgcacgccaacctgggtgacagagctaaactctgtctcaaaaaaataaaataaaaataaacagccctgaggggaaccccagtggcccccacacccagcacagtcgaactgactgagcactgtctacactggatgtacacactcacatcctcactttctctctccagacaggaaacgtctgcagggagcaactctgtgtcctcatcaggagaccccctgttgctggcccctcaggaactagggatcagcatgtcctacccagtgaagccctcctgggggtcttctctgcccataggaaatgcctccttctatcctgtcttcctgtcaccaccaccccccagggtactgagggccagctggacaaaaggtggtgagagatgggccaggtggatcccccgcaggtgagcgcaccccacacacatacacacagggcaggtgcagagtcagtacccagtgggagaggcttgagagggcctgggggagtgctccctggagctgtggggtgtgctcagcagcctagttctagccgggccggcctcagcaacccctgtccagggtctagcctacagacattcccagggttcccgtggtgggcataagggcattgtacacaaggaaacacagatgtccaccgtgacatcaccccagcttgtctcaaagagccgtggggttggggatgagggctgcttcttgtctagaaagaccttcagagatgttggaattctgtgcctgagacaggcactgactgtcactgggctggcctgggcctggttacctggactgtcgccttcatcctcagagcaaacccttgagtctagcactagcgatgtctcaggggagggttcagagtgtgcagcagctggaagtgtgctcagctcagcctgtaggagggtctggcttttccagaatgtcccagggagaagagcgcaaggggagtagggtgctggggtgtgcaggggagcccatctcccgtcatccattcacgttcaatcattcataccagtgtgcagacctgtctggagcctgccggctgccagggtcaagggctgggggggtgcagatcccttggccccagacccccacctggcagaggcacttcactcctcttccatccctcctgagagggccagctccctcctccccgcactgggattccccctagtacgaagtcctctggggctcacctaggtgtatttaagcatgtctgacaaattgagggactccaggcctaacagactggaaatgggccgggaaggcgagggctcactcaaccacagggaccagtctgccctgcccttcccaggccgcccaggtgtgactctctccactctctttgtcccagccacgcaggaccttagggccagccctgcaaggtcactgcactcctggtggggtacaggaaccctcaaagatgggaggatctggaagggaagccattgaactttgcctgatggacccatgggatgtgggggcacagaccccagctgggcaccagcaggtccccatttggctggaccatgttgacagaattagggtgcccactcctgggaggaaagcctcagtctatggctggaggtccagtgagccaggggtgagggtcccagggcagcatcagcccacagagcagaccaaggcttctgccaactgcattgcaccatgtggcagctgtacctgccagtcaggggatcccaagctggggtggggcttcaaggaggtgcctacgggcagatccagggccgagctctgcccgggtgtctgcttcaaaatctattttgatgtgctttgtatttggggagttgcttttctctatgctttgtttatttaaagatgctattgaagagttccagccaaactttgtaaatgccgaggaacgggctgctgtctgagcagggctggggagggtaggagcccctgacagccgcctgtcccagcatgcccaccccgtgcccttattgcccactgaaggtgctcgcgcggcaccaactgcactggcttcctccaggagggtagcctgggggctagggccagagaggcaccagtacgcagagcagtacgtgaggccaaggacctggtcactctgagaccaagcaggttccaggcatctatgctgaggggagtgggagaccactgactttctttgtggcaaaagtggggatggacctgtttgtgtgagctcagggcctctcttggcactaaatgcctctcttggccaccctctgccctggggtccttggcatgggactctctggtatgggaatcccaggtctatggaatgttagtctatgagtccctggtctggggttctgagcctgaagagtcctgctctgggtgtctcaggtcagcaggtctctgacaggtgtctgctcagggtccatagtctaggggtcagtgatctggccttttctccccaggggtgccaggtgccgtgtgctgccatggatgtctctgggatatcagtcagccccttctctgttggccaaggagccactgctaacaggagttgtcccagagggtcacactcttgagtctcttgtggcaaggtcaacaggaggaccatctggagcacggagagcatccccagatcataggcagaagggtgtttcctgctaaggccagccagaagactccacagacctcccaagtcctggctagactcaatcctgctgttataagtctccctgggtcctccctgaatcctcccagagccctccctgaatcttcccaaaagctccctgaaccctccccaggttgtctcctggagtcctcccagtctttcctggatcctctccacatcctccctgagtgctcccagaatcttcctgcagtcctccccatgttctctcaggcgtgggctgctgtacctggattggccctagcaggtgactcgggctggagtttggttgacaccagtggagccacaagcctgctgtgcacaggtgtgatggcaggcctgtgagggttcggggctgcatggccttgctccctttgcactggtgtctggatgtgctcagaggccccctgggtccccaggcctctgggacaaggccggttgagtctcaaaaacaggtaggaccccaagcagagccaaggcatcaccagccccagcccttgttcccgtgtgccccatctcccgaagcactcccctgtgtcatgcggtaccagctctgcctctgactccccatgcagtggccctaaggccaccccttgtcagtgtcctcctgggcctcctggggcgggcaagaacctgctcacacaggtacatgcacagcaagcatcggagggtctccttccctgggagacatcaccgccccacagtgggtcaccctcaaggctaaccactcagcttccgggtggcaagcctgcagagtggccccaggcatgccgggccaccttctaagtgtgccagtcccaccctgtgtgtgtgtgtggatgtgccagagatgtgcagtcacacttccatctgtgtcccatgcccccatgagtgtgtcctcacacctcttgccccgcctccctgctgtgtgcccctcgtagcagcttggccctgcccgctgcaccatgtgtacacagaggcttattttctctgcctttcgggccaggggcgtgctcgtaaattgtgcagtcgacgacacatttatcccgcgggcggctggcggtgtgaatttatggctgcacccccttcctggctgaggcaggacaggggccgggatacctctcaggcaggaacctccagtccactccactgggctgttgtggggccatgggggcgggctgggccgggagggcttaggagtgctcccaaggtctggtcttgcacagaaaccctgcaacttcagggtgcttggggcaatgagaggcgaggccactctgcctgggtgagggctgggggcacagtggctgcccacgtgccagaggcatggaggcccagagcccagcctaatgtcccagcctccatgcccccttccagtcggcttctcatcttcccacctaagaaagaggggacaacttggatgccccagggacagcaggtgtgggggtggctcccctcaggtgctgagtcagccacccactgccactaggcccactgggagtactgagatctggggaggactgtcagaaagggtgggggcctcgagggcagctggggctgcacacagggaagaggagcggagatactgtcgaatcagagcagagagcccctcagagctcacctgccctcctctgccttgtaaagatggggaaactgaggcccagggagagcagaggtcccaggtcacatgggtaggataacagagcctcaagatcctggattcctgctccctagtatgcaataaagggggtcctaggcacacccctccccacggagccacctttgtcctgcaaagtctggaggtggggcctccggctgaagcctcaacagggagctgatggagcaaattggcaagctggtcccatcagggccacagctggggcctgggacctggctgcctcccctccgtccgtcggtctgtctgtgtgcagggtcgggtctccaggggaccctctgtcggctctcaagctccctcccatctcggccccagccccccctcaccgcccgctgtcaggatgagcgatggccgtgcccctccccggccctcggccccaggcccggttcccgctcattagccactgacactgtttgctttcccgccatggacgcccaccccgtcacaggccattt[450 bp omitted]cccctcaggcagccccagtacacagcctggggggtgggtcctgaggcagcaggcacccctccctcctgcaccacccccgcccccaatatggccacagctgggcggcatcagggcccgcaggccagtggcagccagtccttcacttaaaaatgtgtttgtgatttcggcagcgaggcagataacggtgacgaatggcccgcctgccccccagggccctcagcccatctggtttgactttggcctgtcggcagtgcccttgggcctcactcctgccctctggcagtgccctccgagtgaggcacccctcaacctttgcacactctggttcctttgctggaaatgcccctcctctccacccatctgtccccccatcatgggctcccctggctatgcccataggagccacccatgcaacactcggggtggcaggtcctgggcagtgctggggtttgcagggtgggggagggcacaggcccagcagggagggggcatgccttgcctgggccctgcatcccctctgtctaggagggaatagtgagtgcccacctaaggccagaggggccgaggctaaggtgacggagtgggccaggaccgagagaggtggcccggcggccagggcagggcctagccctgtgagacagcccatgtggtcattgtcaggaggaatttctgacagggctcgggaccctcctgaccatcgattatccaagcaggaggagtggcttccgggtccggctgtgggctcagctgggaggtcactgaggtcaagcccgagtgcccctcctcctccagtctccccttctactcccttggggctccccagttgggcagaggtgcctggaaggttgctcctgcccagtttgaatcctggccagctaccacagggagtggtcaggggtccactagggactggagctcatgcattccttagcacaacttcccaatcaacccctgcgtgcccaggtcacagacggagtcagacctggccctcagagaggagataaggagaggtggaggtgcttagagctcccctggcccatctcaggggttggggaggggcttgtgtagagggagggcattcgggcaggatagaggaggcagccctccctgggggtctggggtcgcctccaggagaggcactgctccattccccactgcaccctccaggcccactccctgccctgtggcgaggacagctgtagggggaggggaggggcagcgccgtgtcaggacccccaccccctcctccaaagcaggaaaatccctctccgttagtatcacattgttgagaattaactttgttgaaataaaaattggtcgtggtattaactcggcctcaaggattttctctgggatcctggaggccgcagaggggtcagacgcccattcccagggccagccgctggctcgggtttcggggactccagcgacctcagatccttgggacacggtgcctggttcctccgggttgagggagccaccccagtcctgccttctacagccccggacacgaaggaggacggcccagacagtgtgggtcttaggcatccatctgtgcccctcccccatgtctccgtgtcacttgcagccatggctgttgagccacaagatgcccctcccgctcctcaggggtcagccacggccttagtttccccacatgtaaaatgggagcttcaccccagcacagggtgtggggggccctgggcacagacaggcagccggatgctcagacaccccagaaacctggggcgggcacgggtagggacagacccacccaggtctctccagagggcaccaggtggccacacaggcactcctggcctcagcacagcctcgctggccacagaaagaagttggcacccccgactgtctgccagcagggcgtgggcacttgctcccaaggaagcaagcagagagcccacgcgtgctgccaagaagggacggcagccctcaaacgacacgattccacacagacagatccgcgcaaaactgctctgagaattgctggggtcccgcccccccgccatggtccctgctggacagggggcgtgagcactgccgagttcccacgcccccactctggagtgtgtattcctacagagggagtgcccacggacagaagcacaagggatggaggtggggcctcctcagggcctgcgggtggctggtcctgcgtcccggtagccaggggacaggcgagacctcccagccggtggtcccctggaagcctcctctgctcacatcccaggcagtgtgttttcgggggtggggtgcagcctgggaacgggctggttcgggggcctgggaacgaaggcaggggcccctggcgggggatgcaccagtgggcccagctgttgctgcctggctccaattcccactctgcaccaaggcctgtccctggggccaaggctggtggtctgcctgggagggagtgagggggtgtgggggccatatcttcctccagtcagtggtccctgggcagtagaggtaggagagaaccgccttcgagctgagtggcagagcccacaagcagggggtgctctcctgtctccccaagcccaactgcagcaggtcccaaagcctgctccgagcatggaatcaccctgaggccccatcccctcacccagcacccaagcccacctcctccctgggcctgtgttggcggaccagggcctccattatacaccatgagcctggcgccagcccaagccctccaggcctctgctgtggctgctcctcctgtcgagggagcctttgcaccagggccatcctaaaactcctacttaaccttcaagaccccatgcaagtgttcctgccccaggaccccaccccgaatactgggccctgcacccagctggtgtcattctctttacaagactcctgatgcccctcatctggcacaaggctggacaccagagtggggggtgcacatttccacctccaggagcaaaaaaggctgactcctcaaggaggcctccttcccaatgcctcagtttccccatctgaactgtccttggctgacagtatccatggtcctatgggagcaagtgtgaactctgggcaggaaccaaggccagtgttctaagcagggtggagggaccctgaagaggacaggccaactgggggctcctccaaagcaggagagtgggtgcccagccagccaccccacaaacatttggctggcttcagctgaggccaagggaaggcagagctgctggcagggtgggggccagagcgggattcttcttactcctaaaatccctcccgcctgcccagcgggccccgagggaagccccatgatgcgggaacctgatattttaagacttaaagcaaatgtttctggagcccgagctgggcctcggcgcccgcccgggccttgtgggggcagggccagcgaggaggagaggacccctcccctgaaccaatcctgcccctccctggactgcagtttctggtgacaggcaggggcaaggctggaaccccttgggcaccttaaggttccccgaaacctgagggtgggggccccgttgtcggctctccgctctgctggtccctctctcggctgccagcatcagatgaggctcactgagagccctgaacccctctagggctggctttgcctgacccagagcccagggatactccctttcttaccactagcagggtgggcgtgtacaggtgctgcttttgagccactggcaggagccacttggagctcagagctgacacctgaagcttcctatctgagaggacaggagatctgggactgactggcgatgtctgcctggggtgttgcaggattcctgcgcttggaaccgcagcagatgggatcttgctctgtcgcccaggctggagagcagtggcacaatcacagctcactgcagtcttgaaccactgggctcaatggatcctcccacctcagcctcctgagtaactgggaccacagacacacaccaccgtgcctggctaatttatttttttatattttgtaggtgggatcttgcgatgttacccaggttggtctcgaactcctgacctcaggtgatcctccctcctcagcctcccaaagtgctgggattataggcgtgagccatggcacctggccatgatagggtttttttctctatatatagaagggactccccatcgcttggaccatagggcagtctgacactcggctgaggctgagtgaagctggcctgggctcaggggcatgagttccaggctccaggccccacactggtgccacctccttctgggagcctccttgggggcctttgagagcaggagcatcacaagtggaggggtgactgggtcagggacagcagagcagggaggcaggggccgtgttgggcagtgaggaattaaggcctaataatgaaggctgtatctccaaaaaatgtttcggaggcagggccatccgggcccagctgggaatgtgggggtgtaggggagagacgttctccaggttctcccagaacaggccatcctaaggacccagccagcccagtatccagcccagccctccaagcacttggcaccaaggcccttccttgtctgctctcagctggtggggctgggccaagctcctacccactagctgacaagcctcctctggaccatgtccacattttacagatggggaaaccaagggccagggtgggaacagtgcttccagagagcctacagctggcctggctgtgtggacccttcctcaccacccctgaggtcctcctgcctcagtctggaggagggacggagctctggccagctgtttgggttcgtgcagacctgagcgtgagtccacctcggccatgtcccgcctccaggcactgtctgctcacctgaagctctggctgtctcatggggccttggagggtgtcaccacctgactttggtctgctcctcgctggtcctactgccctggtggactcctgtgcacccttgaaacccactggaatcctgcctaaatcgtgagcccaggaatgccccccacttcctagctccagcgcaagcactcagcaaccctcccctgacggggaattccttgtccattgcccccaggaaacccaccagcccccgcctcgggcagtcccaggcttggccccgccacttacctcactggacagtcttggactcacgctgtgaggacagacacatgacgtcacgccgccttagtttccccagctctgaaatggagatggtaaatgttgggtgggtgttaaggccgggtgtcctgagctgcccagaggaagggcagctggcaggagagctaggggtggtgcccaccctgggcctctgcagcaccacttcccactttaggggcccagatgccatccgcagatccttggtccagcctctcactaggcctggaagccaggctgccgctgtgggtagactcctgccaggctgtgggggctggggaaatgtgcccagcggtggctgaagccaggttgcctggggaaccagtgctccccagggggcctactgctgcctccaaggccccataacacccctgtccacagctccacccaagctcccattgctttccctcagcattttctttcatcctttgggcctcagtttccccacatgtgtctcgggaaatgacagatggcagatttgggggcgaggagaggagagggtatccaggcactttgttaggattgaggtggaaagaagaggtggtcagtggaacatggggcgccagggtggggaggaaggccgcaagatccccatctgtcccctccagaggcagagtgaggttagggcctcaccagaccaagtggaggagccaggatttgaatggggggcaggatgccgccatgtgggtggaggctccctgtgcctggggcctgagtgctggccaccacctgctgtctggcgtcctctccaatccacactggccctcaacccctgtcccaggctctggttccccacctgtcaggtgaggtccttttgagcccacggcactggggcggtctgggtggagtccctgccccctcccagcctcaggcagcatcccaggcacacacagcttgcttcccaggcctctttgaggaaggtcaacggccgagaactaaggctagggatcaccggaaacctgtcccatcctcgcccccagaccctctgaccgcagaatctcctgtggggctgtaccctgggtcccctcccaggcctgtgacccggccagaggctggaggcagacaggctcaaaaccaggccccctcctcaaagcctgtggaagcccatgagatgtcccccagcaccccagggtggagctcacccacctgtccacaagcaaaggcaggcgagggcaggaggtggcagtgaggccaggcccagggatgacctggcactaggcccagcccctacccacagcccccctctgcccatccccagccccctggcccagcttgggcacccaggctccaaaccagaaaaactagacggagagcaaacaagcccacggtgcagactcccatgtctagtggaccagtgtgggcagggccttggagctggggttctgccccggcagagccctgagagccagggcaggagtgataggcccatccaaccctgagttcaaggcctgtcctaccaggcaccccacgttggccctgtgcatccctcagtggagggggatttccacccaccagcctgcaaagtgagcactgccatgccagctgccccagatgccacaggctgcttctggggagtgggcttctcatcactaggggtgtgcaaatggtgccagcagccacggcaggctggccgggtaggactgattccccaaggttctgttcagagtccctggacccaagactccagagcctaaggctctggaattctgtcccctgagatggtgacatgtttcacagtgggcacagtggtgcgcacgtcataggggccggacaaacacctgcttattcaatcagcacacacctcagtggggtccaggggtggctgggtgcctcaggctcattgcccttcaccttcccctccaccagccctccccattccctctctaagggtcaggccgaccactgcagcctgcagtgcctcacacaggtctctcctccccaggagtcgctgttcttgccccaggacccttgcacagggtcaccactggaaaccggggagggtccatctctcccgggtctgcttggtattttccagtgtattcgcagattcttagcatgacacttccactcggcagaaaggacagggagagaaggctgtgctttagggcgacggcagcagggccagctggtgagaaccatgcacaagggtggctggcagagggatgtgacatgggctcccaaacaggccaggggacctgaggcccaggatgccacctgagaggctggggagggcagctgaaggagggagggggcagggactccccccggggccagcccacctgctgttctcgcagccctgggcccagtgatgtggggctcaagggggcctcacctggaggtcagttggggagctagaggccgggacaggagctgagggccagaggggactccggagaacactggatcaagtgccatcagctgggctagttgaagagttttgtgagggtttttgtttgtttgtttgtttgtttgtttttgcgggaggggtggaacaaggaccagcatgcagggcaagatgaggcctgagggtggaggggacagaagagccctgccgggacaagggacacagggacatcggttaggtttggacccatgcacaagggctcagccacgctgccagtgccagactggccccccttcctggggcgtggcagcacattcagttatgggcacaggcaacggcaggggccagggctgcctcgagcaggggaggctgggcacccagctgtcctgtgaggacacaccaccccaccctcagaccgtgccactggacactcacatgacccaagtctggccgcttgctcactggcacccctgccaatcatgctgaccttcttcccactagcacctgctgggagctgacagaggtctctattcccagccaggcgcctgctcaggttatatttaggccacaggggtgggagctgggcctctgacccccaccatgcccaagcaggggcagctgggctgacgccgtgggttgctcactgcctgcagggcccctccctccaggccttgtcctctcatccatcggccatgtgcaggctgggaggcgcgggccggccatgcttcatatgggaaacaagctagtctggctttgagctcctggcctcgggacgatgggggctgatggcaccagaaactctagggaggccagcacaaggggacaggcccgggagctcaggttgggtggggggctggcgggaggcccagcccagcctttcagctccggaggctcagacgtgccatgaggtcattccctcctgggagctcccagagccctgcccgaggggatgctgagccccaggcccttcctgcccagccggggctggatccctcttttccctcctgctgcccaggcaggatgtttccagggaggaaatggctcctgggaggccaccccacccccgctggagtctagggccacttcctgccccgcatgggccttggttctgcccccagtctgccagcctgggccagatcccagatttcctgtccctacagcatggagaggcagaggtgtctcggcctcaaccagcctgggaggcacagtcgcaacctcctggaccccaggacctgagaacctccccctggagccccacttcccttgccccacaaccctggtcagagggaggcacgacctgccctgcccccatgcccagccttccccagcgccacagagcctccttcatataggttccgcttgggtaccagctgctgctccaccgcccatctccatggggcccgcgggcctgggccatccccagcccaccccaggaagctgaatggctgcatcgaagctcccttttggctacaatcctgcagggctggccttggaccagcgggttagcctggatctgatgggccctcctagcagaggtcatcacccggctccgtgggcagccccatccccaggggaggtcaatcagctcagtcctcacccaccctattcaatggggcttcctgccgaccccagatctgggtgagtgtcctggtcaccgccccctcgaccaccaccccatgcagcaggaaacacgtagctggggggttgtggggcttcaggactgggattggagaggctgacagcagggctcagggctctcggcggaagtggggcctcagcccactcagaggtccaggaagtgggggtctcggaagcttcctctcggccagacgagccggagggtcagaggcctggccgcagctgccccttcctcttcggccagccagctgctgggtggcccgtgctgcagcaggcctcaggttggggagctggttgtccttcagcccccgcaggtggccagcatcaggaccggaaggctctgaatcagcctggtctggaggtatgggcagctgtgggggccggtggacaggtgtagcagagctcagggcgcacagcaggggccatctcagcctgggcctgtgttcccttcagtcagacctctctccagcctcggcttgcccatctctccagtgaggtgacaatcccgggcctgaccagacaggctgaccaggacagagaaccctggggccttctaaggccactgccatgtgggccgggtcctgtcagacacccccagccctcagcccctgacccatttctgttcatgccctggccctcctgcatgcccacccaaccccactggagctcagagaccctgcccctccaaggccttttctccacagccaggaccaggcccccagatctggtgccccatcagtcctgccggtacacctctccacagaagaagcccagacccaacccagcctgcgtgagccctgctggggggcctgggccatggaggtccccagccccatgcttcaggggaccgcagcccagtcaacccaggctgcagaggtgtgaggagggggctcttgcccttggcaactggcaggagctgaggaggtgcccgggagaccccatcctcacagatgctgtcatcctggcacatccctacctgcagtggggacctggacaactcatggaaccagtgggagctggaggctccaggcattgatgtgctgggcctcagtccctatgggtccccactgtgggagtgtctcagagtgggatgaggagtctgtgtccgtgcctgggccgaggcctggacaggccccacccccggcccacacatgatgggcggtcgtccatcagcacagccagcccctctggccatccatcaccagccagcggccacaggaggaatggcctgtttgttttgccagctccgtgtcactccctggggcgggggctggaggaaatggccattttctgcctgggcgggcgggtggacagcaggggtgggcagggcaccggggacagggatgtggcaggaccctggctcatcccggccctgcatagatgcccacagccttgccctgttctgtgcctcagtctcccctctggcatcagggtgagtgacactgggattttctgactgttcccatggcagctctctccagctgggtcactcacccctgccccttgccactgggtagggtgggctcaggtgtcagctgccaccaggtggggggtccccctatctgaaatccaagatgcttgatgctggctgttcttataaaccatggggggaggctctggagctaggtccaggccataggccaactgttgattggggttggggtgggggctgtcaggaggtctgaaagggcctgggcaccgatttggagacttccagccttaagatcagagcaggggacagttggggccacattaaaaaaggtagcacgtgtagaatgaagggggagacatcctgtaccaagaggctggtgtccagaccccgggactgtgtcctcagcacctgcacaatgaccctcactgcatcctcatggtagaatttgcagatatgatgtagaggtgtgcgtatatgtgtgtaaagggatacatggcaggtataatttgctgacaccatgctagggactctacaatcattttatcacttctcacaacacctacaaggctccggggagtcaaactgggatatttcttttaccactgcagcctcagacctctgccctggtccctgatccagaacacagtcaccccacactcccctggtcctgggctagcaaggagggctgtggaggaggcaagcaagctccaaagtgcagcactgaggctggggcggagacactgagagtccgaaggcacctccatccctaggaagcaaagccagacacccaattctggagtcagaaaaaagcccttcaatttccatccctgcagcccagtgtcccaccaccctcaggggagaagggtcgctttgctctccctggggcactgtgtttgcttacctcccaggcagctctgatgttgcatagctctttttcatttaggagcagtgacttccttcccgaaatttcttcccttagacctgggctgcttcctctgaccctgcacagccctgcagatgtttgcagggtatcgccctattttatctccctagactgaaacatactctgtcctgagttaagactctggctggttgtagcagactttaaggaaagaacttaattgcaaaaattcactctaagtgtgggcgtgactaagactcattgtgtcttgaatgtgcagagatggataggaggagctcgggggttagtgacattgaggccacatgagggaactctcgtgaacactcagttgaagggttctggagttgggaggctagtgaaccagtcccaccagtgcagggctgacggccctgtgtccagagacccccaagcccagcctgttccttgagccagggctgccgtgcctctgcccagcctccagctcacgagggctggcttagcgggattcatgtgccaccccctcggtgacatctgagaccatgcacgtcttggttgtgccttgttgctctctgctgctctacacagggagacaggccggctggtcgcctcgggggttatcttccctggcccccgaagccctggtgaccctgagcctgacccagggggaacaatgacacaacagcaaatgccctggggcgagtgccaccctgacagccccaaggaacagagagaatcagcagggtgcagggctcagcaggtgcaaggggagaaggctggcttatgtggtggtggggacagggcacagggccgggagggaggggacaggtggccaggggctctgtctacatgggagccacatgggggtgtgggtgggcactgcagagaggggccctggtcatggggtccacaggagagccaagccagcctagaggatccagggatggcccaggtgctcctgccccacctgttccaggccagctgtgtcaggggtactgcctccgtttctccaggctgggacctccactgcagtgggtacattggacactcagaccagccccagggcctggcagttcctggtgaagactgagacagcccgacacccgtccacacccccgcccaggatggggtggctgctgggtcactcggtcctggcaaacacgctggagggaggggctggattgactttagggcactggtaaaagctcacatccatctgtccacccagaacagctggtgccaagcacccacttagcaggacagggcagcccgcgcctccacactgcccatgccccctcccgtctcccaggacgtccacacaggagccacatgtgtcctggacccacgccaccccccgctctgtccctctgttccctgagctgggctggcaggggaagctgaggtgtacagggatggccaaggcctcctccctcccccctgcaccccctagccccattggcattacctcagagcagacaacagcttagtggggacccaagtgagggggtgtcagtggcccaggccctgccctgcccagtcactcaggcagctaagagagcaggaagggcccagacgacacccccacagacatatgccagcccctccgggtgaccaaaatcatctcagtaaaggcagatgaggccaagcgaaaaggggtgggtggaagaaccggctctgagtctcagcccacagacactcggacactcgtcggcccggtaggcaggggttcctggtggcctcaggctgtcaggcccggccccctcccgcagctgtctccagctcccacctcccccgcccaccccccaggactcctatttcactgaggagattaagaccacctggcgagaacccctcccacccctcccctctccccagccctccctcctaaccctgtcggccccttgaggtgccctcccggccccggccctcctctcccatccccacgttcctccacggcagcctccacgccctgccctgccctgccctgccatgggcctgaggatgtccccacccgctctgatggccacctcgggtcacttctcctcagcccataccctggcctaacccccaccctgagcctccagtccctccaatcctcaccctttatgtcccccagccctgcatagatacaggcatcgtcaccagccacggcaatggatcccgtccacctcccacccggccactccagacccaaattcagcactggcttcagcctcctgccattcttgctgggtctcaggagggaaccgggccagccaggtgctgtctgggactgtaggctctgagcctggtccctgctcagttccagcagccagtgggccaggggtgctcagctgaggacccccactccatccagcctgccgtggggcagccggcctggcctgatgctggctcagacagactcatgaggaatctgagctctgaaaaccgcagctccgagcttgcctgtttgtttgcttttgagaaattccaacctggttcagcagagccttggaggagggaagggatttgtcaggtctggggtggggctggggcaggcttgtggatgtggggaaaccaaggctgaatctgggcacagggacccagtggggaagccgggagagggtgcctaactgggcctcctggggggtccagctgtgattccccctccccaaacctcacgccaggcctggaggctccacaggggctatggaggcaacagccaccctactcacagtgctgggaggacctgcggggctgggaggggcccaaggaggccctgcagcaacaatagtgacatcagctggggagctgcaattgagggcccacatgtgctggctccatccacccatggggcctgcagcattctccccacttctcagatagcatcactgaggcttgcagaggccagggcgtgttcccagacacagagccctgaagggtgaagctcgctcctggacccagctcctgagactgggcgacatcaccacgctggttcctccctgtgcagaagggcccagagtacaggggtcctgccgaagcagtcctgttctcctttgaaatgaaatattgccagccttctcaccagctccttcccctgggaaggcgggagaccagacagagttggcagcccccagccctgcatcgccaccccgaccagggaaagctgcctgtgcaactaatctctccaggccccggtccccctctgcccacgggcttggggatcctccacaggtctcagcaaaggggttcccgtgctagagccttgcccatcagggacactccccaaaacctgccccagcctgggcagcccacctgcctttggccccaggtcagtgagggcgcctcaggtcagcccccacaagcacagggggagatatgagcagggtctgcccagagcagtgggcagggaggctcaaatgccagcctgggcacctgggcacagtcctggcctaggagggacaatccagcagccttgggggcttggccagggagcagagtggaccgagaggcacagggtgtggggccagtcctcccctccactgagacaggatttccacacagtctctcccagcagtcacactgggctgtcacagtgacagtatggactacttgaatcaattgagcatttaatgaaaactgcaagtgtgatatatttgactactttaaatgctttaagcatctttaaagagagatacaacatatccaatgtttacgggggcatggcctcgttaggacccattaacaaaggtgctgaggtcactggcttagttgtcattcctcattgcctctggccctgtccccagagccttccttctcagagcttcccagggctcattcgccaccaagcaagattcagggttggggtctgagcatggaaagtggcctcccaaggagttccacccagaaggttctctgtagaccgatcttgtcttgagagtctcttccagtaccaatgtccaaggaagcaggctggccagtcggatgccatcatccgagtgcatccccttcagaaatgacccagcaggagaggactgaaatattgcattcttccttcctcacacagcagcaagcttccacagtgcttcgcccaagtcaagtcaatccaaggcacatgtgagcatcgtcattattgtagaagggttacagtggccactgtgagtgataagcctgcacatgtgtgcgcctgtatgtatatctgctacatgtgctgtgtgtgcacactctctcacactggtgtctgtgttggtgtctgctatgtgcatgtgtgtgcccatgctcacgtgtgtctatgtacagaggtgcatgcatgcccgtgctcacgtctgtgtacatgtagagtgcccatgcttgcgtgtctgcaggcatacagtgtgcatgtgtgcgtctgggcccagtccgtgtgtctgcatgcagtgtgcctgtgtgtgcccatgctcacgtctgtgtgtctgatatgtgcatgtggacacatgtgcccatggtcacaatattggtatgctcacatgtgtaggcatatgtgcccacactcccatgtatgtgtgcctgagtatgaacatggtgtgaacacacacatacactcatgctcatgctcatgagtatgtgtgcacgtggtggtgtgggtgcttgaacatgggcaaatgggagctactgtccagtcagggttccctgctgcccagaggaactggaggggcctgtctgcacgtgtccatcttctggccactcaccctcagccaacactcctccagggtcttttgggacaagtcccttcccctggcaagtgtggctccccctgctggggccacagaagggaagggggctagcagggactggttcctcagctggcccgccaggctgagatccagccacctcaccagcctgcacataggtcttccagggtctcagagcctcacctctgcctggctgcacctggggtggaggggctagtgtggccaggagatggacagacagatggacagccagctccccatgtggctgggtcctcccaccaagtgggcagctaaatcaacagcctcagaaattggagaggggtccagggctgggctgtccatcagtctgtctgtttgtttgtttgttctggagttgtgggaacttccagtctgcagggagtcctggtgcctggcgaggtcggggggcagagggtgccattacccatccggccagccatccctctcatcatctccccacatctgtcctcctgggaacttggcccagaacatcgcacccatagttgcgggggacagctaggccgggtgacaggaggttggggaccagctgtatgcggctggctgtgcagaccctggccggccccctcccggctgggaggaggctggtgtcacacggctgtgtgcttccctgtccagtcttctctccacccattaccccatcccatgtctgcctctctcagggtctcgctgttctctttgtcaatcctgcagtcttttgtcccccagggtccaggcactaggactctcaggcgggtcagaccctgccctgggaccagggagcagatggtgctggggcctaggaagagtcccaggggatgctctgggccgggtgagggggccacacctcctgtcatcctgtccagtgtcctcccagccacaaggtgtgcacaccaggctgtgtctaactcccaggcctttgccagctatgtggtcagcctggtcctgaccagactcacagggacacctcctccaagccctgggccccttcctgggaacgtggctgtgggcctggagctcctgggcagggttcctgcctgctgtctgacacaccccccagagcttggaaccagccagagtacccacgaccccagcagtttgagtaaaggcccaacaccaaggagaacacgtgggggtgggcttggtgaggacttccgtgtcaggaggcgggcgccagggaggagagaggtccagggagggcaaggtcaaggagcagtgggaccacctgagccacaggttggggaggactcccattgagaccccaggctgggtaacaggaacggcctccttcttcatcgcaggcagtgtttgcggtggcacaggagatccggcggtggacccaaatgcgccctgccctggcaggcagggaagtagaccgcttctgtctccagccctccctggaggcggacctggcccctgttctggctctggcttgggtccctccactccaggagtccccagcccccagttctaactcagcacccgccccagaggctgcaaacccactgcctatgcacagagggagacagcactcccgtcaacgcctccgcatgcaggacctaatgtccgacccggctttgatgcagatcccagctcgctcccgtgccggctcccgctcccgctcctcccccgccacccccgcccgcggttcttctctcggcttggcggctggggtccgacgaaggggcagaggccacaactcagcggccccgcgggcagccccggcacgcggccccacccgcccgcctcccaggctcggggtctcggctcgtccacggccacgagggtcgcccggaatgtcgcgttcgccggtgctgtgggccaagcactttcgtgggatggagggacgattggggagcgcccgaggctgctgtgttggcgcccgcccccgagggctgggagtcaagaggtgggagtggagaggggaggagagggcagagctcctgggcgcgcggtcctgtccgggttcaggcgaggtttgggcccccagccgcccgcccttctctggggcccggggctgagctgctgatggcgggagggaggacggtgagggcagctcctggcggcgggccttccccgagaccccgaggccgcgtccaaatagggcgctgtaagcaactccaggcggtccatcctaaaacgaattagcagggtcaagtaaagcccggctcctcagtgcttccctttgcacggtgcgcggcggagcccgattctgctctctccatactctgaggcctagaggaggagtcccccgtgcacctcgaacctccggccggtcccttctgtgtgtatatttgccccaagtagcctgggaccaatgctgggggcgcaacttgcctgggaaacacagcccagcccaaagatcctggtatactgtctgcccaccagggacgcacgggaggtaaaggagggtgcgcggcaacccagcggtgctcagaattctgagcagtggggaggtgctgtgcctttatggataggaggggaagggggtcctgctgggtgggcgtgagggtgcctgtctgaaggctcccctgagggagccacgtgtgtgcaggggaggcggaactgggcagacagatgggcggccacaattctccagcggcagcctacctgcgctagggaaaaaaacttctggaattagggtttgcttcacccacaactacgaagactggggtggggggcgagtctcagcacactggactcccttggggcagggctgaggtgcagcccagacagcaaaggccgccgcgggtcctcggtcgcatccctcccttcagcctcctgcactcagccaagcctctgctccccaccccttacctacccgagtggaagccaagcttcggttttccggcctgtaaaatggtatcatagctcccatctcgccccctgcgctgggagaaatgggcgtcttgtcttcgctgcgcattgcatgcggaggagcagatgtctcagcccaggccctagccttgcatcgagccctgaggaatcagaccctgcgacccctagccgcgcctcaccttcctgatccacgcaagggagctcccagtcaggcctcctatcgcgcgggtgtggaggtgcggccggcagggggagcgaggaggaagggaaccgcggccgggccaggtgagggagggaggaacacttgccgcgggccgtgctgaggcgctgcgttcgcgtgcggaacccgcgtgtgccgggctagggccatccgacgggcgcgctccctccgggctgcgggagggcacgacgggtggggtggcggcaggtgaagaggagtgtgggcgggtggcggggtggcggggcggcggagcgcggcggggcggtgccctaggcgggagggagggtcggaggagccctatcctgctgcgcgatggaggcggtggaggcggcggctccggctggaggctgggacggcctcgcgcttcgagggcttccgggcccctttagccgagggctcctggagggtcccagcgttgagcaacggggtccgggggtccgaaatcaagcgagtgagtataggcagccggtggggtagggtcggccaacagagccggctgggtggggcccctcacctcttcccgtcgcccttctggttgaccagggtttcctccaccctgacggcctcttctctgctgtggcaagctggccgcccctgcctgcctgcaggtcctgctcaggcacgaaggggttaatgggggctggaagggctctgctcctccctacaaacctcaggcacagaggtctggggacctctggaccgatccttgagcggctgacccagagtctccaggaggccccagggtttttcactttcacttctccctcctcaatgttggcctcacccacaggccccacatctggccagtgccctgaggtgtgtgcagatgtacacaggacacaagcttgggcataccctcaggctggggcacatgcaggagccccacccccatgcccccaccgactggcccaggcctctctgggtgcagactgccaacacaggcacgtctcctgcaacactaccaaatctgcggccaccagcatccctaccacccgcctccacgggactgtccttcctgcaggagcagctcctggggacaatggctggtcctgctcagagaggaaggaaaggggcctggaaccagctggtccatccccacacagcactcctcactggacttgtccctgggtcccctcagtgacactgagagacataagtcattgtcactgtcatggcccagaatgactactcagggcaagaaaaatgcactaaggacagcttcccttttctgacatggcccacaaagctccagctgcaggcggcaggggttgtggggggcaggacatgaggcaccccatacaggcagcaacacacaccacatcccagacaggcagcactattcgtatactcacccactgcggccctggactcacatgcgttcctgaacctcaggcccagggccagcctccccactggcgcccagccccccagcccgttactgggccttcccagttcccagccagcatcctctccagcccagggtctgaggtcctgagatcctaaaaaccctgggagaggttgcctgcctcccactcccatcctgagcatgcacaagcgaaggctgcaatgaggttgtatacagagaggccttgcaaacagtggccctgaccaccagcaccagggaggctccagcaaggcacagaggctccagcaaggcacagaggcacagagctgaggttgacacccagctggagaggccctgtacaggaaagccatgggtgcgctgaactggttagaggagaccctggagacagtaggtggggaaacgcacaggccaagtcaggccttggcgtctgggatgcctgggcctagaaaccaggcagagcggcgggcctcggcctcactctgcccagcctggtcgggccatagagcttctcccggcaggcaggctggctgctgggtgccggggggcagcatacgacccagtggcctgaagttctccaacatgtcctcgtgtcctcggctccctcggctggccaggctccgcccccggccctccctgcgcccggccggtgcgcagggaggtcggaggagcgggcactgcccaccctccggatgtataagcgtcctggccagaggcgggcggtgcgcgcaagtgcgcgtgacgctcgggctcgcgggctgcgcagcctgggcagcgtccctctgctggggtctccagcgacgatagtgagccaacttcagggggctgttgggcatttactgggctgggtcctgtcctgctgcgccaaggaacagaggacgctgcggccctggggctcctgtcagtggccggtgcgagagcccaagctgccctctcctcacccaggtgcaggggcagccagggaggaggtggaggcgggaggggccaagggcaggggcagggctgggctccggcagccactcgctgcttcatgggtgccctgccacctcgggctagggctgggtgctgctggcatagacacctctcctcggggggctgtagaagctgacggtggcttcgctgcacagagaaaggccgtgccttggcaggagcaacgggatgttcaaggggcgttggtcatggaggtccctgggaatggaggaagggggcagggagcttggaaagcaagagggccctgcacttccagggtgctccacccgtctgggcccctcggctgctaccagccccaagtggggggcccatgacgccataatcctctgggccaggggcccctggcagtgagtggcaccacaggcccccgcccccggactccgtgggctgggctgggctgggcgcggtgcggctgggcacacgcagtcggaggcggcgccggccaggccgccgggcgcctatggacgcgcggagcccgctgtctccccgagccagtgcgttcagcatcgcctctctggttgcagcggaggcggcggagcgcaccgcccaccagggctcagggtcctccgaccgggtgaagcttcgctggctgccaggatccccggcagggatgcacttcagcaccgtcaccagggacatggaaggtgagcctccaggccgtgtctacactggcccgcccgccagaccccctgcctcagctgctgtggggcccgggtgcaaagtaggtggaggcagctcttggtagcgtgggctccaggcttctggctgcgattctggggcagagaggaagagccggcatcccgcccacagcctgtcccctcaccagcctgggggcccagcttggagatgggcactcaggtatacacaggcccggaagagggcgagtgaggctgggaaggagagcagaggtggccgtgagcctggagaggggggaggaaagttaataagagaggagagagcgggagagtttcacagaaggagagaaagcctcgaggaagccgtggagacgaaattgagcaaaggggagaaaacacaaaaaacccaaagaagaaggtaggggagaaacagaaggacacgaaaaggcaataaaaagcaagagcgaaagagaagagagaaaacgaagggaaaatttaagacagaaagcgaagtcataaaaaagaaaaaaaggaaagactttagtttttttttttttaaaaagaaaaacataaaaaacaaaggacatacaaaaataagaggaaaggcaccgactaaaagaaagacaaagaatgattaaaaataaagtgaaaaggaaggcgaggatggaggaaaaggggaagaggcggaaagtaaaacagaaataaagagaaactacagagataggggaagaaaaaagatgatcgggagggaaaatttaaatgaggacgacaaaggtaaaataacaaattaggaaaagaacgtctgggagagagagaggagaaacgcacgcgggcgggcggcagagcgagggccggccgacgggcccggcgcaccggtgagccggtccgggcggtcggggggccccgggccgagcgagccgcggcgggcgggctgggggccggggagggggaaggggcgggggaggggcgagggccgggggagggatctagtccattgtctccgcgcgggggtgggggggccccgggcggggcggggcggggcgcctcctcggggccggcctgcggtgtggggctgcacggcccggggcgcacgcagcgcggcgcccgccactcggcccgcggcgcggggcagcgctcagcttggtggcgggggcggcggcggcggcccgcgggtcatgatctccgccgtgtccagcccgtggctcacgcagctctcgcatttctgcgacgttgcagccttcacggccagcagcctgagcagcctgggggccgcggggggcttcccgggcgccgcgtcgcccggcgccgacccgtacggcccgcgcgagcccccgccgccgccgccgcgctacgacccgtgcgccgccgccgcccccggcgccccgggcccgccgccgccgccgcacgcctacccgtttgcgccggccgccggggccgccaccagcgccgccgccgagcccgagggccccggggccagctgcgcggccgcagccaaggcgccggtgaagaagaacgcgaaggtggccggtgtgagcgtgcagctagagatgaaggcgctgtgggacgagttcaaccagctgggcaccgagatgatcgtcaccaaggccggcaggtcagggcgcccctccccacgccgcgaccctccccacgtgctgccgccagggctgcgggcctccgcctgatccgcgcgagcggggccgaaagccgggtcgggggcgcggcctggccacctgcgggcccctctgggccccgctgcctccttcgctgttcgccgtcccggctccggcgacagccgcccggcgctcccctcctaacacctatcctccgccggggcgggaggagacggcgcgggccgcacgggaacggcgaggagccccgcgggactcgcccgcccgccccgcagccccaggacgccgcgcggcccagaaaccggcccggcttggggcgcacccggctgggggcaggcagcggcgtccagggggcctcaccgcccggccgactcctagtaaatcccacctcaagaaaactctggttcagttctggagttcagtctatgcgggcaagataaagagcggcagccgggcaactctctggacactttcaggagaggattacccttaaaaacagcgtgcactgttgcgtggaagttgctacccagtttccttcaacctagatccctatagttgtggggcctggctctgtatccagcggcccgtcacctcccaaccggcctgtatttgttttaaagaccaagagacaaggggaacaagttttgcagatgcacccgatttgaccggtagacaaaggcgggtgccgcgctgtgtctaatgtacacaccagctcggagtccgaacagccaaggggagctcagggcctgtttgcaaagccttctcgtggtttctgtttccctgctgccggcgtcctttctgaggaacctgggcctgtgctctgctccagctctgtggtttttttccaggccctccttgctgtccccaggcacacaggccctcctgaggacagcggcagcccagccgctggctcaggccagcccggcaagggccttgtcggcgctgggcttcacccgggagcccacgtcccgcagcaccctccagcctgcagaggcttcgggtgggggagggagcgggcctgtcctagaggctggctcctggcatctgtcttctgcccaccgcctgcagggagttgcttgtgaggggaggcagaggggacggcaagtgagggccaatccttgtgttgtcctgaagggccccacggccactactgctgtgccatcatgtgggggtagcccatggcctacacccgtccaggcactgcagaatgtcctttcaagagccctgactggtcactgagccagggtccaaagcgggggagatttgaggaacaggaaagacacaaactgagtacactctgggtagctgcgtcttggggttatgtgtcttaaggggagtggaagcttgccctgtgccctgaggaaggtggggagactcttatcatggggccatgatagagaggggccctgagagtcaggggagggagggctctgagccttggcctcactgaggggattgggtaacagccgaagacccagctaaaagggcagcggggacgccttgaactcacacaggactacccggtttcactttgttggagccgggagctgcttcgatcaagctggggaggctctgctaagggcgcacgttaggcaccctgctgccggccgaagctgggaccaagaggccaaaaagtcagcaagggcgaggccgagtttatgtaggccaaggttgccgaaggtgggggctccagcgctgggctggccatttctgtgtccaggaacggcccaggaggctcccctgctgcgccaagctcccagttgagtaggggcctgcccagattagagcagctaagccaggaaagatggagcccaagggctgggacgacacagcagcccccagaggctggagggaggggccgagcagaggggccgccagccccaggcaggtcaaggggggctgccttccaccagctagggtgacccaaggcctcatcacccccaggcggatgtttcccaccttccaagtgaagctcttcggcatggatcccatggccgactatatgctgctcatggacttcgtgccggtggacgataagcgctaccggtgagcgagtggttgtaagcgtgagggaccgggagggcaccctggaaagtggcgggtctccgcctggtgacccaactccaagggtcgtctgcaccatgaaactctttaggcacctgcgatgctgcccgatcaacccgctccctcctccactcccatctgaccccagacccacaaccctactccatgccctctcagaacccgcctctggagccgcaggctgcagacagctcttgctcccctgggctggtgtggccctagggtggtcagccaagtactcagccccggacttcttcaagtctccctctcccaggaggccggcctgagcgcctagtccccttcccccatccccagggaactctggatcctggagctgggccggaaaggtggggtggccaggagagattatgcagggcgggcctcagctgcccggacaattaacagcaattaataaagagaacgcgcactgccctgtgcctgaggcccggcaaggccaagtgtgggctcccaccgcagcggcaccggggcgggaggacccgcatccagcgaaatgagatggcaggagcccagcctccccctctcggtgccccacagggtgtccagttccttgattgttttgagtgttggggtgggtgggagttctctgtttagtccatagtcccccttggaaaagctcccagcacatgcggcagcagagggttcaatctcacaggtggggaaacttctcaaaggcacttttagggttcgcccagcacacgggtcaaggccctctgggttcacctccacatgcacgaccccaccccgtgccgctccaggtacgccttccacagctcctcctggctggtggcggggaaggccgaccctgccacgccaggccgcgtgcactaccacccggactcgcctgccaagggcgcgcagtggatgaagcaaatcgtgtccttcgacaagctcaagctgaccaacaacctactggacgacaacggccacgtgagcgactgcctccccaggctccggtgtcccccaaggcctcgagtcccgaggcacccgcctgtccctaagaggcctgtagaatccccaggcccccggctgtccccaggcggctctgggctgtccccgaggaggccctttagagtccctgcgaggctagaggctgaggcggagcttgggcagtgctggtgtgccgatgaggagagcggcctctggtcaggggtcgcacagcctagtgggcctgggccctgggagaggggtcgccctccttctctcaccccactcctgattttatgcaggaagcttttttaatggaaaagatggggccctgcaagggggctggagaaagaggctttatggagtccaggccagtgaggtcgctgggcaggcacctaaggaaagagaacctaaacccagatcttttgccacttggagctcattcctggcagttgccaatgggtcacagcctcctcttggcccagtgacccagcctcatcttggaattaagggttttgcccaactcatccaggaaactcattgccaactcagacctcagcccatttcctggctcccaccccagatcctcagcccagccccaccgctggagctgattccccaccttgtcttccagattattctgaattccatgcacagataccagccccgcttccacgtggtctatgtggacccacgcaaagatagcgagaaatatgccgaggagaacttcaaaacctttgtgttcgaggagacacgattcaccgcggtcactgcctaccagaaccatcgggtgagggcctgtggggaggacctgagcggattcaacgcctctggaaaagcgggtgtaattttcagttgccgtttggggacagtgggtccgcttagacctgcaggctgtggtcccagtggagcccaacccaactggagccccactcccaagggcctcaggcagccccctccctctcgaggctggccggcccagcctcctatcagcttgacctctccagcggcaactgtcacttcgtcctgaaagtttgttttccgaaccattccggaaactccccatcaggggcctgatctgaggtttacccagattactagggaacccgctctgttccccaccccccaccccactgcacgtggggggtggtgaccacattcctgtcccagcgaggagcacagggcctccatccccacccacctgggggacaccagagaggggttccctagtgagagaggaggttcctcagacccccgcccccctgcaggagggagcaccagctccgtagaggaggggcagacgtggactggttcttgtcagggcagcagaaaggcccttggtgcgcttctcctaacactcccctatcctccgccgaggtcgggtggcccaggctgcagggctccagcggcttgctcacacccacctccctgcagatcacgcagctcaagattgccagcaatcccttcgcgaaaggcttccgggactgtgaccctgaggactggtgagtgtcctcccccgagagagtgagcgccgggcgcctggcgcaggcgccgccctgatccgcctcccgcccgcaggccccggaaccaccggcccggcgcactgccgctcatgagcgccttcgcgcgctcgcggaaccccgtggcttccccgacgcagcccagcggcacggagaaaggtagggccggggtcgtgggatccgggttccggccctgtgcgcgctctaccccgggccggcggcctcgcccgacctcgcctgcgcccccggggcgctccaggctttcgcgccggttgcacaacggccgcggcggcgggcaagcgcgcactcgcccgcccggcccgacggctgcgccccgcccgccgccgccgccgcccgcagaggggcgcgggccccggggagggctcggggcgccggcgacttggggtctcgggcacgctggcaccgactggtcggggaacaccgagggcggccaagagccttctctccgccagggcctcgcatggggcgtcggagctcctcggcggccccggccggccgcgctcactcctcggccctctccgcagacgcggctgaggcccggcgagaattccagcgcgacgcgggcgggccagcagtgctcggggacccggcgcatcctccgcagctgctggcccgggtgctaagcccctcgctgcccggggccggcggcgccggcggcttagtcccgctgcccggcgcgcccggaggccggcccagtcccccgaaccccgagctgcgcctggaggcgcccggcgcatcggagccgctgcaccaccacccctacaaatatccggccgccgcctacgaccactatctcggggccaagagccggccggcgccctacccgctgcccggcctgcgtggccacggctaccacccgcacgcgcatccgcaccaccaccaccaccccgtgagtccagccgccgcggccgccgccgccgctgccgcagctgccgcggccgccaacatgtactcgtcggccggagccgcgccgcccggctcctacgactattgccccagataacacgggccctgtcgcgctcccgccccggtcctgcacagccccgaagttcgccgggcccggccaccctgccccaagggcaagcaaggaatacgttcccccagccccaggggccaccgcggctctccccttccccagcctcgaagccatgggggccccctcgccacccccagccccttgggctatcgaagtatccggttccccagtccctggagccaccgcgggtccttccccggccccgagggccaagggggtccccgcccgccagtgccaaagcgcccggtcggaggcggaaggaagtgatatttattgttctccccgagaccgcgtcgcccgcggcccggccggcagttgcagtgtagacagcccgagagccccgcctgcaggcggtgtagatacatgtagatactgtagatactgtagataccgccccggcgccgacttgataaacggtttcgcctcttttggaagccgcctgcgtgtccatttatttgtgcccagttagatcgcgttgggaatcttcgggacagcgagcccggggtagctcagggccctcagggcctccccagccccaatccctgccgactgtaggtcggtcccggtcccacagcgccctgtccgccacgcctcctgccctctgcccgccccataggggctcccactgcccctcccctctccgaggcccctcctgccaggcctgtgcactccccccaccttcccaccgtcccgtctcatcccaacctccccagggctggtggtaccgcccaggtgtgcatcctgcctttttacttaaattcctcccacctgcagttgtccctattctgggacttgggcctgcgccctggcctgttttcgggacagatgcttgtgcttttccatggaagctgggaagaagggtcatgacagacactgccggtcggtgctgggagggggagaagcccctgaccgggatggggtcatggaaagacaaaaacaggcagcactgttctgctagcatttcccctgccggcctagcccaggcccgcatgttccctccttagtgactttatttgctgtgagtgtccctacggagtgacctggccagggggcacaatgacagtagccatgagtcatcttgagacctgtgtatgaagcatttttcccaggccaggtggctaagggacctctccccgttaactcaacaccagggatggggcgagaggaactctttgatccctcccttcctgagcgcaagcaggaagggctgacagccggtcagcgccaaggctgctgacttggacacaagatgaacgggaagtgcacgtggccgaggctctgtcccccacctcccgtgcctgtcccagtgtgtttgtggcaactgctgccttctaggccactcggctcatcaccccacgtggtagcggcagcctgagtgccacctctccgagggcacagccaggagtttccagatgtccaccctcgcggacctgtttttcgtatacatgtttgctctggcggcgtgaagtgagtggggtcttagtaattgaatggcaggaaccattcccagaggccagtctagggtgggagggggtctccaggggccatccaaagcctcaaagggcatctagcaccagagagtgaggacctctgcagcatctgcccaggctccgtgagcacggctttggagatgcatttggggggacggctgtggatgcccattcccaagtcctgatccccacctgcgtgaacttggggcagccattacccatgtgccccacggtgggtggggctttgcactgcagagggcctccctctcttgctgtcagaaggcagccattccgtactccacatccaggatgtgcggaggggctgccattcgagacctccgccttggttttgttcagagctaaagggaggaaaagccctcccctgaacaaagagcaaacacagtgtttgtaaatgagggtgggacacacagcaatgtgcaaggaccctgagtgtgcagcaaactggcctgttaccgtgcccctcctgttgggatggccatgcaagatggagcacccagccgtccagcagggccgccgctggccatccggggctgttcgcattctttttttttttttttttttttttttgagactgagtcgcgctctgtcgcccaggccggaatgccgtggtgcgatctcggctcactgcaacctccgcctcctgggttcaagtgatttcttttgcttcagcctcagagtagctgggactacaggaatgtaccaccatgcccggctaatttttgtatttttagtagagacggggtttcaccatgttggccaggctggtctcgaactcctgacctcaggtgacccgcctgccttggtcttccaaaatgctgggctttcaggcatgagccatcacactcggccacacgtcctaatgaactaggattcattaaacattcaggtcctcactggccccattccaggtgctccgtggctcacaggccgcgggtcaccacactgctgctgttgctgctgagggcactcccacgctgggcagtggcccccagaagtgtgggtttcctcccctccacctttgtagatgagtttgtgcatctgagaacttcttgtaaatgagagctcgcaggccggcgtctgggtggcagcttccgctggctgtgtgtctgcaagactggcgcacgccgctgctcaccgtccctcatgtgctcagtcctcaaccagtgcccagtgattgcctgcccgctgcgggggctgtctggctgatgccccagccactaccgttcctgtggaggtgacgttcccatgggcagctgccctaaggcctggcttccagcagcttcctctgtgacagctgtgatctgaacgttcacccccaaggtgatggtggcaggagatggagcctttaggcggtgattaggtcacgagcgtggagtcctcatgagtgggattagttgagtgctatgctgctcacagacctccagcctccagaactgggagaaataactgtccattgttgataagccaccgggcctatggtcatttgtcctagctgcactactggactgacagtggccgttcttccatctccttcttgttccctgttttaggttccccgttgagcacacctgccctgccccttctgtaagctgctgtgatgggcagtatggtgtaggggatagggggctcgtcccaccgctgttcccccacaggctccccctcagctgttggacttcccccaaacatcctcctccaggttccctagctggtccagaggccccgttgccctcccctagcctggctgcagacgtccagctgccaggactcaggaggacgagagaccagaagggcccccagactcctcactcccaaaaactctccaaaaacaacagatgcacaacgcaggaaatagatagattcttgactaagcgggggtggggaccatccacacccccttcacaccactgcatcccacggaagggttctaggaccccagggcctgggggtgcagctggacgatcctgcagtagccccgctccctgttttcagaagacccccccacggctgccctctgcagcatgtgcccctttgtcgaagggacaatgggcactccattgcccagagaggcttctcacccaggaaagcactggaggtgcagaggcaggagcacgcgggggcttggctgcgggacaaggcgagtctgtttggtggcaccttgagctgcggaggaagacaagaccctggcccggtggagatgagaccctggcctggtgggcttcaggccccaccctgcggcgcaccctccagctggggaagtccatggggtgtgtgggatccatgcgatgacagttgtatgaggctgaggccctgatctccaggtgtgccgcagatcaaagcacccgcataccagagaattccacgtagccacagttgccaagggcagaggcagcctcacctctcactggtggagggagagtgatgggtgaggagctgcttctaggacgaaagggatggctccagtgtgtcaggcagtgcaacccaaccaggagctgggcaccaggggagagcatgtggcccgtgttccagagactctgtgttccagagactcagttttcccttcagctgtggtgctgacctccgccctgtgtggagaagctctctgtcaacagtggaggcctgtgtcagccatgggcacggggacgttcattcctgcttctctcctccctgtgggttccaatgaggcggtgtgctcgggcagggtccacaagcatctgcaccatcctgcctctcctccttgccaagctccttcaccccccgccctgaaggagcatcctgcagagcctggccaaggagcaggtgggggcacggccccccagcctggcatagtggcacccaagcctagggagggcaggatgagacctttttccttggtgctacctcacacattttctggatttcaaaaaacacaactggtgcctttgattcaattccctttcctgcttgttgtactacttcaaaccagatgggctcctcagatgaaactccggagactcagtgtctctctttaaccgctgccaggtctgtgtgtgggaaacagcagaaccagaaatattttgctaaaaccagcccatgtgggggagaggcttagcttttaatagcagtaattaaattatcttcttaattataaagggtgatggcattgtcaacatgctttatctatcagctttcaattgcacaaagtaagcacgtaatcctctcctcccggccccactggcatcctctgctctgtggccagcccaggcccccttcctgcagtgcagacccccagaagctttggggtgcatctccccatttcaccagttctgaggtgcacagggttttttgcctgcatttcaacacctctgaagttggtgttctcttattcaaagtggggggtctcagcctaactgaaggatcttggctgcacatgaaaccatggtgcagtggcagttgccagggtgctgcagttgaggcccatgtcggtgcgcccactgtggcctcgggcaacgctgggtgccagcatgttgctctgggtgactttcttgcaggtggtgactccggcttctgtctccagcccttacagtggccctgtccttccaggaccttactcttcattcacatcatttctcaggacactcctccctgcacatccctagtcttccccatctcctcttcattcctctgtcattctagcttcagttcctctcaacagtttttttgtttgttttttgagatagagtcttgctctgtcgcccaggctggagtgcagtggcacaatctcagttcactgcaacttccgcctcctgggttcaagcgattctcctgcctcagcctcccaagtaaccgggattacagatgtccgccaccacgcccggctaatttttgtctttttagtagacatgggtttcaccatgttggcctttttttctttttgagacagggtcttgctctgttgcccaggctggagtgcagtggtgtgatcatggctcactgtagcctcgaactccggggctcaagccatcctccagactcagcctcctgattagctgggactacaggcgtgtgccaccacaccctgctaatattttgtagagacatatgagtcttgctatgttgcccaggctggtcttgaactcctgcctcttgaactcttggcctcaagtgatcctttggcctcagcctcccaaattgctggcattacaagcgtgagccaccgtgcccagccctcttctcaaatagtttttttttcccctccgtttctgaattcatcctttatctcagaatatgttttccggattactcccccaagacaagctttttttcttgtgacatcatcacagaacgaagatggtgacagcagcagggccacaaaacagtccccagtctacccagttgctcatggctgtggtttggaccttcagccatgaggcagtacgtcttcccagggcagggtagggaccttcaccgcggggctgggtctcaggagctgccgggcgcccttctccagcccgcctttgtgataagggacagaatcggggtcactggcaggacacaggtccccttccctgtcgcctcaggctggtgggattcctgcacccgagtgctgctggggctgcaggcgaggcctgggctacacaggaagcccgggcaccgcagagtggccgctagctggtggcattgttcctccacggattcagagcttacgagcacgggcgttgagctgaggcaaaatacggaaacagccacttccatgcaaataatcacccttctgataacaataagtcaagtctcaagggactaagaaaaacaagcagctttattaagatgcagctgaccgatctgaaagcctgcctgctccgccacctcctgggagagcctgcagggcccgagctctggggacaagagctgctgctcaggccccagaggaaggtctaggtgggaaatgggccgccaggaggtggacaccaacacataggagcacatcccaagacacccatcaccctgtgtggtgggtgctggaaagaaacagcctagttatgagagagacttgcaactgggggcaccctagcaccccacggaggcatttccaggtggcccctccagcttggctgtgtgggcttccttggaggaccctccctccaggcggccagccagaaggggccatctccaggcaggcacccccttcaggagagcccatgcccagtcactgcctgggaagcttactgcagggctggcccccacctgccactgtcacctcctgacctccacctgctctcctgggtcctcaggcctcacacagtcctgtccttctaacaggtgactgcaggatggagccccaggcatctcggcatcctgatgcggtcactgccaggaggggagtggtctcagggtgggccagacccctggacaccagcgtggtctccttcctgagctgccgagggagatttgcctggcaaagcccacctggcccctcggccctcagccgccgagtttccctcctgcagtgggaggtttcccacgactggagggaagcagtggctattccagtagtagctgtttctcatgcacaggtctcttccccagaaagaatttgagctgcaggacagagatcctatcacatatatacccagaaggtgattcaaggtgaatattaaagacttggatatccattaggatgatgatgattttaaaaaacaaaaacagaaaacaacacgtgttggtgaggacatggagcccctggaagccgtctacactgctggtgggactgtaagatagtgcagcttctgtggggaacagtgtcatgggtccttgaaaaattatacagttgttagggagagtgaagcaggaggactgcttgaagccaggagttcaagacccgcctgggcgggcctaggcacctgtagtcccagctactcaggaggctgaggcaggaggatcgcttgagcccaggagttccaggctgcagtgagctacgatcacaccactccacgccagcctgagtgacagagcaatatcttgtctctaaaatcaattaaaattctacatagaaccgtatgttccaggaattccacttctgggaaaatacccaagagaattgaaagcagagtctcaaagagatatttctccacccatgttcatagcagcattactcaaatagcaaaaggtggaggcgagccgagcgtccaccgataagtgaacggatcaacaaaatgtggtgtgtgtgtaccgtggagtattatccagccttaaagaggaagggaattctgttacatgctacaacagggatgaaccctgaggtccttatgctccgtgaattgagccggtcacaaaggacacattttgtactgtacaattccacttgcatgaggcacctcaagtagtcagattcaagaaacagacaggagaatggggattgttagggactgggggagaggaatggggagttggcgtctagtggggacagaggttccattttgcgttcatctggaggtggacgcacagcatcgggaatacacaatgccactgaattgtgtacttcaacatggtcacaatggcacattctttattttttgtagagacagggtgtcactgtgttgcccaggctagcctcgaactcgggttcaggctctccttccacctcggcctcccaaagtgctgggattataggtgtgagccaccacacctggccaaatttgtgggttttttggtttttatgtttttgaaacagagtttctcccttgtcacctaggctggagtacagtggcgcgatcttggctcactgcaacctttacctcctgggttcaagcgattctcctgcctcagcctcccaagtagctgggattacaggcacctgccaacacacccagctaattttttctatttttagtagagacggggtttcaccatgttggccaggctggtctcgaactcctgacctcaggtgatccgcccacctcagcctcccaaagtgctgggattacaggagtgaggcgctgcgcccagccaaaatttgtgtttttaaatgtatgtttaacaatttaaaaatcctagatcatccacagtttgcaaaagccactgctatccatcttggattgaccaattccctacctgcctctaaagcggtggttttttaacaggagcagtcttgccccctggggtgtttgacagtgcctgggacactgggtgggggtgcttctggcatctggtgggtggaggtggggtatgcttttcacctcctgcaatgcacgctcggaaccacaggtccggagccatggggctgctgtggcgaggtcttcccacatggccgcaccctgtctgaaggagctagtggtggggccccgaatattctgaggccaggagctcccaagtcccacctggcatgaagcggtgccccagggccctctccgcactcctccccctgcccaagtgggcccagactccccagtgaggccgcatggcctggagtgctcgcctggagcctgaggggtctggctgctgtgaggtgggcttcgagggtggctgccaggctgtgctggagagggctgggcatcagaaggctggtgacagccttgcagggagacggagggttaccggagccatccctggaggtggcccctccaagtgctcgggccccaggcaagtcccaccggctcccgagtggaaggtgtaagccacgtgggcacaggtgggagggagttctcaccacccatggctgctagtgcccctgaaaccacctggaagtcccagcggcttccccagggacaggcagtgctgtggcccgtgtccaccccagctctggggcctgtgctcgtggctccgtgtctgcccgtggtctccctctctctcaggggtggtttctctgtccctacccaatatggtgctctatagctttccttaggatcctagctcctcaggaggaagacgtgtggccccttgctccaggaaggcccagtcctccctcactgggggtgggagggtaaggcaaaagtgccaaagtgtccatcccatgaatgcaagacacacagtgcctgctctagaagagctcatgttccagcagggacagctaacacccaggggcctgcacggggtggagggctcttcagaggcaggatcacctcggagatgggtgcaggggacctcgggccaccccagggccaggcctgcttgccctgcttaggagctgggtctcccactcagggagggaggggtcatgtctcaagggcagccactgggcctgaaaagcagaaccgcatgtgatcagtctgggtgggcaagacttcaagagagcacgcctaccctcaagggatggaagcagaggctggtagccgacgtccatgccagccaccaactcagagccagcacactacccgcatgtgcctctgccaatgagtggatgaaaagcagcgacctacagatgcaggcaacctggatgagtcttgactttatctcacggagggaaggaagcaggctcgggaggtgccgtgccgcgtggctctgtttataagctgtctgggaaaaggcaaaaccacagtacagaacacagatcagccagtgcaggcaggaagggccagcacacggggtgggaggagcttcctgggtaacgctcaatcccatacgctacagagggcgcatgttattgaacattaaggtttttttaaaaaattttaatttaatataatttaattattattatactgttttagggtacatgtgcacaacatgcaggtttgttacatatgtatacatgtgccatgttggtgtgctgcacctattaactcgtcatttagcattaggtatgtctcctaatgctatccctccccctccccctaccccacaacagtccccggagtgtgatgttccccttcctgtgtccgtgtgttctcattgttcaattcccacctatgagtgagaacatgcggtgtttggttttttgtccttgcgatagtttgctgagaatgatggtttccagtttcatccatgtccctatgaaggacatgagctcttcattttttatggctgcatagtattccatggtgtatatgtgccacattttcttaatccagtctatcgttgttggacatttgggttggttccaagtctttgctattgtgaatagtgctgcaataaacatacgtgtgcatgtgtctttatagcagcatgatttataatcctttgggtatatacccagtaatggggtggctgagttctactcttataaagagcgtgctggcctttcccatgccttctcgtctgttttgacccattctgggtatcggtccttttcgtctccccctctccatcctctctcagcccctttcactgggtttcagtgtgctgggcacaggttcagggtgtgttgttactcttaatttttttttttttttttttgagacagggtctccctctgccccccagcctggagtgcagtggtatgatcatggctcacggcagccttgacctcctaggctcaagtgatcctcttacctcaacctcccatgtagctgggaacacaggcacgcaccaccatgcccggctaatttttaagttttttgtggagatgggattttgccatgttgctcaggctggtctcgaactcctgagctcaagtgatcctcttgccttggcctctcaaagtgctgggattacaggcgtgagccaccacacccaaccaggatttattactcttaactagtaaaacagcacattcctgctcatttcaagagacaggatcttgctctgtcacccaggctggagtgcagtggcatcgtgatcaaggctcactgcagcctcaacctcccagtctcaagcaaaccttcctcctcagtctcccgaacagctaggactacaggtgtgtgccaccacacctggcttttttgatgttgttgttgttgttagagatgggggtctcactatgttgcccaggctggtcacaaactcctgagctcaagtgatcctcccgcttttgccctccaaagcactgggattataggtgtgagccactgcacctggccattgctccttatttcttttctttctttcttttcttcttcttttttttttttgagacggagtttcgttctggttgcccaggctggagtgcaatggcgtagtctcagctcactgcaaactccacctcctgggctcaagcaatcctcctgcctcagcctcccaaatagctgggattacaggcatgcgccaccatgcctggctaatttttgtattttcagtagagacggggcttcaccatgttgggcaggctgatctcaaactcctgggctcaaatgatccgcctgcctcagcctcccaaagttctgggattgtaggcatgagccaccgtgtccagcccctttgaaaccccatctctactaaaaatataaaagttagctggacgtggcggcaggtgcctgtaatcccagctacttgggaggctgaggcaggataactgcttgaacttgggaggtggaggttgcagtgagctgagattgcaccactgcactccagcctaggcaacaataagactccgtctcaaacaaataaaataaataaaagtaggtaagggggagatctggttccctgatccgacgtctttccttggggtcactgactgtgggaaaggcctgtgctgggctgaggtgggacctggtgtggctgtggaggccgtgtctgtgtctgtgtcctgtgggcggctcggctcgttgggagatgcagtcctgtcctgcccttccatgcggttcagacactggacatttgtgcagtctgatctgcaagaaaagagaggcacctctgacatggtacttcatccactctcattggatggggttgtcacccaggtggacatgtcctgaaggacaaggaagtgaaagctgagacgtctaggaacacaccagagagagaagtggagcttctgagggatgcaggtggctgtgtgaacctggggctcccctgccccgcagagtgccaacccttcaatacccagggcctggtggctgggaggaccgcaggtgaccgtctttgttgaatgctgaggccgggccatgggcacatggagttgtcgtgtttcccttcactttggttcatgtttgaaatttccaaaattaaaaaaacagtgacttgttcagtaaattccaatatgaataaagtgcatgttttgtaataaatacttctccatagagtcacactcccagttgataaatcaaaacttgttggataaaacaaagtaaatttctcctgacatttaaacattgactgtaaactcattataaacacttctaaatatttaatggaaactacaagcttaacatatctgatccaaaaatgccttaaacacctcagtacagacacccacacactatgaggatgattccctcaaactggttctgaaagcagtagctgtgcttttctctatcgcgttcttattctttctccgacgtgctcttagcaccctcctggggattagcatccgacccacatcactcgggaaaagccctggctggcggctcccaggcggaggcaccacggtgaggccaagtgctgctgtccagtaagcctgactgccccctcaggctctttcccttcacatttacttatttattttttaaatcgacatataaaattgacgtatttattgtgtaaacttcttaccacaaaaatgagaactatgtcaggtgatgtatttgctagttagctagacttaagcaggcctttagttttcagtttttaacattgagggaaaatacacgtaaatcaaatttaccatcgtagccctttgtaagtgtacatttcagtggcatgaagtccatccacatgactgtgcagccatcaccaccagccatctcagaactcttcatctcagaaaactgaaactctgtccccattaaacaagaactcctcattcccctcccctggcagccagcattctactctctgtctctgtgaatctgactactctaggcgcctcatgtaagtggaatcacacagcatttgtctttttgtggctggcttagttcactgagtgtaaggacctcaaggttcatccgtgttctagcctgtgtcggaactccctgcctttataaggctgaacactattctgttgtatgtctgtaccacgttttgttgattcattcttctgtcaatggacacttgggttgctcccacctgttggctgctgtgagtaatgccgctatgaacgtgggtatagaaatatctttgcagccctgctttcagttctcttgggtattctgccacaagaggaactgctggctcatatggtaattctatgtccaggattttgagaaatgaccacactgttttccatagctgctactccatttttacattcccaccaatagcgcacaagggttcagatttctccacacacttgttttctgtttttttttttgttttttttttttgagatggagtctcgctccgtcgcccaggctggagtgcagtggcgcgatctcggctcactgcaagctctgcctcctgggttcatgccattctcctgcctcagcctcccgagtagctaggactacaggtgcccgccaccacgcccagctaattttttgtagttttagtagagacggggttttaccatgttagccaggatggtctcgatctcctgacctcgtgatccacccgcctcagcctcccaaagtgctgggattacaggcgtgagccactgcacccggccctgttttgtttttatttttggtgtacccatcctcatgggtgtaaggcagtatctgtctcattatagttctgacttgcatttccccagaggatagtgatgctgtgcctgctggctactcatacatcttctttggagatatgtctacttaagtcatttgtctatttttttttaatttttaatttttagagacagggtctcactatgttgcccaggctggactccagctcctggattaagtgatcctcttgcctcagcctcttgaataactgggtacataccacggcacccaggatggcccatttttgaatcggcttttttgttgttgttgagttttaggagttctctatatattgtggatattaatcccttatcagatatatggtttgtaaagattttctctcagtctgtgggctgcttttttactctgttgatggtgtcttttgatgcatacaacttttaaattttcatgaagtccagtttgtctatttttttcttttgtgaaatgtgcctttcgtgtcatatccaagaatttattgctaaattcaatgtcatgaagcttttggcctatgttttcttctaagggttttatggttttaggtcttaatttaggtctttgctctattttgagtttatagggtatgaggtgggggatcaaactgcattcttttgcatttgtaaatccagttttcccaacatcatttgttaaaaagacagtcttttcccccattgaatggtcaccacattaaaaatcatttggccagccaggtgcagtggcatgtacctatagtcccagctacttgggaggcagaggtaggagaattgcttgaggccaggagttcaagaccagactgggcaacgcagtgagaccctgtttctaattgagaaaaatatcactggtttatttctaggctgtctattctattacattggtctttacatctgcctttatgccagtaccacactgttttgattactatagctttatagtaaattttgaaaccaggaagtatgaatcctccaagtttattcattttaagattgttttagctattaaggggtccttgagactccatatgaatttcaaaatggctttttctatttctacaaaaaatgtcattgggatttttgaagggaatgcattgaatctgtagactgctttgggtagtatggatatcttaacaatgttaagttttccaatccatgaacatgggatgtatttccatttatttatgttttaatttctttcagcagtgttttatagatttcagtgtacaagtctttcacctccctagttaagctaattcttaagtattttattatttttaatgctgagtctcttttgataacaaaacctcttgttatgttgaggaactctttagcccatcttttgtatttgctttcagtttgtgacactttagcatctcttcctgagatgagcgattctttgggtttcatggatgggagagcccattgcattatcctttcatttggagatattgcctggtgtgttgggacaaggaaggactaaccttccttgtcagtgtcttatcacacccgcagggctgagtgacagggtggtcctgggcaggctgcctgtggctgtgcaagctgagtgggtgcacactggactcttcccacctactgatggtgtgtgaggctgatgtgcatggattctagctccttccctgtttctggggcctcagctgtctgtgttcactctttcttgctacacaaagagaaacaaggacaagccttatttgataaaggccacaaacactttgaccttcctccacccagtgtagggatctgtttcccctctcctggactccagggctggtcacagaaggctctgggctccaacctggcttgctggacgtgctcttgaagcccccaagtaagaagtctgagtccctgagaccaccacactgcaaggacacttgaaggtactcaggttggtggtccccgctgtgcccagcccctgaatgaagccaaggctccaagcacctgagtgaagaggctgtgatggaagcgaatcctccagccctggccatcaccccgtggagtagacaaactgctcagcccagcctctcctaaattcccgacccacggagcccacgtgcccagaatggctgttatgctgctctgtttgaggtggtttattaatgtagcaagagataatggcaccaggatgaggccaaatgactcgatttctctacaccccacattttacaggtttcagagcccaagtcaggaggtcaagtgtgcatgcaagaggtggcaggggacagatgtgctgctgttcccaggccacctgcacagctggatggtggaagcagttcacttaaaggccatgagttactcgggaggctgaggcaggaggatcacttgagcctattagttggaggctgcagtaagctatgatcatgccactgcactccagcctgggtgacagagtgagacccccactgtccctggtctcttaaaagaaaaaacaaacaaacaaaccaaaaaacaaaacagcttatgagcacctcctactaatttcctcagcttagcacaccctgtggccgttgtccccatcgtccgtggcttcatccctcaactgatgctttcctatgtggacttcccggccagtgctgtgggacctcccctgtagggctggccagcctcatgggctgggctacccgtcccactcagcagtggctgcctggcctcccctctgtccctcctgcccagctcctaatgggcctcccataaaagctgatgcgtgggagccaagccacagctcgctgacctggggaagctgacagagtgacagagggtctcaaggactctccacccacaaggcgggaatggggatgctggcaaatctggtatgaaggttgagaccccgaggagaggcaggcctgggggaccgtgcagcagctgtgcccacctaggaccacagggctggtggggctggcagcttggtagagggcaggtgcacagcaaagttttcaccggtgccggcttgttgtcttccacgctgggatttcacatgaagttctagctaattgagtataagcatttctaaagaacccccggagggttgtttttctttgtgcaaacactccttttgtgcagagggtgttctgtggcttcttggcagagacacaggtgggaaacacctgattgaacatcattgcctggggagtggagacacgcacagcacgtcaacatggagcgcccagcagcggcggcgggtcctgggctgtgctccggagcccttcccgggatcatctcccggcatcggctgacccctcggtgtctacgtgccaagcccaatctgcctgcagggacacccactgccagaggcggaggcaggttctcctggtcccagacccagggccgtctgttggcctgcaggtaacacgcagggaggaaggaaaaggctctaggcacagctgcttgtctaagagggaccctgttggcggcgcaacgctgggtgagtgctgcccgcccgcggatggggtgctggccgaacctaccttgtaaagtggggctgcacagaggtcagcacatggtggcgcccaccgtcgagaggggaggccccttggcactggaggcagggcctcaccaggcagacgtgccaggacccgcgtccctgcacacagctgcccaccggccagtggagtgggacctgctgcccctctgacagctcctggtaatcagaggggcccactccacctgcaccggaggcagcggctggggatgctggagcatacggctccagccactcaggatcccactctgggccgtgaaagttactccacagaacaccccaaggccacccctgctggctgtgaagacaccaccaggcggacagtgcccagggctggggctcacagccacgagaatctggatttgaacagaaaaagcccccagccgcgctgccaccctgacgcagccttgtggggccctgagcagaggaccagctacgttgtgcccgtgcctcgacacatggaaattcttccaataagaacaggatggtgggccgggcgcagtggctcaggcctataattctagtgctttgggaggctagaggcgggaggatcgatcgcttgagcccaggagttcgaaaccagcctgggcaacatagcgagactccttctctataaaaaaaaataaaaaattagctgggcatgatggcctgcacctatgtgggtggtcctgagcttctcgggaggctgaggcaggagaatcgcttgaacctgggaatcagaggttgcagtgagccgagactgctccattgcactccagcctgggggacagagtgagactctgactcaaaaaaaaaaacaccccaaaaacacaggatggtagaacacacctacctgagttggcactgaaaatggcaagaaatgtccgccgttgtttccaaacaccaagttctctctggcttgagaggcctcactgctacccaagagcattatggaggaagatgtggaagggctgcctctcccagttggtgggttggccaggggcgtgatggcagcgaccagccatgctgccaggagtcgcctctcaggttcatcccaggagctgcatgctgaccttcgcgtgctgcctccgggccacccctcctccccacttaatgccttcactgctggctctgttggcgttcctgccagcctacaggaagtggctgtttgctaggaagagaatgccaatgttcaggtgcatcttttccaagctggatgtctggagctgagaccgtttcttcttctgttgtgggggtttcaaggctggtcagacgcatggtgattcatcacgacccaggttctgttgacacaaaggccgacctgtccagagccacatggctctgctgtggacaccacggagcagctcaagagaggaacaggaccaggagggctgcactgctcttggccggcttggaccccagcaccggttctgctgctctcccaggcagctcagccaggtgaatgaaagtcctgggcctgccctccacaggacgtctataaggcctcagaagctggatctgcctggcaaggggggccctatctgcctagccacccagatgcgggcacgtggccccgttgtgcactggaggggtgagggctgtgttaggcatgcaggactcacgctgtcccgactccatccctgcacactgagattcagaacaagatgtgcctggacactgctcaacgccacatggcctggggcagggagctcaaggccaggctagggggcagccgcctgccatccaccctgcttgtgcctttgactgaaagcacgagggccaggggccaactcagggtctgtacaccctgcccacagctcttcatggcctctatgtaagacatcagcaggcagtgccactcgccaacctcatgctggcatgcacacctgggccctcatgtgggatacccacctcgtggctgtgggacgtagggagttttgtaactacagtgatgatgccaaagatgacagggacataaacaggggaaggggtagaggcccagaaccctcagggtgggagctgaggcggggcagatgtgcctttggcaaggctgtcaagggcatgcagggaaactgcaaagccaattcccactccacctaccctgccgctgtcatggggatgtcagaacctgacaccttccctcactgtgacagcctgtgatgagcacccagggcacagctccctcagcacctgcagtcactgcagcctaaacccaggacccttcccctccctgacacctcagtgatatgaaaatacctcccggagtgccctacgcatcctggcggctataggacactcgaggaaaagcagcagggcccccctctccaaaggtcctgggcacctggtggccacccttgtccaacggagccaggccagtacccgagccaggtggtctccaagcttgggccaggggccgctttcccggccagcactgacattcccgtttgatggaacggtccccatggtacctctgaccaacagagaagtgtggtcacaggactcctcaaggactccgggccccccagcaaccatgttcctcacagtggggttggggaggcacggccttgggaccccctgcagtgggtgcacaggtctcactgacaaatccaacacccccatccccaggccttggaagccctcctcggctgtaccccacggcggctggccatgtccacttcactcagtgcagccaccctcaggctgtaatccagcccccacccccagcccggcactggagccttcctggccccaagctgcagcgcccagtccagccctccgtttggcaggtctgttccgggaactcccctgatccacccctgctccggccacctggatcccacacccttccgatccgtcccacacatgttcagatttctgcctggaaacctggaaatgccatgtggtcctgcaggaggctggtgccactctcagggtcaccctctgtatctcatcctgggggtctgctggactcgagtctagttctaggactagaagcccaggtgggggtcccaaggagcatcggcagggccttgcagggcaactgcctcaagggaggccaccccgggccttcagctagaggggctcttccggcaatccgggcagacacaggcgtgtgtggtcccagcttctctggatctgcccatgggccccactccaatattcagggtcatggttctttcccaatcaacacccgcttttaggaggagacgaccggccaggctgggcccggctgcatgcagtgtgaggctctggctgctaagtcctgctcttgctgtgttgtgccctgggggccaccctgtgtgcagccgcagctgtgactgtggccttggccactgtgaggcggtgcttgtcacactcccttgctgctctcgtgccttctgcccagcactcacctggaggtgcaccctgtgcgccttccccactgcaccctctgcgggcaggcgtgccctcccggatcccacatctggcctggccctgtgcgctgcaagccccccttgccgtccctcacaggcacctttctctgcttcactctttagggagttcagttacttcctgatcctgatcctggcctcaacctgtgtgttgggagctcctggcctcctcggggtgaggggtcatgtggacatcgacgcagctatggttggggcctatcatctcctgaggcctggcccaggaaacccacactcggggtggcccattcaacagcaggtgtgagggtggggctgagcatcctgcctggtgggggtctgagggcactgatgctaagtgggggaccagggcctcctcagggagctcccacctcaagcctgcaacttggcaatggaaatttattataaaataccctcagctggcaacacagcaggcccaagccaacgtctcctgcaggcctcggacggccagggctctggctggcccccagagtcaccgtcctgtgatgaggcactccacaaaaggaaataccaacctcatgaagacagcggggactccatggtccttgggccatgacttgctggtcctcagaggcccttgaggtttcaggccaaggctggggcctgatgcccacctccctgcccgccctcctcgtctcccgggaagggagtgggtgagtcatgcgcgtgggtagagtgaccagaggctgatccgctgatccttggagcccgcggccagcaagccatcggcggtgaaggccacgcactggacagcggcgctgtggaaggccagcacggccagtggctgcatcgtccgccagtggaacacgcggatgcggtggtcccagcctgcggtggccaggatcttgcgatctggccggatcgtgacctcggcgatcccgggattggtgagttcatgagtcccacgcacctgtgagagttgggagaggtgttaggccactccttaagcccacaaggcagtgctgcccctggtgccccacctgcagctggaaccaggagagacgcaggcccacaggcccgggatgtgagggccacacgctcctacccagctgacctcccactcttcctaaggccacgatgggggactccagccctcccctcagagtggtcttcggccctgccctgctgctcctcgcaccagctctgaccgactccttccccagtcagagagcagcagagacagggaggtcccagctgcaggagaggggctgggtcccgggacccctcaccccagggaagccactgcaccctagtgcctagcgagaggccacgtcccgggcttgatggcagcagaatgctggcactcctcccagaagaacctcacaaccaccccaaagctgacgagggtgagaaatacaaactccattttcagcaaaaccatgaggtatgtgaacccccaagctcgacagggctgggagcgctgccaagagcaagacccagtggggggttggcaggatgagggggggacaagggggagacgccctggaggcggcaggagccacacagtgtaccttgcctggtgggggcaacgtccccggctgggttctgagagggggtagggcactgcacgagacccggagccacacagacaggtcctacgtgcacggggccgtcggggtgctggcctcttcctgggccgagcgttggggccagggggtggtggcatgtgcctgtaatcccaactactcgggaggaggatcacctgagcccagtggatggaggctgcagtgagctgagatcactgccaccgcactcctgcctgggcgacagagtgagaccctgtctcaaaaaaaaaaaaaaaaaaagatacgctctaataaaattattagacttcatagctaaaaaacctttggtggccagacaaaaagaccatgttgatgagggtgctgtttaggccgtcctcagaatgctccacagccacagggtgccaagggatgacggggtgatgcctgcaaggctgaggaggaaggcgaggtccaagtattttatatccagccaaactgtcgctcaattataaaaacaacagaccaacatttctgaacatgtaagaactcagagaatcctgcacccataagctgttcttgaaagactagaagattaactccagtctcgtaagagataactggagaactgcagcaaatggtctggcagggagcactggacccacttgcctataggatcagctctaagacaatatggggattacggctatggaaccggttattataactcacagaaatatgggaggcactgagagagatgggatggttgttaagttcactgatttagctcagcttttgtcctttggggccaaagatataatagtcaacctcatccccgagagattatctgagaaccccccaccataagtaatgacaaaaatagcattatttccttctcctctcccacctcactgtaggtgcctatgtttccttgtatagctgcataaagtaaaaaaaagatctaaatatactcaacaggctgagtgtggtggctcatgcttgtaatcccagctgcttgggaggcaaagacaggaggattgcttgaggctgggagtttgaggctgtagtaagctaagatcacaccactgcactccagcctgggcaacagagtgagaccctgtctttaaaaaacattacagattagccaggtgtggtcgtgtagtcccagctacttgggaggttgaggttggaagatcatttgagtctaggtttatgattgaatttcaaagtgaaatctaaatctatgctaggtacaaggaggatgccaaaggaactcttggcaaagatatactgggaaaatgcaaataagaacagggtaatctgaataataggaacatttgaattcagggccaaagcattaggtaagattatataaaagacttaacaatgataaagagtacaattcccaatgaagagccatataatcccagcactttgggaggccaaggcaggaggactgcctgagcccaggagttcaagaccagcctgggcaacatatagagatactgtctttacaaaaaaaattttttaattagccatgcatgctggcatgcacctgtagtcccagcttactgggaggctgaggtggaaggattgcttaagcccaggagtttgaggctgcagtgagctgtgatcacaccattgtactccagcctgggtgacagagcaagaccttgtgctccccaccccccaaaataactgtaaatatctgtttagccagtaaactgacatatcatccataaagcaagaacaataggaaagtgtctataattgagaaactggtaccagactagtcttcttgctgtaaacaaccataaaaagtggacaaaatacacaaggcaactgtttacaggcagggagcactaggcagagaagggcagctgatgaggtgggcctcccaaatgcccccacagctctctgcctggagacaatgccatgagcatgaagtccaggcagaacatagtggtcacattaagctgaggaggcagagatcataatctgcagtagccagagggctgaaatccatggggcaaggcaaaggaacagagggagctgaagattgtctgagggggtccctatgagtcttgtgtgagggctggactgcgcatgctcacggtggactccacagggcttaccagagctgcacagttaaacagaacaagttcaagaggtcaacagtgccgggggtccagtcagcctgaatgtgaagactgtgtgacagcctgagaccagctgagctaccagaacggcttcacttcaggaataggattctatcttagagtatggcctaccctagatctaccagaacaaaactagaaaccaagccctgaaaaggtctgcaggagaggcagagtttggaagttgaggtccaccccactaaacaagcctgggaatgaactttccacagacctgccctaacaaagccaaaagccaagcctgcacaagctcaaggtgaacagtcagtaactgaactccataccagaatgaaagcaaacactcttcagagcaaaataacagaacccagagattcagcatgtatcatttaccatgtctggcacacaaacagcaaattagtagacatgctaagaagcaggaatatatgacccatagtcaaggggaaaaagcagttaatagaaactgaccccaaaatggcagagatgttgaacatatcagataaagactttaaagaaactccttaactatgttcaaaaaatgaaaggagctctctcccaccacccaagatgccaaaaggaaagaaggccaagggaaagaaggtggctctggcccctgctgtcatgaagaagcaggaggctaagaaagtggtgaatcccctgtttgagaaaaggcctaagaattttggcatcggacaggacatccagcccaaaagagacctcacccactttgtgaaatggccccgctatatcaggttgcagcggcagagagccatcctctataagcggctgaaagtgcctcctgcaattaaccagttcacctaggccctggactgccaaacagctactcagctgcttaagctggcccacaagtacagaccagagacaaagcaagagaagaagcagagactgttggcctgggctgagaagaaagctgctggcaaacgggacgtccccaccaagagaccacctgtccttcgagcaggagttaacatcgtcaccaccttggtggagaacaagaaagctcagctggtggtgattgcagacgacgtggatcccatcgagctggttgtcttcttgcctgccttgtgtcgtaaaatgggggtcccttactgcattatcaaggggaaggcaagactgggacgtctagtccacaggaagacctgcaccactgtcaccttcacataggtgaactcggaagacaaaggcactttggctaagctgatggaagctatcaggaccaattacaatgacagatacgatgagatccgccgtcactggggcggcaacatcctgggtcctaagtctgtggctcgtatcgccaagctcgaaaaggcaaaggctaaagaacttgccactaaactgggttaaatgtacactgttgagttttctgtacattaaaataattaaaataatacaaattttccttcaaaaaaaaaatgaaaggaaagtgtattcaaataattacccaaaaaattgtcttgagtgagcaaataggaactcttagcagagaaatggaaattataaaaaagagtcataatagaaaatatagaactggaaagctcaatactgaaatgaaaaatgtattgaataggcttaacagtagattggaaatatatattttttaaagtcagtgaactggaagacagatcaacagacattgcccaatctgaagagagaaaaaacgactgaaccaaaacaaacagagcctcagggggccatgggatgctatcaaactgtgtaactcatagaagccccagaaggaggagaaagtgaaaatggtcaagaagaaacagtggctggatatttcccaattttaatgggaaacacgaatatatagatgaaaagctcagcagaacccaatcaggacaagaagaaaaatctatctaggcacatgatagtcaaactactgaaaaccacagataaaaaaaaatcttgaaagcagccacggagcaagacatattacatgcatgggaatgataggatatcatgagttctcatcagaaacaatgtaacaacatctttacagggcatgaagaaaaataaaactatcattcctaaattccatagccaggattctgtaaaaatgagggtgataaagacattttttagataaacaaaagctagagaattttttgccagcagaattgcactacaaaaaaatgttaagaggatacttgggtctataggatgagcaccagaaatggcaaaggggtgagtaaatgtaacatgttatgttttttatttcttgtaagtttttttttaaactgatgatttaaaggaaaactggccagatgcagtggctcatgcctttaatcccagcatgtgggattgcttgaacctaggagttcaaggccagcctgggcaacatagtgagaccctatctctacaaaaacttatccaggcatggtgataggtgcctgtagtcccaactacttgggaggctgaggcaggggtttgagggtgcagtgagctgtgattgcaccactgcaccccagcctgggtgacagagcaagaccttgcctcaaagaaaagggaaactaatattgtaaggtgcagttttgaatgtgtgtagacgtcaagtagatcacaacagtcacagaaagactaaaaaggtgagtagaagggattgcaccagcacaaggtcatcatgtttgtgaggcgggatgtaaacaacactgattctaaggagactttgagaaggttgcacactcttggagtgcaaccacttaggaacaaaagtggcaagaggtctagctaagaagccaagagaggaaacaaaaccgaatactaaaaaataaatatttgattaccacaaaagaaggtaggaaaggaggaaaagtggtcaaaaatggaagtgacaagtagaaaataagtatagaggtgttagacttaatcccaggcatgtcaataattacagtgaatgcaaacagactaaatgcaccagttaaaaggcagagattgtcagaaagcatcacaaagcaagacacatctgtctgctaaagatgcttttcattgggaggccgaggcagacggatcacgaggtcaagagatcgagaccatcctggacaacatggtgaaaccctgtctctactaaaaatacaaaaattagccgggtgtggtggcgtgtgcctgtaatcccagctactcgagaggctgaggcaggagaatcacttgaacctgggaggcggaggttgcagtgagccgagatcacgccattgcactccagcctggtgacagagtgagactccgtctcaaaacaataaaataaaataataaaataaaataaaataaaagatgctttttaaatatcaagaggtcaggacaggttgaaagtagaagcaaggaggaaaatgcaaagggcaaacctaagaaagtcgatgctactgtttagtatcagacaaagccaacttcaagacaaagagcattaacaagagacaagggacactttgtgctgagaaaaaggctctgcaccaagatgaggtgacatctcagcgcctatacacccacactgagccccagagcttcaaagctcatgaagcaaaactggcagagacaaagaaacaggcacgtttgcaatcacagttaaagattttaagagccttctctgcgtaactggtaaaaaaaaaacaaaactagaccaaaagatcggtaaggatattaaagactggaaccacgtccactgacctgggtcaggctgacggaaggctccaccccacaactgcggaacacacgctcctttcaagtccatgtggtgcactccccgagacacgccatgtgctgggccaaaagcaagcctccataaatttctaaacactgcaattgcactgcgtgcattcactgacaacagaattaagctagattaaagatatagctacaaaatcaacgaatatttggaaattaaataacacacccccaccaaggaacctacagatcaaagagaaaatcacaatattctgaactgaattaaaatgaagacacagtaagtcaaagccaatgagactgagtcacatggaaggtggccaggctgggagctgaattctcagcagcccagggaggtggcaggacctagacccatggcccagcagctgctgctgctcagagaacggcccctcagcatccaggcccgtgcatcagaggccaccagcacagccaccaagaggcccctgcctgaggaatccctaaaggatgcgctttttggcttccagaaggaggtcttgagatgtaagaacacccagggcaacgctcacacacgacatgcaatcatcgatgtgagaactggctccataagagatgtgtctacgcctggagggccaggaaggttggaggtaaaatgattaaaatgtaaaggctataaagggaagtagtgaccaaaagaaacctggactgagccatattaatagttggaaaaataggctttggggcaaatgtcctttctagagatgatgagggggaatgaagaaaagacctcattcaccaggaaatcaccattttaaactggcatgttcccaggccagcttcaaagtgcataaagcaaatacagacaggcccccagcaaaagggaacaggacaggcctctctgcgcctgctggggaccatggtgacctgcaggatgacttaaagggctaagaatcagtggacacacgggcctggcgcccacgtgtgcagcggggcatctgacaaccagcactgcctccctggcacatgtgcaatgcttatgaaaactggacggccccgcatttcaaagaactaatatcattcagaccttgttcccagaccacaatgttaattaagttagaaattgaaaactaaaaaataactggggaaaaaaatcaaacattcagaaccataaaaacattctaattaactcagcagccagagaacaaataaaaatggggtctttgtgtcaaatgaggaatatggggaaaaaataataaaaatggggtctgcctggaagtggggggaggaagacaatgtcttcttgcaccagggagcccagctggacagtcacctctggaaacaggctccatgtggggctggcaagggaaggctgagtgccgatgggctgtgcacctgaccccaggcagggcagcagatgcaacccaggggacatgggatggagggagagcatggcaaggacagaaacaatgaacagaaagatagaaatgctcaaggacaaacgcatacaagactgatcaggaataaagcagggacggagctttgaatgcggcagaaatttaaacaatcatcacaagcagtccaaaaaaggtcactaggaatacaaccttcaggatttgtatgcccacagacaaattcctagaaaaattccccaaatcaggaaacctaaattagtccacaaagaaaacaacctgggcagagaaaataactgcccagtaatggtgcaggcgaagaccaacctacagtcactcacgaccccccacctccaccgcccaaatgtgtccatccatcgggagaagagggaacgctccccaccagctccctgagcctggggctcctgtcactaggcaggtggtgggagagggaggcccaggtccgtctgtggccctgggcagttctggcccagcccagcagagtgggcggagcacatgtcacacacgggagggggggtgggggtgcaggcggtgatttcaagacttttccctgagattcagggacagactgaggattttagttgttttaatgtttaagaaaactccaacaatgcaatgaacagattcaagaagaaaacctgtatgagttggagagatgcagtgagatcatttagtgacatcaggcacccattcaagacccagattctttccccaggaggggtgggaggagcctcgcctggcgaggagatgccaccaaacaacccacagctagcgcagccctcaccctggcctgggataccaccgcctgcgcccccaacactgctctaggctcctggccagtgaggtaggcgccttgccatgccctcagccacctcgccgtcctacctcaacaccagcttgtctctcaaggccaagcccctgcaagcccatcatcctgccctttcaaggcctctccagggcccggggccccctggttcacggacttaccaaggcctgcagccctgacccctctcatggcccctcccctcccaccgcgcactgtaaccagcacagtcccagcacatcccagacgctctgcctgtcctctacctctcttgcctggcagaccttggctctgggggtctcggcggtatcctgcctgtgcacacacaagcagctgaatgtgctgcagcacgacacacagccattggttggcaaccgcaagcccaggctggcctcagtgtccagagcacccggccttggcgctgcctcccctccctccacaccagcccctacctccccacttggctccctgtgacccggctgaggggctgtcaaggccagcacctgctgcgcggggccgtcaagtccagcacctgctgcgcagggccgtgaggggatgctggcatgtacctgtcatgcgtgtggggttcgccgcctgtgcttgcagacccaggagcccctccccagctctcagggaccagaacacagtggcccagggaaggaactggcggctgggaagaacaggaggctgatttgatgccatcgtcacccatttctctcctgtgacctctgccctaagtcagtggtagagagggaacaacaggccacacgccatgggcctcactggaagccactggggcctgctcagggccctcttgacaggaatttgctggcaggtccttcccagggagaaaagagctgccaaatgcctggagccacaggcgtgtggggaggtttccgtagaagtcctgaccagggatcttcacctgtggaggctgagatgcccagttcctcctgcccagctcctgcccagcagcctggctgtgcctacccaccagccaggcggccactgcctgcagggacaggagcgaccccacacccacctcagccattctcagaaagcagtgacagcatcaaggtaaagaaaaccaggttcaaggaccagcttcccgcaggaaatgaggatgatgcgggaagcctggtggggcctcctggagaaagactagggcctgctccagccctgtgttcctgaagaagaggaggactggtcctggccctgcagtgacagcagccagggccctgcactaccgtgctcctgatggcagatggaaacatgtccacgccctgcacaagcctctcctcctgatgcgatgcacggggagctgacccggggccctttggcctccctcctggctgcccagcagctctgctactgccctctaaagggaagcctctggcagacagcgcagcagccaccactgctgtgcagatgggagcgcagctgggacacctggccatgtcttgtgggagagccacggttggtccacttcccagaccagggctgcctggggtgggggagcctcattattacttaaagccctaagaatatggctggctgtaaatcagtccccacttcaaggctgtgggcactaccccaaaatgtgggagggagagggcctgcgtaccacctgtatctgatgacaacacaggctctaactgtgacagctcacgggaaagccgcctcagcaaggcaggctcagggctccagtcaccacttgaccccgaggcaccctcaggtggtatcctgatgtgggcagcctcctcgtcaccaccgcggcccctggccaagccccagcctggacctgggccttccaggaaggatctctggccaccagtggctctcgtagcgcatgacctcaggtgccaggaatgcgtggtgcggcgaagccaccatctggttccgattacccatgctctgctccaggaacctcattcgcgtctctactcccagcacccgccggggggagactgatctgggctcatcagaggcttcggcaggagggtgtgagggggacacagccgtgcccacgtggctctcagccaaggagtcacagtgcaggcggtgggtgaggacacctgtgggtgctgaggaccttcggtcaccttgcttgctcccgggtggcaagaacgctctcaggcagctcacctccgaaagcgcccccacaggctttccctgaggctggggctttacagaacctgcaatctccagggcctctaggatcaacgttaagatgtgacattgggcagagggtggcgcatcagcctctccggctccctgtcccctgttcctggagtcgcctgtcccctcccaggcctcctcctggcccatgcaacacagggctcagcaggggaaacgcctctccttcgatgtgcaccatgggccgatgccctgcccagcacgccacagccacgccaaccactccctgttcctggttctcccttctgctctcactttccaattcattaatacctggtcccccttttgctttaacttttcaattcatcaatccggtcaagttcatctctggactggaacatgccccataaattacagtcctaagttccagcagctgtttcccaaacacaccaggagagacgaggcagatctgggccaggacggcaggagggccccttcctggggtcctgggcacagaggtggaaactgcagagaagagccctccgggggctctcagggaagctgtctgggtcttcagcgctttgctgtcaggctggtgaaggacaagccagtgccaagtgaacactggaccccatgggggcagccctgcaggatccctgccaggcttgaggaggagggagggagtgcaagggagacgccccttccagacatgcagacccagcacccagagtggctctgcctcccagcgcccagagcagctcagcttctagctgctcagaacgggcatcatgatgatgacacatccaccgaccacccaggcctgctaagccttaggagacccttcctcccggggagacatgagaagctctgccgcttacatcagggccttgtgcccccatccccaggacagctgacggatgggtgagggatggacacagctctcctgcaagtctaccatgtgcctgcacaggttggtgatgcccacagggcactggggccgctcacagaaccctgcccctctgtgtatcctagtctcaccagggcatgtccttccgcagctccaccatgtgcttcaaagactctggtggtgcccactcaggggtgggcctgacggacccgaggtgaaccctccccgccccacaggggccagggctgggcaagcgtgaggcgcagcaggcttgctggggctgcgggcaagtctgccctgcctggggggcccgaggaatgccctctctgtggcctcctgtcgtacagacagcctggaccacagccctacagagaagggcagccccgggccctgtccttggtgaggctgggagctgttgctgcttctgccagtagtcacctcacgggacatgcagctccccctggaggcccttcacccactagactgggcaatctgaccactcgctggctatgggtctcaggcttccaagacttctggtgaatgggggctccttgtccaccccccagaagccaggatgtacccaggccacacccagcacctcatctcccatggtctctgcagcccctgagacttgcaccagagtgagacctggacaggagactccccttgcccccaccagcctgacctgatccctcccatcccaaacagggccacgtgtaggccaggccaccctggagccacaggcccagacagggacaccacggtgcccctcgagccatgccagctaggagagcccaggagacaccatgggaagatcttcagcaaccgccaggtggccctgaggcttcccagccttcctgctgggctttcctgctgcccgtgagcaatggcctccctcgggccagctccagaccaccacgggggctgcagctcctcgcagttttccacactggttttttttttttttttttgattaatcagttccttactgaccaaattcctctgagttttcacaaaggggtttgagtattcctggactctgcgtgcctttctctagatggacaagatgtgacggcatgaacccgaggtctgggcgaaacccaaaccatgtgaatggtctgccagcgcccacgcccccttcttcctgcgccagccatggacagcccccctgcacccgcctccaagtgattaattagccagggatctgcaacaactcctcttcatgcctaaatattgtttcagcctatcagactgttagtgcagagcaggataaatgagacccggggcctggcgcactgacctgcagggcctgctgccagtccaggctccagacagccagcgccttccccgcggagcctgagatgcccctggccttctgggagtcaaagtcaaggtccatgacgggctcctcatggcaggcgatgcggctgcacaccttctgctcagagacgtcccacaggaccaccgatccatcctcatagccggccagaaggagtgggcgggagctgcagtcggcctgcggggaacagcagagcagtcagctcctggaaggaccctgactccagtgagtttcgggggagaaggggctctggaaattcctgcccctcctgctggctggggctgtttcccatgtcttccacgtggctgccacagctcagaagctctgcaccgccagtgccctcccacacagcccctggatggctgatgctgtcagcatgggactggcacggctgcccttagggcaccccaaggacataggggtggagggcagagagccaagcccaaggcctcccactgctgtaccacttctcaccagccctgcaacctgcatgtgcccaccctgggttctgcccaaaggggtgatgctgggcacccaccagccactgtgagtgctgccgaccctctccacttctcccatgcacagggacctgtcctcctgcctcctttccccaggcctaagatgtgtggccaccacttactggggctggtcacctgtctagagccgccagccagaagaaaccgtgagctccatctccatgaaaaatgaactctctgtgctttgtcaaagtggctgccgaagcccctgcccctgaagcctggcgtgagccgcccgagctcttgtgatgaatgagggcgcgggtcagagggctccaagccctgggcagacacctcgtttgttaagcctctggaataattgcaggaggagagcactgcaggattccgcatcaccctggggacacagccgtcagtccccggcaccaagaatgacagcccagagaaacctggcatggctgagcaaggagacctgagggagccagaaggcaccagggcgtgtgcctaacaaagggatgctgagtcctcagacaccacaaggaccagggctcgctgcatcagaaggctggtgatgggaaccggggtagccaggcccggagcccgaggccaactgccctgacctggaggggatggccatgccagggacagaaggacactcactgtgccctgcaggatgtgggcatgtgaacccgaggccagagctggtccagtggtcctcatacatgtccctgaaaaagacttgtaaaaccactgggttctaataacagagttcacacagacaaaactgagaagagtgaggctccaggaggaggcgagtggcggtcagtgtgtcttctcccggggcacctcctcccaggcctcatcccaagtcatgccccgctgccagagtccacattgtccctgggaggcagggctgccccagggccccgagtgtactcagccccctgcccctccctgcagaagtcctggccacgctcctgcgtgtgctgttttatccctgggaggagttccatgttggcacctttcagatcacctgctgggaaatgaggcgtgcagggacccacagtactttccttcccaacatgggcaccatgccttctgcacagaagctccttgcaggcagccctggctccctagaagggcctccccctggtaagtggtgcgtctgaactcacagtgggtgagggccaggcgagagcagcggggaacactctgcatcccaaccaggaatgcaggccaaccccagaagctgactccaaagactctcctcattggacccactcccctcaggcagcgctctgtggtggcacctgttcccagcctgtgccaccctcctccccggcactttcctccactgcaggagctgagactgcctggggctgctcccatcaccgatgtccttctggcagtctcagagcctagagcctgtgtgaagccactgcctctgaattcagatgccatggccaacgcagggactgtgtgtgtgactgacccgcctgtcgtggtgccacagggtggctggagcagaagccaacctggcctggaggggcttgccctgtggttgccagcccctgctatgcccctggtccctgcagccccctagtgacagataccacaggccgggcagtcctcttgtggctggagcacttcggtgcccacagccttgatgctgcctgacctctgcaggggagaggatctgaagtctcctggacctgttcttctctgccccctccctgcccgcagatgagacctggaggccaggcctcattctgcacccctcccattgactggcacccccagagggacacagcaggtcaggggctgtgggaagccctccatgcaccataccccaagaagcagggcagggctggctggagtggcccctgccctgagggctatgccagtgactgcctcaggcttgacgtaggtcctgaccttttatatattaatagcaattattcttatgttgcaggtcagctgcttagaggagcaaaataagaatatactaaaaattaaaaattaaaaaattttttaaataaataaaaatgtgattgccccccaaaaaaagaaaaccctcaatgtttcagaaaaaaaaaaagcaagtcaggccactgtgccacaattggattgataaattataacctgaccctcaggcttggggatggaaaagggaacatgtggagttaatgtcggcttttcttagcggaatgcttcacgctggatctccatcaccaacagaaacacgatttgtcctctgtcaactacattaattaccttaacaagtttgtacatccctttctacgcatttttctgttggaattttacatgattgtgcaatgacccacgtttcccaaggggtggaacaggagccgtgcagactcggacacccttccccaggacctggatgccctgcccactgcctgcggggttgcagccttggggggcgtttttcctcccagcggagcccatgtcaagcccttggaggagccttgtgtgggcacatggagcccagtgacccaggctctgctgcagtccctgtggcccggctgtgagcctgctggcaccgagtttcatcatctcaggtgagcctcccggaagccaccctgcctcctgtgagggcttctccccaaatggccacagccacagaagcagcactacaggatcagtccacgggagaccccaaattccaagtgaaccttctcagtcaagaaaccacagggggaagctgactgcagtaaggggcgcccactttctggtcacgtggagagagagaaaagctgggggcagggactctgggggtacccatcccggtgggccttgcagggcatgcagatgcccacaaactgcacaggcccatccggtctcgctctcatgaggaggtcaaagaggcagcgagccagagtcacctcccggtaaaggcccagcccagggcagttctcagagccaaacagaaaaggagggtgcctgggccgggcgcggtggctcacgcctgtaatcccagcactttgggaggccgaagcgggcggatcacgaggtcaggagatggagaccatcctggctgagatggtgaaaccccggctctactaaaaatacaaaaaattagccgggcgtggtggcgggcgcctgtagtcccagctactcaggaggctgaggcaggagaatggcgtgaacccaggaagcggagcttgcagtgagcagagatcgcgccactgcactccagcctgggtgacagagcgagactccatcacaaaaaaaaaataaataaataaaatagaaaaggagggtgcctggcatgacttagggcctgggaagagtgctgctggtgaccccttaccgtgggcttccgaggcagctcagggctgaggggctctttgcaagtgaatgcacgggatcacttgctctgcagccctggacatgagcggccccgaggagggcagctacaccttgagccagtgctggcctgaagggtgatgagggaggagactggcctcgaggaagctgtgctgcatggaggcagctggcccagaagagtccctcccagcaaccccgacctgtgccccggctgatgccttccaaccctgtctaaccacaaagaacagttgagaaggaaggaaatgttcatggatcagaaattccaaatgtggcctcagggaatgtcattgtgttaagtccactcctgcctctaagaggcaaagaagtaataaaaatcaatcctaagcaaagcgggggccgtgcaggcttgctgcagttagtcagcgtggcctgccctgccctaagcacggcccaagtactgaggcgctggcagaccccactgtcccctcctcaccgctcactggagggcaccacgagctgcggggtgagcccaccggagcttgcaaaggacgaggacctgctgccactgctgctggctgaagccaggcctctcctggggcactgacaggaggccccttgcagcagcaggaagcagagggccgtggggacactgaggcagctgcacaggttccctgcggcaggggggtggggtgttgcctgagtggctcgacgataaatcagatcctgaatggagcatgactcatggccgtgggtgtggccggcagggcgtggctggtgcacgcggggccttacctgccacagccgcaggcacatgggcatgcccagcttggcatctgccttcggcttcagggcgcacactgacgtcttggagggcatctccagaatctgaacctgacagtaagaaaacaagttgatttgggccgtcgccaagtcgagtctgcgctatacaaacaagagactcttaaggcgattagcccgggctgctgtgagtttctgtctgctcccctccccgtgggcacctgggagcccaggctcctaattaggctgcatgggcccttgcaaaacgctctcactgttcccaggtcaccgcctggcagctgccccagcctctcccgacgttaccgtgcaggctgagcaggaggctggttcactggcccctgacagagcccaccgattctctctccttcctggtgtaggctttacatacgaaccagtgtgagtgatctcaggcatagccatggttctaagactcgcccaggagcacctagggatttgccacccacttgagaaatgaatgtgatgtgcgtcctctgagggcagctccgggaaacctggctcccccacctggacgccccggtgtcccctgtgcatcgaggctgcattccaggtcccctgaacacaggccagggcccccctacacctgggctgggagatgtgccatgccggcttgtggggtgtaggctcgctggtcacacatctcctgaacagccaggtcaggggatggccgaggccacaagcagcagactgccaggtggttctgctggaatccaggtccgcctgcaccctctgccctcgctctgggaactggggaggctcagccagcactgaacttccccaggtacaagcgagagcagctcactggcccctgacagagcccactgattctatctcctctgtctgcttctccttcctggtgcatgttttacataggaaccacttggaatgagctaccgataacacagcaataatatcaatgcacagccaccttggacagagcctggcatacatggggcatcacccactttacacacaaggagtccaagcccctgaggctgggggctctgagtaggcagaactcataccagttggtccagcggtctctggcccctctattctcctgagccaggcagagggatcgtgtcttaggggcctgtgcctctgtgggtgagaagcttgctgccctcactaacccacacagaataggcccgggaccccaagtctgaatcccagatctgccacaggcatgctatgggtgtgctgaggtcacctccgggcagggcagagagctgggcccacagcccggtccttccagctacagagacctgctgaggcgcccacctccagtacgcggaccagggccacggcgcttcttgtgcaggctgctcttgccaggggcccccacagcagctcagcctctgccagcagggcttctgctccactcagcaccaggagcttagcctctgacagcagggcttctgctccactcagcaccaggagctcagcctccaacacagggcttcagccccactcagccccagggatggctcacagatctaggccccacacaaacgcatgcacacacacatgcatgggtaacatgtacacacctgcacacacaaatagagcctcctgcccatcaagcccagaaaccaggggcctcagggggagccaaccatctgacgaaaggggcccccggggaacaaacagagcaacataatgaagagggcaaaaaagaactcagtaatgggagaggtgattacagtcaggaaccaagaggctcagtgatggtgagaccaggcctgcgagctctggggaaggttgtcaagcctgaactccaaagccggccaaaatggtaagcaggagggtaaaacagaggtctctgtggacaccaaggattccttgcggaaaaaccgctcaaggagaagctctagccacatggaaatataggaacattgatgtccaaaaaccaagacgaggtgccactgagcctggcacagaagaacgtggagaacccaggagaagctggggcgggcttagccgttctttgtcttctgcaagtaacagcaactccgggacagggttcctcctcttaggatcagcatggccactgagtgaagagctagaggcaccagggcggcctgcaaggaccagagttatagcccatgtgccacctctgtgatcccagctaagggagcagtggcaagctgtcattgggtgttgccaccattgtccctttgctgttttcaggaagggtctgtgagagccaccgtcagggctgtggggagggtctgggagggtgtagaccacactgcctggctcactccccacatttccaaatgatacgggagaggggcagggaagtgctaggaagggaagtcacctggcaagggctccacccccgggcctgtccctatagacctaggtgaggacaggcactcctgccttcgcacccaaatgctgcatttcccaagaccaccctggctcaccacacccccattctgtgcctttaaaaacccccaagaccatagcaagcagagacacaagtggctggacgttgagaggacgttgaggggagcacggtggtggaagagcacaccgacagaggctggcatgctggcaggccatcaaccagcgagcggaatgaggtggaatctggccgggcagttggaggagagcccaggccacccagcagcccaactccaggggaaaaccatctcccttctggctccctcatctgctgagagctacttccactcaataaaaccttgcactcattctccaagcccatgtgtgatccaattcttccagtacaccaaggcaagaaccccaggatactgaaagccttctgtccttgcaataaggcaagggtctaattgagctgactaatacaagccacctatggacagctaaactaaaagagcaccctgtaacacacactcactggggcttcagctgtaaacattcacccctagacactgctgtggggtcaaagcctcacagcctgcctgtctgtatgctcccctagaagtttgagcagtgggacaccgaggaagcgaaacacacctccattgcacgccccgggaggggataagggaacttttcccatttcacaacctgttttccccatattaaattgagaagttttgttttgttttaaagtcagagtctcactctgtcacccaggctggtgccatcacagctcactgcagccttgaactcctgagctcaagtaaccctcccacctcagcctccccagtagctgggactacaggtgtgcggccaccaggcccagctaactttttgcagagatggagtctcactgtgttgcccaggctggtctcgaactcctgggttcctcctgctttggcctcctgagtagctgggactatgatttcctactttttgcactcctctgtgccagatttcttaaaataagatctgttcttcttgtcgctatatcaggaagatgggctagttccagcagttaatggggtggggaggtaggggacttaagccaggggcaggaggagccgccctgagcacacctgtgcctctgtggggtggggagggctgcggaggaggcaggcactggctacacagcctacacggccatacacagtccccaaccaaggaaggcctgtctcaatttgggctccaaaagacccctctggggacagtgaggggacatcaagggcaaaggacttgagcaggccagtgagggcaggggcaaaagatggggggaggaggggtgcggtgagggcagaacccagggcagccctgatgccccactctgggcgctgcaggagggagcgggggtggcggcgccttgaaccacatcctgggtgcaggggagtggtgagccctgggcctgagcaccagaggtacacaccacgtctacctgggctgggtcctcagcccggggctgcccctgcctgcgcctgtacttggagcctcctacagacacccatgagctttccgcctggcacctgactgcaacttttgtttccagaaggaaaaatgttaggtttgggcaagtgtggccacccagccggccgagtggggtgggagtgcggctccctgggcgttgtctgggtgcaggccagtgaggctttctcccgcccagtctgacagattccaggtgggaatgtggaaagcaactgttttcccaggatgtgagaggtccccagacaggctgccccgggaaaagacagatgctgccccacagggagagctgaaagctaggaggagggttagacagccttgagcacaggggacgtgtggcagggggcagcgcaggctgaccgagtgctggctggcggcctgggggtggccgagaccagcgcatggagcacagcaggccaagggaagagctgactcaaactcctgcagcattcctgtgggtctgtagaccttgggtcccgggggaggaagcacgcccctctttctcacataaatacaacttgtaacaggtttttggcagattggcaagaaaagtgtatgtagctcctaattggttatttaaatgcaatgaacaaataaatgcctgttcctatctcattatttctgtactggatctgcctgaagacagaacgactctccttgggcaggggccaagcccaactgtgcgtgggggccgtcctgcccagtaccagccccaaagactgcccgggcacagcgaatggggaggactcggcagtgggcatggacagtagcccccacgtgtgcgccccctattccatggtatgtcctccccatgccccgccctcgggccaccatgccccactcaccaggtgggacagtcgccactcaaaggctcttctctgatttcccttcagctcccccaagagctgagcctccagccacaccctcctccactatgacaccctccccgcacatcttgggcacccctcccttggcagaccctgcctcctgtgccactgggggtgtggataccactgtccagctgggccagtcctgtgttaccaacacctctggtcattctggcctaagctccacctaacagtggcctccctgcttggtgatccccccaccccctgggtgttccctagctcacctttcccctgaggactgtgatcaccaccttgtgcctgcacccacccatcccagccctggttgtgtgccctgagataccaccctccctgctgccctgggtcagccctccccaggcctccaacttcaccagggacttggtctctctcccaccgcctcctgccagctgccccggagcgttcctcccacttgggtctaaggtcctcagggcctgagcagtctctcccctgccgttcctgccggcctcgggcctccatgcttggccatcccacgccactgtcctccatgtgcagaactatgctgggtgcccaggcctccaaaacaccggcccctcccccaacgcctcctgattctcccactgccctgggaggatggctcatcagcaaggccaccccaaggggacaggcccaggcctagccggctgtgcatcagccccggctgctgaagctgccggcaggtgggcggctccatggagtcctgtgggtaggcgcaggcgcctcctaatcaaatgcagaggatgagcacaactgtttggagaacatggggcctcaggcaggctggctctcacctcgtcgctgcccctccctggcacggcaagcgtccagcgtggctggcccccggccaggatgctgctccggcagaagcccacactctccaagcacacggagtccacgacagcgctcctgccctccgcgaggtcccacaggcacagcttcaggtcccggccctgactgccagacaaagaggagacaggcctgagactccccttgacaagtgtcagctcccatggcccctgcagcggaaggaaggcaaggccatgtttccagagagtgggtgccgtgagcttggatcatcgcaggtcgggagcctcagctgaggaagggcctcaccgctctggcattgacacttgagccagcaccaaagtgcccgaggccaggacatgcagtggatcaaggctgtggactgatggctgtccagcgtggccccggggtgggggacaccaaccctgcagtgctgcacagcacagagagcaaacttcactgtgtgcaccctaaaaccagcaaactcccagggtgccaggatcccaggaaggactgcagactgtgacaagggggagaacagaggggagccaacctgaggcattttggggtagtgctcatgactagatgcttatgaggttaaagacaaaaataactgtgcagaaactgttccagtgggtgaattagtttctcagaggggtgcaggttacagttctgaatcctctccacgcgtacacctggtagaacagatgaggaaaccagtggtggctcatgggcccggggtctcaccacagggagatgtgacgaagaggcacaggggagacatgggctggcggagtcgaattagaattgtaaagtcaatatgaacaacgagtgtttgggcagatgcacagacagaaatgagtacagacgggtgtgtaagcacaggtcagcgggcacccaggcgtctcccggtgctgtccactgagaacacctagaagcaatgaccacacctaacccaagtcttggtttcttatgctgttctccaaaaacaggaaccagggctctggagaaatggctgagtctagggtggagtggaggaaaaccaagaggagtctcaagcatcctgtagtgccaggcagtgagaaatgcttcaaaaataaaataaggctgggtgcagtggctcaacgcctgtactcagcactgtgggaggccgaggcaggtggataacctgagaggtcaggagttcaagaccagcctggccaacatggtgaaaccccgtctctactaaaaacacaaaaaaatcagctgggtgtggtggcacgtgcctgtaatcccagctacttgggaggctgaggcatgagaattgtttgaacccgggaggcagaggttgtggtgagccaagattgcaccactgcactccagcctgggtgacaaagcaagactctgtctcaataaataaataaaaataaaataaagactgggtgcggtggctcacacctataatcccagcactttgggaggccaaggcaggaggattgcttgagcccaggaattccagatcagcctgggcaaaatagtgagacccctgtttctacaaaagacacaaaaattggccaggcatggtggtgcgtgcctgtagtcccggctactcaggaggcttaggtgggaggattgcttgagcctgggaggtggaagctgcagtgagccatgatcgagtgactgtgctccaggagaccctgtctcaaaaaataaaataaaaataaaaaaggatcggggatgtcagaaggacacggactctgaagctggaacaatctgagaaatcaaataaatcatggtggtattagattttagcccaaagaaagaagtaaatctgcatgagcccatcctcatgagtgaatgtgtattatgtatcagaaagaaggaataaaccttccttccagcttcctatattccaattaaagtagaaatctgccatggctgggagggatgagggaaacgagaataccccagtaataacaggtgcaggcagagtccacagatggatgctaaaatcagcggcaaaagggtaagggtctcaacatgttgcccaggctggtctcaaactcctcggcttaaacgatcctcccgtctcggcctcctgagtagctgtgactacactccccagatgttagtaattactgcagtggttttaacacagggccacacatccttggctctcctctccccaggaggtgaagcttccttttctctttgcatgtggactgcagctagtaagcaaaagctataccttgacagtggagtcaggcagacacttcctgccccagtgaccagggttgtccccggcaagccatgggccatcagggacccatgtgttcagcatggactccgggatgacaggatgagaaacctcacttctgtgggtttcttcccaaaacccatcaccccagtcttaacctgagaaaatatcagacaaacccaacctgaggggcgttctacaaaacatctgggcggtaactcttcaaaagtgtcagctaggtgcagtggatcatacctagaaggtggaggtgggaggactgctcgagcccaggagttcaagaccagtctgggtaacatagtgagactccatctctacaaaaaatgttttttaaattagtcaagcttggtggcgtgcacctgcagttccagctactcagggggctgaggtaggagaattgcttgagcctgggagattgaggctgctgtgagctgtgatcacaccactgcactccagccttggtgacaaagcaagaccctgcctcaaaaaaaaaaaaaagaccaaaatgttgaggtcacgaaaataagtgatcacacaccaaaagggactaaggagacgtgacagctcagaggatcccggagcagaaatgtcactggtggacaaacagaagaaattgaaacaaagtctgggtgccagttattatcatgcaccatgctctgccaggagggccgtgcggtgtgcggtgtgcagttgcggttgtggtgcccacgccacagagaattcagcaccacaaaggccgatctgggcaactcggtcccgtccaaatctccactggggttttggagaacctgccaaactgatgtcaaaatgtacctggacatttggagcacaaagacgtgcacagcccccgtggctctgctaggcggcaaggctcaacatgacactgcagggaggccgagatgggggtgtcctcagcatggggaggggccagggccaagggaggggaggtgtggctgcacaccacgctcatatggagggcacccatgtaagccctgcggggagtggaggactgacttgtttttccaggaactttaacattttttttctttgagacaatatcttgatttgttgcccagggtggagtgcagtggggtgatcacagctcactgcagcctcaaactcctccctcagatgatcctcccacttcagcctcccaagtagctgggactaccagcatgtgccaccacacccagctaatttttgtattttttgtagagacgagatttcaccatgtttcccaggttggtctcgaactctgggcccaagcacacctcagcctccctaagtgctgggattacaggagtgagccactgtgcccagcttaactttttattttgaatcagttttgaactcacaggacagttgtgagaacggcacgaagaccccgtatgcctcctgctgcagtggcctgcttctcccggcccctcctagccctgtgcacacaggtgagcctctcaccaagaactccaccttgtcaacaccgcatcctgaccaagggtgagccccgacagcccacagccatcctggggcgtcgtggcctgtgtggggcctcgcggggccccggctgcctctgccccctgcatggccccttctctctccctgtctctgcctctctctcatgtctttgcactccttccttccctggggacgaggcccaggcccatattcctcagatgacaccagtcgtcacgctgcgaggcacacgatgtgacctgcccaccatcaggggtgtcaaccctgatcgcctggtcaggacccatagttttcaaaggctcatcatccctaattctgatcatttattttagtgctcaaattggcccaggctaatgggagtccctgcaggctggctcagaatcctctgacgtggccatctgcgagatgtccagacctagaatctgccatctcccggggaaccctcactcagcttaggacacacaggcatttagaagccaggacctgggtgtccacctgctcactgccagagtgtgccccagccaccaggcccctccgcacacgggctagggaacacacacatgcctcacatgcatgcacacaacacacaatcacacacaccacacacctcatacacacctcacatacatacacaccacacaggcacctcacacatacacaacttacatacacaaacctcacacacacaacacacaggttctttctcaccttcccccttctcgtgtctgtaactctcctctctgggcagggacaaccctggcctctgttatcctggagatgttcactgacatgcccaacaagcgagcctgccacctgccctcaccaacctcctggcctcccaggctgccgctgccacaccacccccccaaccctgcttctttgactgcctggcacccccttcccaccccatccaaggggcactgaggtgggggaaggcgggaccgctgggtacccacatggaaacccagggccttcactgcacaccgtagtgaattccagctgaaccatggatctacaagggacaacagtaaagttcctgggagacatggagagaggtctctcggacctcggtgcaggaactcccggcaagacacaaaggcactctccataaggggaaagcctggcagacttgaatcaactccattaaaatgagtaactttgttcattaaagacaccattaggggccaggcacagtggctcatgcctgtaatcccagcactttgggacgccaaggtgggcagattatgaagtcaggagatcatcctggccaacatggtgaaaccccatctctagtaaaaatacaaaaattggctggacgtaacggcacatgcctcttatcccagctactcgggaggctgaggcaggagaatcacttgaaccagggagtcggaggttgcagtgagccaagatcatgccactgcactccagcctggcaacagagcaagactttgtctcaaaaaaagaaaaaaaaacgtaagaaaaagaaaacagcgacagctgactgcagctacatgcaacacacggagctcacggagataaagttgagtgagagaagtcacacacagatgctgctccttatgtctccacgcttccaaagaaaaaagcagacaaaatagtctatgcttttcagagacatacattcataaatatagcaaaaatgaggcgtgaggggctacctcctggggcatgaggggctatctccagggagagcaggtggcagcagctcagggattcagaggctcgggggccctgcgctctacttcttgactggaaggtggttgctcaggtgctcactcagccgtaatacaatgctctgaacacttgtcttgcactcttctgtgagtacattatacttcacaagaaaaaagattaaaaaacaccctgccgaggtggctgtcgaaggcacaggtgtgtccttggcatgcgggaggctgagggcgtcctcccacctcccatcaacatgaaagccatcacttccttcaagggccacttggagagacttggcttccaaacacagctgagcacaggccgggtggcggcccacaggctctagtacagtgcagacgcacctggcactccacacctgcagtttctgtccacagaccccctgacccgtggctggctctgcctgggaagcagccactacagcaccatcccagcaggaaggggaggtgccctcgaacgtcagctcccagaccgcccaccaggcctggcacagctcctgtctgcaggacagcctgataccacaaggcacctacgcaagggaccaccaagggctacattgtggctgaaaactcaggaggacacttacaaacagcagctcctgatgcacatggcctggtggggttctagaaatgaagtctactctgacaatcaaagaccaaacccactctgaggccccctgcaccagtggtgagggatctgggtcggcttggccaggatgcaggcatgaccacacggggctctgcaagcacacaggctcagggcctctgctcttcaggacaaccctggtgccttcgtcacctgcagccatctcccaggtggtaggcaccgcgtgagtctagcacagacatgttttgcagactggtgggggccagacaggcctcattctccagggactatactccacagtgccatgaaccaggcaccgagtccagagcaggagaacaggcctgtccttctggagttctgggctgtgatggtgatggcacggagttccctgaatatgacgcaaggcaaatcccaggacagcagcaggcccgtgctcaggattcctgggctggtggcagcgatccccacacaggggcagatgtcactctgatcaaggacaatagcctgctccagcatccaggcagcccaaaggaggacttgttgtcagccccctgcaggccttccctgtcccaccatgccctgtccctcccactccccatgggaaacagagaagcccctcacgcacctgcccctgtctgctgcttcctggcctacctccggcctggtgtctcagccccatcacctccacaagaccacgggggcgatgtcagaacccagccctgggctaaccctcgggggctgcccctccctgctctgctgccagctgcccagcacccagccccactgtccttcaccacactcagaggcaggccctccagggccgcagcacgtggggtctcccccaccaggactgccaggccctcttattcctccgccacctcctgcttacccagcagctgcaccagcgtgtgaagcagggccctgtgagctgggtaacctcaggatgaggctctgccacccatgcaggaggatggtgcgacagccacaggaggccaagttgtagaggggctgtggtgactgggacctgggcccatgggatagaggcagaagctcatctgaggaggggcctgggctcaatgcggacccctggccagggcgagctctgctgaaggcacaggctgacactgcaatggggacacagccatcgccatacgttcactaggctcttcccagcaggcacctggccagacagcacagcagtcacggagggtagggtcacactgtctcgggatgggctaaggcctcatgaaccatgggggcacccagaaacctgcccttgtgctaagcacaggctagaacagtggggtctgaataccaatggggacaggccacctctgtggacccttcctgctggggtacagtctggacaagtaatccccaagtgatgcgtagggtacagaacacacacgtgagctcggggccctgagggaggagactgcaggggtagaaaccacaggagacactgcaggggggaccaggtggggagatggccctcactaccacgcccacttcagaaacgcagaagcacactgctgtgggacagcactatacacccaagccctgcgccccgcccctggccactcagccaccatcttgccagccacatagccgtatgtggcacaacatcaggggctgggtcctcttgggaagagtcaggtgcattgtcataacctagtgaagggacacacacggccagggctcagctgccggaacacccagctcctagggcctccaccggcaccgtgtgtgacctgccatgctcatggcacacggcccaggcaggatgggcagtgggcagggaggccctccttgggaccactgcctgcatccctgagcctgtacttcatcccattcccctcctctcagcaaatgccctcacccctgcccagtttcccaagccacgacccagtgcccttgtgaaggccctcccaccaacttgcgcctgggctcacctcagatgtcaccagccctggagctctggcctcctcacctggcacctcctggctccagcttggagcatgaagggtccagtggagatggtggagatgcagaggcagacctgcctgcctccctgtgacaaggggctggacctgcacaccctgcccttgctgcggaccctttgctggccccttctggttcccccaccccattctgcccctcagtgggggacaccagagcctccatcagagagttcctgactcccccgaaggccatacctggctcctgcaccttggagacccacctgaggagctggcgcccctggggcagcgtctgcagccaggtcacacactggccgccgtggccatccagggtggtaaccgctctccgcgtctgcaggctccagatgtgtaccaggccactctgagacctgtttcagacaagccgagcagggtgtcagggggcagaagggtgtgctgaatgctctggggccagcctggaggccacattgtgggatgcgggcatctaggctggttgagctgaaaagccaacagctctaaatatgaactaagggccaaactggcaaagcactccttgctcctcttccagagaggggaccgggggaccctcaggagcctctaggggtaactcaggcagatctgcttctctggaggtagggggagccatgccacagtaatgcacgctgggtggtcgtgcctgctcctgcgtctgtaacaaagagtgtgtgtgtgtgtccctgcctcccccaagggacagtgtgtctgctggtgggtgctgaaagctcagcaagcctgggtggcgagcagtccatgccccttggccagcaccctcaaacaagcgctgggctccttgctagctcacgacctcctgacttggccctgggtggcctggggctggggccacagctactcaccctgagaagaggagcgggcgcccctgagcctgggctccttcgcagaagtgcagcgcatgcaccggtgactgggtgcctcggaggacaaactgggggtctggaggtggcggcgggcagggggccgtcatgctgggcaggatgcagttacctgggcaccaagggagggcgtgtgagtgactgcgtccctattctcaccctctaggaaggctgctcaggcacaggggtgcttgagatgttgcccctgctcattgtctctggccctgtgcccctcctgggagagaggtgccactgctccccagacactgatgaacggcctgtggctacagaggcaccagttccctgcacggcggtgagcccagcagagagcacagagctcacccttcccccactgctgggggaactgggagccccatggatgccagccctcctcgcaccgtgcctgttggcctctgcacctgactggtgcacccgcttgggccccacctgagccatccctgagtgggcacagcggcatccaacacttcctcggccactctggcctccagggcttcctgtccaccactggctgtgccctctggctccccagatcccaggggccacaccagtgctttcccactctggccatctgcatgccgggactgccggtcctgccactgggcttggctgagtcccgccctctgtccagggctcactccagtgtctctcttgggagccaccctccctccctgctggcaaatccagtctcccttcttctctcctccctgctgccacctctgcccatggccagctcagggatcaggggaaaagaggcacacagggtcccggggggctgctaggaggagccttcctctcacatctgctgggccccaggcctgccccgccacaatttctaaccgctatcaccaccctataaggcggcagcacccttttcactcttggggaaaccgaggcagagaatagtcactgagctgcaccaggcccctggcgctgaggcctgaagtactctagggcctcatggcaccactgaagggcagagtggctggggcagagtcgccgtgcggctccttaggagagctgcggtcacagatgagcagctgttccccagaccactgggcctgtgggggaagactgccgggccaccacccacccagagaggcttcccgggtccgtgccgagcccttccaaccactcagacccacagggcctcgcactccacctcagccccacagctggctgctctgtggggtggccctggagccagaagcgaccagctccatgtctgtctgcctgcagaccctgagctgggctaagggctcagagggaaaggccaggagcagaccactgggtggctggggcagcctgtcacagggggcctttcccactgggctctgggacagtggggcaggccccggcccagccacctgcagcctgcacacaaggcagggaggatggcccacggcagccacagccagcagagggactggggccagtaaaggaccagggcaggggagatgggaaggactcttcagaaggggctgggtggtaggcggatgggggtgcaggttcagaggcaggagtgctgtggatgtctggaggcagctgtccagggtgccccttcagcagcactgccaccgccaagccctgcctctccccttctgaatacacgccagccctctccttactctattcagagctggggcaaaggttcaaaacacctgagaaatgcccctgccaaggtgtcctgcagagtggagggtggacagcagccagtgcccaagcgggcggcatgggggagggcaggaggcctgggaggggccgggcagtgactccagggcgcaggtccaccctgcctggcgagagacctcgggcagccactctacctcccaaccctgcctctctcaaggggttccgaagacaatgcggagttccctgggatatcctttactaactgccaagtcccatttttccttttcttttttgagggggatgagagaggtttcgtcctctctcacctttggctgaaagccaactgatcatgcccaaacttaagggtggcttccaggggaggcagagggaccagaccccacactgctcccaagacccacggcccctgctccagcctgtgatggggaagactccaagactcctgaagacgcagccaggccgggggctggaacagctgccctcagcgggctggcttggaggacagttctcagaagccactgcctgtttgtgctatgcctgccaggtaagaaaggcaagctagccagggggacaggaaggcagggcccagctccaagaggagccaaagaatgcagacccggcaaaagcacctccacctagcaggaaagcaccgagtccaggatggagggtccctcccatgactccagtccaggaagcagagcctgacaggtcacctctacacaggctcccctgtgcagtccaggcacgaacacacattagacacacgctatgctcacacatacacacacatgcacatggtgcacacagacacatgcaaaacccacacataggacacatgcctacacatacatgttcacacacccatatgtgcacacacacacatgcacacacacaggcacacactcatacctacatacacatacacacacgcagactcagacactcaggcacaggcactcacgtatgtgcacacacagcacagagaagcacacacacagacagcacggcggccttgggcggtgccagccgaagcccggcccccacatgccacctgcctggggcctggcgggagtttccagaacctcaccagcagaaggctcattctcaggtgatgaaatcaagttctcctctattgtttccccagaactgcagggaacaaacccgtcacgttgttacaacaaccaaaatgcacaggccaaaatgatgcatcggcaattaagggctccatcatttcaagtaattaaaataaatgctttatttgaaaactaattaattctagctacatatttttcccatgacaatatcctaggattgcttgatttatgacatctaattattctttattaatctaattgagaatcatcacattcccctatcttgcctggccccaggctgtggagcaaaggccgcccttgcgcaaggcccgtgtgcgcccagctgtccttgcggtggccccggcccagccccggccctgtcctcccggaggcaaaggaacaggaaacttaatccacagagcacaactttggcttctgcctgctcttccaggtgtcaaagtgagccacattctttgaaaaatgaaaggcagtctgacacaatttgtgcaactctaacagcccttccagagaagccacaaacacccctgaaagccccagggaacaaatggacgacaacagcatctgcctgcaatgcaccaccgcggaggcagctcggcaggccccagggctctcccaagaggggtccagagcgctcctctgggtgtggggaccagcgggtaggtgcaactggcagagaggtccacagacaccccactcaagggaggcaggggcaggcctgcaaatgtcctgctggcgcaaacccacccacacctgcagggccttcctccctacagatgaagcagggctgcggcagtggctggagcccaaacaccacaggtccctacccaagacattcttgggctcctgggggttcatgccagacaggcctcagctcagcctgggcccccgccctgccctcgggctgcacagccctgtgctcagtcccctagcccttttgtggaaatcagcaaagagtaccacgaagtgagccaacgtggggagccaccacccagagaggccactggcaccacccctgcccaccccagcccaccaggtcctccctgtcccattgggcatgtgacagcacaaggacaggccgcacaggccgctgggagtgcctcaaacaggaccctctgccccactgcatatctcacacaagggcatggaactagctccagcatcccccgaggaagctccagcccataatcagcaagactgaagactaggtcagcacccctttacaccaggacggacaccctgggtggccctctcccaaaaaacaactaaagatgttgataaaagtttcttagaaggccaggcatggtggctcatgcctataatctcagcactttgggaggccgaggtgggaggattgcttgagcccaggagttcaagaccagcctgggcaacatagggagaccttgcctttacaaaaaataaaaataaattagccaggtgtggtggtgtatgcctgtggtcccagctactcaggaggctgaggtgggaggatagcttgagcccaggaggtcaaggctgcagtgagccatgatcgcgccactgcactccagcctgggggacagagcaagaccgcatctcaaataaattaaataaaataaataactatctttaaaaaatttttttaaacacagccaggcacagtggctcaggcctgtaatccctgcactttgggaggccaaggcaggaggattgctggagtccagaagttcaagaccagccagggcaacatagtcagacccccatctctacaaaaaaaataaataaattagctgggcatggtggtgggtgcctgtaagtccagctactcaggaggctgaggtgggagaatcatttgagcccaagagttccaggctacagtgagccacaatcacaccacggcactccagcctggacagcagaacaagaccctgtctctgaaaaaaatcaaaatcaaaatcaaaatattaaacgcatcactaagttgacaaaaaaaagtctgagctgccagaggccaaacactaagtaaaagtgcagcctcgggagacctgccaagcctgccttgagggcatttgctgcactagtgacctggatttccagctctgatggcctctggggtgacaaaaggcaaagcttagggccatcctatggtggctaacctcctaggagaaccccagtagctagatgctcagtgttaggctgagccagcactaaacctacacccacggatgccagaaaaacaccagtcctcaggtttcagccctaactcacaccaccttgagagatcccccacacttcagtctgtcttctcagaaggaacccacctgcaacccaggcctcaaggaattcactttagaataagtcctaagaagtgcaaggttgtagtcaaaaatcacaaaagtcaacaaggcactgtaatcgagagtcatgagaggcaacaaaaaacagaactagacccacagagcagagcactcgggtatataaggcaagggtgcttaacgctcttaaagaaacagagagggaactgcaactacaagtagagagcaagggagatgaaacatcatcacacagatccaaaaaaggatccaacttggtgagaggtggttgggaaacaggagatgtgtgttgcgccaaggtattactctccaaactgtttactgatcacaaaaggaaaatgtgtatcttcaatggagacatctggctgtcaccactttcaccactgagaaaagctagcactgccaataatgaacaaactggcattgcttatctcctgatgtgatgccacagacatggcaccaaccttgtgtgtccctgccaacaatgctcaacctcaatccagccataaaggaaacaatcagacacatccaggttacgagacactgggcaagactactagcttggactcatcaaaaaggtcagcatcaagagaaacaaccaaaggaaaacgctgggtaacttccacattaagagaccaaaggggcatgatgaccaaacatgacatataaaccttagatcctggctcttagatcagatcctggatcaaaaaaaagggggctataagggacatctgggggatctttgtgggtaatctgaatatggactacagataatggggtgttattaatttccttggaaggataacagtattttatgtagaagaatgtctttattcctacgagatacatccgaaagtatttaggggtgaaatgctataatgtctacaatctgctttcaaatgtttcaaaaaaaattctctcttaatctctacctatctatgtatgaatatataggcagagaagtagtacaaatgtggcaaaatgctaacaactggtgaccacaggtgaaggtgtacaggtatttattttactacacttgcagcttttctgtagatttaaaaccataaaagcatgccagaggggtggagaaagacaagtccacactggactcgtatccagaatatctaaagaacacagaggtcaacagaatacaaaagcaaacaccgaaagaaaaataagcaaaaggcttggacagatatttcacaagcaacgtaaatgtccaataaatatatgcaaagatgtttaacctaattaataatcctgggaatgcctgtcaaaactacaatgtgatataattacactctcagcagattagcaaaaaattaaacagtctgtcaaatgttgatgaagacagaggacaactggaaccttctaccatgctagaaggagcgcacacggaaacgaccactttggaaaacaatctgactccatcttgcacaccgtatgactcggcaaccctactcttagataaacaccctgaagaaattctcacaagtgtgtacaaagaaactcacacaagaatgttcctagtagtattgggtataataacaaaaaccaaaaacaacccaaatggctagcaactgcagaaaggaacacattgggtaaattcgtacgatagaatactccacagaactgaaaatgaatcaactccagtcttacatggatgaagctcaaagtcataattctcatcaagagacatgaagggagtcaaaactgaagacacagacagaaataaaatgttcacaacacgtatctgttcaaggattcattctcagaatttactccttgactcagaatatgtcactcaataagaaaaagagtgtaacacaaagtaattccaaaacgctaaaattagagatgggcaaaaaggtatatggggcaaacagaaacaataagaaagtaggggttgaaatactaatagcagacaaagttgaattccagccaaaaagcattagacttgacaaagacagatagtttttaattcttcattgcagtttacaaaatataacagtttattgccaggtgtggtgggctcacacctgtagtcccaacactttgggaggctgaggtggaaggattacttgaggccaggagtttgagaccagcctgagcaacatagtcagattccatctctcaaaacaaataaaaattcgctgggcacagttgtatagtcccagctatttgggatgctgaagaaggagaactgcttgagcccaggagtttgaggctgcagtgagccatgatcacaccactgcattaaagcctgggtgacagagtgagaccctatctaaaaaaaaaactatatatataacagtttttaatatctatatataatatataattaatctatgtaacagtttttaatatctatgcactatataacagagataccacctctatagagcagaaacgacaggagatgcagagtcacagaaagaagcctactagtgattggagaatatgacatactactctttttcttttttttttttttgagacagaatcttgctctgtcacccaggctggagtgcagtgacgtggtttcggctcactgcaacatctgcctctggggttcaagcagttcttgtgcctcagcctcccgagtagctgggactacaggcacacgccacagtgcccggctaatttctgtatttttaatagagatggggtttcaccccattggccaggctggtcttgaactcctgacctcaggtgatctgcccatcttggcctcccaaagtgctgggattacaggcatgagccaccgtgcccggccataacatactactcttagtacaagtcagatcacgtggacaataagtaggcagatagaagatccaaaaaatacaaccaacaaggtagatactacagatctataatggaactttacactctcataacagagcctacctcttcttctcaagggtacatgggacatgtataaaaattgactgtatattgggtcacaaagaaatatcagtaagtttcataaagaagaaatatttataaataaaattccatgaccacagtgcaattaaattagaaattaataaaataaaaaacaaaaaggtcttatcaaatagaaatttaaaaacaacttttaggtgaaatgggataactgaaaccacaaaaatttttttaaaatgaaaaatactacgtaccaatttatgagatatatttaaagctctgatcagaagaaaagtatagaccaataccagttatgactatcacacaaaaatagtaagtaaaatattagtaaacaagacccaatatcacattaatatacagtgatcaagtggaatttatcctagaaatgcaaggttggttcaaatagggaatttatgaaagccatatactgtattaatagatataatgagaaaaagcatgtaattatctccacagatgctgaaaaagcctttgacaatattcaatgcccattttttattaaaatacgtaaacaaacagacattgatgcatttcttagaggttaaatatatatatatatatacatcccccttggtcctaaatccaacatattattttatgaagaaatattggggacattcccactaagatcagaatgcctgctatctctactaccattcgacattgtagtggcagtataagccaaggcaattagtcaagaaaaattaagtagaggtttataattggaaaagaagacattaaactatcttcctgttgagtatagtggtacacgcctgtagtcccagctacttgggaggctgaggcaggaggattgcttgagctcaggagtttgaggctacagtgtactatgatcacacctgtgactagccattgcactccagcctcggcaacacagcaagaccccatctctagaaaaagaaaacaaaaccatattccagattatacgatggtatacatggaaagccatagaaaatcaatgataaaacagattcaaataataaaaaaaaaacttcaactggtagcaggatgtaaaactaacatagagaattcaatagtctctatgttatttgtatacaataacaataaagagcacatattacttgtacaaaaataataaccagttagagaaaattccatttataccaaagaagataaaatacttaagaataactttaataaataaatatgaaaaacctacatgaagaaaatgttaaaattctcttggaagacacaaaagtagatttgaacaaaggaaaaaggatcctttgttcttggttaagacaattcaacatcaacataaagatgtctcttctccccaaattaatttataaatttaacacaaccccaacggaaacaccagcaagcttctttatggagttagagaagttgatattaacactcacttggataaacaaaaatgtagcatgcacagaaaaacatggggaaaaattagctgcaaaggagctagccctatcagatactaacaggtactcaagtctttaggattaaaagtatagtactcctgtatagacagatggatcagtgaaatagaaagcctagaaataaacccaagtacgtgtggaagtttaatacataaaagaggtggtatctcacatcactggaacaaaaatggttaaccatataaaatcagatccatatcttacagtgaaatacacgagcataaactccaagtggatctgggatccatatgtaaaaaataaaccaagcactagaagaaaacatggaagaactgcattattaacatggttgtggaaaaggtttgtcatgactcaaaatttagatacaacgcctgtaatcccagcactttgggaggccgagacttgaggtcaggagttcaaaaccagcctggccaacatggtaaaaccccatctctactaaaaatacaaaattatctgggcgcggtggcaagcacctgtaatctttgtacagctactcgggaggctgaggcaggagaaatgctttaacccaggaggcgaaagttgcagtgggcccagatcatgccattgcactccagtctgggtgagaaagtaagactctatctaaaaaaaaaaaaaaacaataaaataaaatggataattctgactatagaaaaataaaaatttttcatgcctgtaatcccagcactttgggaggctgaggcgggaggatcacaaggtcaggagatcgagatcaccctgactaacacggtgaaaccccatctctactaaaaatacaaaaaattagctgggtgtggtggcaggtgcctgtagtcccagttacttgggaggctgaggtaggagaatggcgtgaacccgggaggcggagcttgtagtgagccaagatcacaccactgcactccagcctgggcgacagagtgagactctgcctcaaaaaaaaaaataaaagaaataaaaagaaagacaaaaattttagcatttgcatgtcaaaagaaatttaaaaattaatatctttaaaatataaataaacttttcaatattaaggaaagcctaaaaactcaatagaaaaatgggaaaaagagatgaatagacaattcagaaaaagctatgaaaatgcccattaaacacatgaaaagatgttcaaccaaaagcttactcatagaaaaatgtaaattaaaactacagaaaagcttcttgttctggcaggatgaagtaagctcattacagcctctctctcaggctgactgcaactcaaaactctggacaaaatataaaaagcaactacctaaggctgggcacagtggctaacatcattaatcccagcactttgggaggctgaggtgggaggatcacttgaggccaggagttcaagaccagcctgggcaacatagtcagaccctgtctttacgaaaaataaaaaatattagctgggctgatagcgtgtgcttgcaggcctagttacttgggaggctgaggtgggaggatcacttaagcccaggagttcaaggctgcagcgagctgtgattgtgccactgcactcctctctgggcaacagagcaagattctatcccaccccccaaaaaatcccaaaaaacaattctctgaaaacagaaaagtgggcaacagcagccagccgggttttggaggaaagcaaagcttaggacagtgacctacacagagacatgtttcctaggttattcgtatgtgtgttttggggtgctgccctacagttggccctggttgcagagctaccaggcagcagtggctaaaacttggataaaactccaaatttctagatagagatacagagaaaaaggtgcgctacggccccaagaatgtgaggggaaaccctgaaggtttactgtccccctctctcacggtgctgccccagggatggccctgcacacagagcccaggggaaagtgactgagagagaagcttgtctttctgatcaggggaaccaaggaaagggaaccctgcaagatggcaaggggggaaactacagagtggggagagctaaaaaaagttccccaattctgtgaataaatacacagaagcctcaagctcacccctgagctgtgtatacacagggcagacccaaagcagcaccagctgtaagaagggaagtaaaccaacactcaagtctcaggctgagccctgggtggctgatgtgcgagacagaaccaaagcagcatgtcaaaagctctgaaaataaaaatgagattaaaaccacagcccacggagggcgagatggagcttgtgcaaatctaactgggttgactgcctgctagcgccaaactcagctctctctggaggacctcacacactattcaacccaggatatgtctaggatatcatccaaaattattcagcatacaaagaacccggaaaatgagaccaactctcaaggaaaaagccaatttacagatgccaaccttgagaagattcagatgttggaaatatctggtaaaaattttaaagcagctttatgattatgctgcatgaggcaaaaataaacatccttgaactgaatggagggaaaagacctctcagcagagaaatagaaattattttttaaaaaaccaaacaaatacgaatttcagaactgaataatatctgaaaaaaatcaataatggaatgggagatgacagagtgacataaagtgggccaggcgtggtggcttacatctgtaatctctgcactttgggaggccaagacggaggatggcttgaggagttcaaggctgcagtgagctatgatcgtgccaccgtactccagcctaggcaacagagcaagaccctgtctctaaaataaaataaaataggccggacgcggtagttcacacctgtaatcccaacactttgggaggctgaggcaggtggatcacttgaggtcaggagttcgagactagcctggccaacatggtgaaaccctgactctactaaaaaaatacaaaaattagccaggcatggtggcgggcgcctgtaatcccagttacttgggaggctgaggcaggagaattgcttgaaactgggaggcggaggttgccgtgagccgatatcataccacggcactccagccggggcgacaaagtgagactccgtctcaaagagaaaaacaataataataataatataaatataaatataaatataaaataaaagattgagtaagtgaaattattcaatataagatcagaaagaaaaaagattgaaataagtggttagcatagcagggacttgtggaataatagtaaaaggtctaacattaagggcagtggagtctgagaagtagaagagagaaacagatttggacccaaaaattaattgaataaataatgcctgaaatttcacaaacttagagaaagacaaaagcacatatgtttaagaacatgatgaaccataaacgaaccataggataaattcaaagaaaacaatattgaaacatcataaactgctgaaaaataataatgaaaccatggaggccagaagggtggaacatctttgttaaagaactgaaagaaaacaactctatatctagcaaaatattctttggggatgaaggcaaaataaagattcccagatgagggcaaatgagaatttcttgcctacagatctgcactaaaagaaatgctaaagttcttcaggttcaaaagacatgataccagaaagacatgtggaacttcaagaaggtaggaggagcaatggtaaaatgcggttttatcacttcagtaaacatgtatgattgttaaaattgtattatctgttgaggttttcaatatggcagttataacataatggaggagggtaagggacctatgtggttgtaagccttctatattttatttgaaatggaaaaatattaactctaagaagactgtgaagggttaattaagtatgtacactgtcatccctgcagcaaccattaaaaacataacacaaagagatactgccaaagttccaacaaaaaatcaaaacaatgttttaaaatacctaaataattcaagagaggacaggaaagaggggatagaagaaaaaaaaagaagagaagaaaaagagaaaacaacaaaatagtagacctaaatataaccataccaatcactacaataaacataaatgctcccaacatgctaattataagacccaactataagctataaaaaataaaaaggtgaaaaagatatgctatacaaataataaattgcagtggatatattaatatcaggcaaagtagacctcagagtgaggaatattatcacggacaagaagaagatacaatgataaatggcatcgattcagaaagaagacacaaaagttgtaaatactgagctaataagagaacttcaaaatgcatgaagaaaaaactgatggaactgaaagtagaaatagataactacataattataggtggagacttaaactcctccttagtaactgactgaacaagtggtcaggaagtcatacagaagacctgactaatactatctacctacttgacctagttgacatttatagaacatgccgctcagtagaagaaacacattcctctcaaatgcacatggagcactcatcaagataggccatatcctgggtcataaaagaaaccttaaaaatgtaaaaaaaaaaaaaaacaaacaaacaaacaaaaaaaaaacctcacgcctgtaatcccagcactttgggaggtcgaggcaggcagatcacgaggtcaggggttcaagaccagcctggccagcatggtgaaaccccacctaaaaatacaaaaaattagccaggcatagtagcgcacgcctgtagtcccagctatccaggaggctgaggcagaagaattgcttgaacccagctggcggaggttgcagtgagtcaagatcgcgccactgcactccagcctgggcgacagagcgagactctgtctcgataaaaaaaaaaatgtaaaaaaacaaagtatacaaagtatgctctctgatcatatggaattaaactggaaatcaataacagcaagataatgaaaatctccaactatttggaaattaaacaacactgttttatataatcaatgggttcaagaggaagtcccaagggaaattagaaaatatctaaactaaatacaaatgaaaacaccacatatcaaaacgtgtaggatgcagctaaaacagtgcttagagggaaatttacagcattaaatacttacatcgacaagaagaaaggtctccaaatcaatgacctggtttatgccttaagataacagaaaaagaggacaaagtaagcccaaaacaagcacaaggaaggaaataagattagagcagaaataaatatttttaaagaatagtaaaacaaatgagaaaataaagcaagaggtcggttctttaaaaagatcaataaaactgataaatctctagctgaactgacaacaataaaaagagaagagacaaattataataattaaagaagggttatcactacagacaccagaaacattaaaaggataaggagatactatgaacaactcaaataaattcaagctaaataaacctagctgaaatgaaagttggaagacacagactatgtgaagaaagagaagacctgaatagtcctgtatcaattaaaggaatcacatttttagtttaaatccttggggaaaaaaaaaaatcaaaattccagcccacatgactttactggcaaattctaccaaacatttaaagaagaaataacactattctacaaattattttcccagaaaacagaaaaagagagaacatttcccaactaatttgatgaggctagcactaacccaataccaaaaccagacaaagttagtagaaagagaagaaaaccacaaacaaacatatttcatgaatatagacatacaaatcctcaaacaaaataatatcttgctgcttaagtctcaagttggggagggaaaaacagcaaatctaatccaacagtgtagaaaaagaatacactggagccaactggcatttatctcaggaatgcaaagctgattcaatattcaaaaatcattcaatgtaaactctcatgttaacactaaagaaaaaccacaggatcatataagttaatatagaaaaggcactgggcagaattcaacatccattcatgatttttaaaaaaaccctcagaaagcataatccataagataaaaaacacaaattcaccttccacaaaattagaaacctttgctcttgaaaagagattttttttttttttttgagatggagtctcgctctgttgcccagactggagtgcagtggcgcgatctcggctcactgcaagctctgcctcctgggttcacgccattctcccacctcagcctcctgagtagctgggactacaggcgcccaccaccacacccggctaattttttgtatttttagtagagacggggtctcaccgtgttagccaggatggtgttgatctcctgacctcgtgatccacccgcctcggcctcccaaagtgctgggattacaggcgtgagccaccacgcccggcctgaaaagagattattaagaaaatgaaaagacaatctatacagatggggaaaaatattttcaaatgatgtatatggcagataatttatataccaaatatataattttcaaaatccacaaggaaaacacactcacaaaataaaaccactaagaatgggcaatagatttgaacaaacacttcaccaaagaagatatgcaaatggcaaataaggacatgaaaacatactcaacatctttagtcgctaggaaaatgtaaattaaaaccacaataaaatgccattacctacttatcagaatggctaaaacagaaaagactgaccattccagttgctggaaagcttatgaagtaattgaaactctcatacgctgctgatgggattataaaatggtacaaccccttgggaacaaagtttggctatttctttaaaaaccagtcacatactggagacaacccaaatgcccatcaacagcagaagaaacagagctatatccacacctggatatatccatccttgacaatgacaaagtaggaagtactgatacatgctttaatgtgaataaatctcaaaataatcatgtcaggtgaaagaagccagaaaaagagagtaaattctgtgattctatttatgcaaaattctaggagatacaaactgacctacagtgacagaaagcagattaaagggaacctggagaagagaggtgcagggaggaagaagggaggggcatgcagagacgcaggaagatactttaggcacagtgggtatgttggttgtcttgagcgtggggatggcgtcacagacgccgcacttgtcaaactgtccacttgaaatatgtgcagtttattgcatacgcaatttaattgcacaatctatttttgtgctcattaaaggaaatgcaagagcaactaaacaatccaattaaaaaggcataaaagatttggccaaacactccacctaaaaagatgtgcaaataagcacaaaaggcaactcaacatcatagccattagggaaatgcaacttatgcccataatgaaataccactacatacctactagagtggctaaaattcagaaaaaaactgtcaaaaccaacaaaaccaagtgctggcaatactgtggggcaactggaaccttgttggtgaaatgcaaaatggtgcccacactctggaaaagagtatggcagtttcttatttatttatttttttatttttatttttattttttttttgagacagagtctcgctctgttgccaggatggagtgcagtggcacaatctcagctcactgcaacctccgcctcccaggttcaagcgattctcctgtctcagcctcctgggtagctggattacagacgcctgccaccgcgcccggctaatttttgtagagacagggtttcaccatgttggccaggatggtcttgatctcctgacctcatgatccacccgccttggcctcccaaagtgctgggattacaggcatgaaccactgtgcccagcccagtttcttataaaattaaatatgcattaacatgttgcccaacaattctactcctagatatgtattctagagaagtgaaaacttatatgcaaacaaaaacctgtacatgaatgtttatagtagttataactaaccacccaaaacagaaatgtgaaaactataatctcctaaaacagaaaataacccaaatgaccatctatggatgaatggaatactattctgcaacagaaaggaacaaactattgataaatgcaacaacgtgggtgaatctccaaagaactgagtaaaaggctacacactatttatatggcatcctggaaaaggcaaaagtataggtacagaggacagaccagtgactgtcatggatcagaaggagggggaggggatcactgccaaagggcagcaaaaggcagggttttgagagaatgagaagttttctgtgtcctgattgaggtggtgttgacacagacatgggttaggactcactgtaagcgcacacaataataaagataataacaataatacagtagttccaccttatctaggggggatgatgaatgatgatgatgaaaagtatctagggatacttttcaagacccccagtggatgcctaaaaccatgaatagttctgaaccctatatacaccatgtttttccctacagtgtacatatatacctacgggaaagtttaatttaaaaattagagacaggcacagtggttcatgcctctaatcccagtactttgggaggccaaggcaggaggatcactgagcccaggagttcaagaccagcctgggcaacacagggagaccctgtctctacaaaaaataattagctggggcagggcacaatggctcacacctgtaatcccagcactttgggaggctgaggcaagcggatcacctgaggtcaggagttcaagaccagcctggctaacatggtgaaactctgtctctactaaaattacaaaaattagcccaggcgtggtggcaggtgcctgtaatcccacctgctcaggaggctgagacaggagaatcacctgaacccaggaggtggaggttgcagtgagccaagatcgtaccactgcactccagcctgggcaacagagactccgtctcaataataataataataacaataataataataataataataagccaggtgtgttggcacatgtctgtagtcccagctactcaagaggttgaggtggtaggatcacttgagcccgtggagtttgagactgcagtgagctatgctcacaccactgcacttcagcctaggcaacacagcaagatcttgcctcaaaaaaaaaaaaagtatactatgataaaagttatgtgaatgtggtctctctcttacaatatcctgttgtattgtactcacctattttcagactgcaattgaccatgggtaactgaaacctcagcaaaagtgtagatgagaggggagctagtgtcgtaataaaatgcccatgagtccacactgaggtaaagaaatgactaaataaacaaatctcccaaacagaagaattccactttatgcagacactctaccatcaaggaggagtagataactcccaaccgtttaaatatgggttatgcagtgactcccttcctaagaggagagtacggaaaggagagaaaaacagccactttacagcagaaacacctgacagataccacctccgccaggtgatgacgctcagcatcagcagggctaggtcatgctgaccacacgtcccactgacatgatagaaaatccaggaatgggccaggtgcatggctcacacctgtaatcccagcactttgggaggtcgaggcgggtggatcacttgaggtcaggagttcgaggccagcctggccaacatggtgaaatgccgaccctactaaaaatacaaaaattagccaggcatggtggcacgtgcctgtaatcccagctactggggaggctgaggcaggagaatcgcttgaacccgacaggcagagattgcagtgagccgagatcgtgccattgcactccagcctaggcgaagaagcgaaactccgtctcaaaaaaaaaaaaagaaagaaagaaaaagaaaatccatccaggaatggcattcaacctttgtgcttttcttcccaaaacccttaagctcagtctaatcgtgagaagaacacaacaaatcccggtggaggaacattttacaagagcctgaccagtgctcctcaaaacttaaggttatcaacaacaagaaaagtctaagaagttgtcctggccagaggagcctggggagacaggagagcaaacgcagtgtggggttctggatgggattctgcaacagaaaaggacattagggcaaattcaggaaccctggatgaagcctggactttggtcactaacaatgcatcaatcctagtccattagtcatgcgcagagcaagatgctgacaggaaaaagggctcagaaatgcgtccgtgcacaaggttcacactcaaccactgctcttggccacagtctcacaggttatgtttcaaataaaatatattgtacaagattcttgtgctattttttcttgtgttacagttaatggtatttaatttacactaatgtattatgaaacttcaattcctgtttctggctttggagtcaatttctatctctactcaaggtgacttaaacagacttaatgagcctgggcaacatagcaagacccccatctctacaaacaaataatttaaaaaaatcggccagttatggtggtgcccgccatgatagtcccagctatgttggtggctgaagcaggaggagaggatcacttgagcccaggaggttaaggctgcagtgagctatgatcacactactgcactgcagcctagcctaaagagacctgcctctaaaataaacaaacaaaacagacttaatgtcaacttttacacgcttttcccattccaaataatttactatcttatttttgccctaatataaattcatcaacagtgccccctggtacaagctagtagttattcggttaagcaaatgagctgatgacttttatgaccatcgttacttccagaaggtgtccccagccagctggggacagaaagagcactgatctaaccactgttgcgcttcaccagcccagcccacctaatttctctatgaagtagcacagccgttctagcatgaagatgttgaattggctggtcctccaggccagcaagaacatgaagccaaggccatgaggcctgaggcaggcacacaggtggctggtgaatgggctccctcccacctcctgctcatcaggcacctcccaggctacacctggaaccagaaaggcactccctggacaggcctgtcctgagcagagacctcagtgtcatcccctgccttcctggtgaggaagacagcagcagtaaggcccagaatctcagaactgtccgctgcattgcagcctcagccagcgaccctgatctcccaaaaagcctcacacacaccactccaagaagctgcatcagacacagagccctgggctatcccagtcagttcactggcacacatctcagtgctgctgcttcaaaccaggaaactgaggtctagatacacccttccccatctctgaaatgcagggagatcagcggggagtcagtgggggcagtcagagactagcccccaacaacccttctcagtcactgatgtctgcccaccaaggcctcgggggccaggattgcttccatggccttggctctcagcccaggacgggggtgggagcagcctggtgagtaatgcccaggcccccaagaggtggtcctgccataaataatgccaaggacacatcccccttcaagggaggccagacctgccagggagggctgcagaaaagctgcactctagctgcaaacaggaagggatgagcctgctcagatggtgaggtccctatcctgttacctgccactcacggccacaaaggaccagaaaccctccctgggcaaggaaaacatgctgcacctccctgtttggacccacggctaccagggccagctactggagataccaggactctgctagtgtcacctggcctgggaaggacctaagcagctcaagctggccacacagcagccacagccctggccatggcccccacctgcccactcccactgcagccagctccctgtcctgagcacgggaaacaggtctaccagcactaactcaaacttcacaaagaaaccatttctggaatggggctccgtttggcgattcggagtcaaaggcgcacttcatagctcctttccaaatcccgtgcattgtcaggccctgttcccctttgaagcctcgctgagtgattgaagcgtctactttctgaggggcagatagcaccgggctggtaatctgactctaagccacgggataaaggtagtttgtttcctctcagcccgtctgtcaacacctcctcagtaattagccctaattattacagagggccagcctcccattcggttattaaatcagaaatagtatcacggctgggcatctgtcaacgccccgactggcgaccttcgattcattgaatcctctgtcagtatccgcctttggaagcgcccaggcgggcagggaggcagcggcttcaaagatgcagatcccaggaagaattccggtgaggcagggaggcagggagggccggtgcccagcagcccgatggcgagggggagccaggcaccgccccccgggcagcaagtgcacagcccaaccccagcaatttcccacctcccagggctgaccgatgtcagtctctctgtggcggggaataaggtatgccccccaagaactccttcccttggagaagaaagcacctccaggcctgcatcaggcatatccgtctcagggagtggccctgactgacaacttggcctgaggcccacaaagccctgaaccagctcagtgcagggaggggaacccgagccccggctgcccagagcactggtaagctggcaaatctgcaaagcagaactcagattccagccatagacacgatttccatagtggagatgagagtgctacagtcctgtaggccccgacgaaggacagccacccatctcccttctgggtctgagtctgttctccatcctagagaaatggtcatttgctctgccacaggggccttctgctctggcaaagcacctccaccctgctcccctagggtatagctgccccccagcaagattcactgcctcaggccaggggccggcactgacctcacctcacctggggcagtggcccaggtgccccagggctggccaccagcacttctccagagactgagacccacagtgccccacccaggactcctggcctgcagtgagccaggtggggcccagcacggtgcctacatgctgaaccccaccaggtctgtgccgcccccttccagataggccctgctgcgtgtgagggagggtcccagagatcagtcacttttgctggggacacgcccaaatggcgtgattcgttcccgagcagagacaagcaagttcctctagacagcccactgcagcctgttctcccccgaggcactgccagtccctgctgggtgctctgccagcactttgggtcctcgtggccaccaaccacccaccacgctggcagggggagtgggtctcatggagacaaggacatggattagttttcttccttggggatgcctggaagcctcatggctggggcatgaggagtgacctgctggccagctccacagtcagcaggggcgccaggcaggcgctgaggctgcaagtcagacttctcctttgcactgggacacgggctgcctcagctgagccaagaggaaatgccagcgtgaggagccaccaggctgcagaggcaggcaggatgggcaggcggggtctctctgtgagcaggcatctcacgctgtggctggggatgtccgtcgccccaggagcgggtcccaggagcctggcaagatggcaggaaggaagcctgacttggacattgttagccagcctgccccaggcacttacgggcagaggcaggaacccagccagcagagggaccggcctttttgacccgggtgaacacacggaaaagctcactgctttacaggaagcgtgacatccccgtgcaccagttcagcctctgctcagaggcctggttcatgtaggccagctgccgatcccatcagggagagacaacactcacagagggtgcaggatggggaccaatcccctggggctggtgcccctggcctcggggatggggatgtgccctggaaacttggtcggagctggaggaggggtccctaagcaagctggggctgacactttctgacagggacttgcctgtgtggctcctcctgtggcggaggcaaccttgggtggaaaggggaggtcccctatcacacacaggtggtggtgtggccaggtgtatgtctcatcaactcccgaccacccagctgcatgcagtcagctgtgcacatgcttacatatgcatgccagcaatgtgcttgcccacatccacagacatgcgaatgaggacagaggccagcctcccactcgctctgccctgtgggtgctgcaggtggacccctcactgagggccccccctatgcacagcctgtgaataaagagccctggctccacaacccacaaacactccccagtcccctgcagtgctcagacacagaggtgaggtgggcagcgcaggcacagcagggggcaggggagtcagatgtcctgtgcacccagctggcagccccaccaatggggacacagaagaatgtggcaagtgcatgagcacccatcatccacaggccccagccctgtgctgggggtggttcctgaggccaggaggaaaggagccggccaatgagaacaccccacaggcctgggctcttccttggccagcccctacccaccgtgtccctgtaatagagatgatgtagcccaaagaaaaactaagggagcaacgggccctgctgtcctggagagcaggcttggccaggctgtccagcgacaaggcacccccgaggcctgcaccaggagagtgtgaacactgctggggctgggcaagggccatgacaccatcctcgctgcctctgcatttgtgatccaatgtgttttaaaacttgcaaagacaacttgaaaaatggggacatggatggtttccctatgacataagcaagacttaaaagctagaataactagtaagggacagatcagaccagagagcaggcgggtaggccaggcatggctcacgggtggctgcagccagactgtgagttgctgcagccagcagctgatgctgaggtaggccctatggaaaaaggtgaaatgggatcccctgttggtcaggacataataggttatgctgtggaaaacacaagccccaaactcagtggcttcgcacatcaaaaatttatttcttgctcatattacatgtgcatcgcggtcggcagaggggctctgctcatcacaggctatcaaggatgacagcagacccctcccttctgccgcagttacacttacaggtggactcaaggttgaatgtcaaaggcagaaagttacaacctgggaatacaggataatgcctttgtaccccccaggtagggaaagatttcttaagtgagaaacagcatcccatacagcacaactgggcactgcctactcaacagccaaggcttggccatccccactcctcagtatgggccccagaacccagggcctgggggactctgcacacaggcatgtggagaccacagaagcctgcccaatatagcgctgccaggaacagcaaagacaaaaccagagaagcctatcgcgggcaccgctgtgggcagaactatgtcccttcaatatttttatgttcaagtcctaacccctagtacttacatttgaagacagggtctttaaagaggtaattcagggttaaatgaggtcatgagggtgggccctgatccaatagactagtgagcttatgagagattaggacacagacacagacagggacacggcaagaagatggctatctgcaggccaaggagcgaggcctcaggagaaaccaaccctgcccacaccttgatctcaggcttctagctccagaatcatgaggaaatgtctgttgtttaagtcccctagcctgcggtcctttgtcaggcagccccagcagacaaacaggtatgttgccctgggatggatgcaggcccctcccatcctcccatcctcagcagcaccaaccagccccacgctgggtggctgcttgtacttctccatactgagcaccccagcccataggatgatcagctgctgccgtcctatggaactcaggtgtggctctgtggcttcctttggccacagaaatggaagtggggtgacacacattacttgtggcctgctgtggcctttcccctgcctcagtgagcatggagaaatatgtccaggtaggctgtcgtcagcacaggtctgacaggccccagccacggtggcccacaggtgcaagcaagaaataagcagtgccaactgtagccgctgcgctgttggagatctttgttactgcagcacaatctggctcatgctgactgatcctgcagggtaacagctttatttgccttgctcctttattgctggatctttgggcttttccagttctgctgttcaaaaaacagtgacacccatgaggtgggtgttagagggcccagaccccagccaaggcactgcatgggcatcattctcattcaacccttctaaccaccccatgaggaaaaactctggtcacagctcaaaaaggtcaggtaaggaccctcagctcatgcggggaggggaggaggcaaggccaacctccagtccctgctctaaacccccatgtagtggtaccgaaccatgaccacccctggcaagagccttcatgcacctagcaagtagtcacagcatgcatgtgcctagaattgttacgtggtcaaattatattattgtgtattcccaccaacagtatgagaaggtccacttctccatacctccacaactctgggcatctaaaacttttaaaatcctggaatcataggcaaaaaaaaaaaaaaaaaaaaattcacccatattttcctctagtactttcataattgtaacattgaaatctttaatctggaatatgtactggcataaagagtgaggcacatacatggctttactattttccagagggccaactgcttttactgaataatccattttactcgttaattggaaacacctctagcctgtactaaatttccatatttatttggcccgtttcaaagtcctctattctctgctcatctgtccacatctaagtgctttaactattgtggctttataaaatattccaatatcccataggaccttatccttagtacttcctattttaaagttttccttgcagacaggtactttaaataccatctcacagcacccatcatgtcctatcttcaggaaataaaatctctgggtatttccaagggaagtgaaggactgacaccatgattagaaagcagagccagcaccatggcccgtccctgagcatgtccagcaaaccctgccaggctctgcagctcctgagcaccctgccttcgggtctgccagtgtgtgggggccagaagagaaaaacaacccagggggaatgcctccttcccccagcaggaaagcagcttggtcatcatctgtctgaaagcaggtgctgcagcagctggcaacaaagccactctgaaaggagctgtgtgcactgcctgtctggaaggccatgccagagtccatcgttgcctccaccctacctgtgcaggaaacctggacatcaccacttcaaggccctaccttcctttctgggcagagcccaaccacaataaacaggacgcgttttaattaaaaaccaggtcacctggactctcccaaggactctcaagcctgcctaggtggatgctgcatgactggccctcagacacacggcagaccataactcacacacccccaggagctgcctgggtcccaagggcacaaaagccccaaagccccaataggacagggttcaaaagagaaggcagcaatcccaggctggagtatccacttcaggtccactaaagggagatggggaaggtggcctgtccagaagcctgtgggacagggtaaaggtcagctgggtgactaggctgtccatcctagagagcaactctgggttctactgccagacccacaggtgagccaggccacagtgcactggaggtaggcatcagggagcagtctgacccaacccacaaaaggggggatggggcctgagtcatcggacggagggcagctgtgacctggcacagaagcatggggctgggccaggacatccagggacttctcacatctgaccagaatcaagactgaaaatgggtttcttctgccagctcacttgctttgctaccagggctatacctgctttctaaaaatagcttcccacctatttccaaggtttccagttgttttacctacaaggtatctgtgccctgaaataactcacacataaaaccatctgaacccagagccttttctagtgatagttaccataaaataatcccaacaatttatatttttctaaataaggtttttgttttttgttgtttttttttttttgggatggagtttcactcttgttgtccaggctggagtgcaatggcgtgatctcggctcaccacaccctctgcctcctgggttcaagcaattcttctgcctcagcctcccaagtagctgagattacaggcatgcaccaccacacttggctaattttgtatttttaggagagatggatttctccatgctggtcaggctggtcttgaactcctgacctcaggtgatccacccaccttggcctcccagagtgctgggattacaggtgtgagacactgctcccggccagtttctgaataagtttaatcagatgcttgctaattagtttttcctaaaatagttggctgtatttccaattcacatttctgctttttcttcctactttccaggaaggtgttgttttgttgttttcacaattgtaaacctgaaagggacttgaacttcttgtccaagcaccagagtgggcacacactgcacacactgggcggctgtacctgcctatcctgtggtaaacttggctccaggagcttccaagctcagcttccactagaaaacccctccttgtgtggaacaggtctttcttcattccattcctctgggcctggggcctcacagctctggactgctgcctggtcctcacttcacctacagctctcggaagtcagttctctacctgcagagccacccaccccctactcagccccacccagcttctttgatcagacccttggaccctcaaagcccctgccagaaaccacagctgcaatgctgacctggaatgctcatggccaggcctctgctcctgacagaatgggaaacaaagacttgctggtaggcagccactgcaccacctcagccagtaatccaacacgtgtttaatgagcaccaattgtgtaccaggccacagagctgactaagacagagcccctgtgctgagggtcacagtctgccaggagggagatccaagtcatttacacactagggcttaagtgctgaatccgcaatgcatgcgagtgcggagtgagcaggggatggcagcacagcagcagggaagaggagcctgcttcagaacaccaggcacgattagagctacagtgttaacacacaaagggcgaatgcctgcagctgagcctggcaaggggcttgcatcccaccttcctgcatccaaaccttccagctgcccagaactgctggtaatcccacaggaaacatcattctttgccaagatgctatcccactcatcccccagaatcaaagtggccacttcctccaggcagccttcctcacattccagctgggacagaagtcacagggagcagagagggtggggctagggggacagacacagaaaccccatacaggaacgaggtcccaacagggcagacgtggcagacccagttcagtcccagccagtgtggaagacaccaaggggggtgttttatgggggtggaggtgacaaagatgatgcaactatctgctgagagttgatctacaaaacgaccccctcgtgggagcaggcctgggtgagacggcactcccagaagacgggcagggatgcagcagagagccagcagcagggaaagggcacagggcggaggtcaagctctgctggagttgggggagctggttctgctcagcgcagagtccaaaacaagcgcatcttgcccagctatggggtctgaagtcatctggggacaccactctgctctgactggggactatggggcgctcaagccacacaggccacttcatcatgaggggcagcattgttcccacctgggctgtgttcagaacccaggagaaagtggtggctctcctggggtctccggggcctccaccacctcctgtggggtacctaaggacacctcctggtctccctctgtctccaaaacctcctcctctgttttctggggttttggacctcctggatgagctgggtctggtctctgggcaggaggattagctgactccgacagtctagggacaggtgtgggggctgcctcctctggctgggaagaggctggttccacaggaccaggcttggagctacatgtagaactgggcaggactgggggctccttgggcccaggggtgctctccttggtcagctgctgctcgaacagagcacttctagatacagagttggacccagacacagcaggggtggccatggcggctggtaaagacctgggggcagtacccatgtcgagtgccaggccctctaagaacctagctaagtattgcctcaccacaggcagctgaggggccactggcagctggctggaggccaggggcaggggacaggtaaccacagcatggtactcagcaaaactgttcgggtcttgaacaacttccttgagatcctggcagaagagctcgtaatcgtcaggcaggggcaggtccccatcaaggtagggggctgcccaggcctgggctcggcctgttaggcgcctgaggatctcgcagacacggctgatgttgtcctgatagtgctcaaagtggaaggacatgtaatcgcccagctgggccaagaagcggtccagtagccacggggagccatcaaaggtgcctgggtctgagcctggtacccagcagaagtccaccctgtggggtcgggagctgggcatgtgcccagctaggggacccctttctgcaggtttaccgccacaagtgccactagctgtgctcttctgctccatggtcgttcgcacacacacggtgtccccacagcagggccgctcaatccagggatccacaaggggggtgtatgccaccccaggagacgccttgtccatctgctgccatggatgtgcgttggcataattggcggctgcccagatgggaatgcgagggccctgctgacggcaccggccacgaggcatgctgggagcacaggggagaagagaggagagccagcactggtgggtggtgggggtgtggacagatgtggcttgcacgacacaacaggacagggatggctgaacagggcgtggcagacccgcactggtccaggcaagtgctgaggatcagggagctgacagctgcagcctcaggagagctgagaagagctgagagactgtcagtcgcaggccatcatccgaggcaatctgtccaaagacaaggtggggaagagcaggaactaggcctaaccatcacccactggactggtgggaagaggctacaagcgggcaaccctctggtacccaactaggagctttgaatggaaggaggggcccagggggctggcctgggaggtctgaggtgggcaaatgctgcctatgacattgcaagggcaaggcagaatgacagatgctgtcaatttcagaagaaaaggggccagatcagaactgtcaggaatttcaggatagcaatagtagtaacctttcactgagtgccccatttgtgccacctcccccacaggaggttggtactagcattgtctttgaggcacacagtggtgaagtaacttgtctgcagccacacactaacccataagtggtggaagcagcaaaaactggctggagagaccagaggcttaactactatacagcacgcgattataaactacatttgtctgctgagtaggctctagccgccccaaaaactctgaacaacgcacagaccgcgtcgtcattaggctcttttacatcccagcaccaggcacacagcaggtcctacctgcttccccgacagagcagtgagcctgctattctctgctccctcctgaccccacatgctttccaaattcacctctcacaactgagtgccacctgcaggcaatgccacccccacccacaaacaccacctttccacagtccccatcccagccacagcagagcatcccagcccccaccattgtaaaatcctggaaccccacttgctgtctgctcccgccactccagtcacttgtgcccagggtctggggagtcccagtctgatggctggacccgcccctccttctccacgcagcagtcacctaggaggctccagagccagtagccagttctattccagtgcaaggagccctcctgtagggctcttacactctgcagcctaactctatctagccccctccccagtctctctgcaaacggaggcccactcacgacctccaggaaactctctgcttcaccccacacacaaacgccaccggctcactgggagcacaaggcctgcacacaccttcatcccacatctcctatctgctggccatcccccctcagggtgagttcctccaggtacctcccagggtggcctgcagcactagaacctgccagggccactggccctacctccaccacccaaacactctggaatccctcaggtctgacccccctctggggggggggtcttcacctgaaagcccagcccatgaccctggcttcccaccttactgcaggattatactaaggcctggacgtgagtcgagtccagtccagtccctcactgagctctaaaaaagcagtgaccccgatccagggcccagctcccaccaccagccaaggttaggtatccaggttgcccacaatgaccacaccccatgcccgggagccacagtgtgctacccagatctctgccttcccttcttcccagtcccctaccctgcccactcacctgcgcacctgtgtcccctgcagtctgggagaaggcttccctgcaccagccagccaggcctgctttgggcctgagccttcctaaccctgggccgcactctcaccattttgagaaccttagccctcccacgcctatcagtctgttggtccccctacttttctccccacactgcctggcatagaagactttcggcccttctagactggacagcactatcctaaaggggcaggtaccacggcgcatgtgtgtttgcccccacaaggccaaaggcagcacctggaacgctggagccgttctctgctctggggagacccaggagccccaagaacaaaacctgcccaaagccttaaagcaagctgagtgcagacgactgcaccgcccgccccccagcaaccgccatgcaggaaatacgagctcacaaggcccacggcaacaagaagcccacccacctgaggctacgcgaatcgcccgcgaagagggtcctgggatccgtagccacagaccgtgggacgggcctccctctgagggcgagagtccaggcgccacctagaaagtggagaacgagatcggccgccgtgaggccaggcaaggagcgggcgcggcttcccgagactgcgagaacggcccaaatgtctccaggtgcccccacaaacccccggcgcggaccgagaaactgaggcccgcagaccgaaggcactgcgacccaggctggggctccgagtgcccctctgcggatcagaagtcgggaaaagacgcaggggcgcagctccaggcccgcgtgcacggagttcaagccggccgcccgggctcccgcctccacactgaccctcttgccggagtcgggaacgcctgctcctaggagcgccgcgcagcgtccagagaccgattacatcgcgcagccacgcccccagcgtgcgcgcggccgccgtgtacgacccggcgcatgctcccggcacgctccacgcgctcctcccatccaggccgcgcctgcgctgtatgccgtgtggccgctacctcgcaggctctcccggtccctgctggcgcggcagtgccgcgcggtgggtgatgggagagcgcgcccattcccacgccgcgccaagtgccacgggatcaggtggggccgcgtgtacaggcgcgagacggtcgggccaaagctgcccctcatgatccccagcggacggtgcccggcggtccctcagatccgggaaatctgcacccggctgtggcgtagaccgaggggccgatgctgcttcagcccgccgttactgccctggcgtcagccagacactggggtgctgctgggcgtcgagagggctgctgcggggccgggctaagcctggggggctgcaggtgtcggggtggatgtgggcatagcggggctgctgggcctcgtgagcgccctggaacggcgtgcccgcggagtgcctctcatcactcattgccagtgcggggaaccttgttagggcccggttcgacgtagctgcaggctgggcgccagaggcagggggcaggcagtccgagaggaccctctacctgcatacctgggggctgcaggcagggcctctgggcctccttgttgtggatataattgtgtgcttcccgactcaggccgaggctggacccggagacgacagcgagggcaggctaccaagccctccccacagggccgtgcccagcccaagcctgccgagtcagcacccagatcctgggacaagataggtgaggatgaagtggtggtgctcttctcacttgcacaagccgtcccacgccacctctcctcggcttcacggtgcctagagaagaggtgggagagggtgcaggcgccccagctcaggatctgatgcctgtgggccaaggacctggatgcaagccaggagtccttggggccacgggcaggcagccggattcaccggaaagtgacgcttctcaaggggaacacacacgtaacacaccagctccctttctgccctggtccagtgactcctttcatgaaagctctctgaaatgttatctgcatttacacccaaactcactcactttgatccctgaaacgcgaatcaaaggtcacattgtaccttccctgggtctgtggggctttcagcagcctgggccaaaaataataaaagtggcaccgagccaggaaacgcctccttgaagtgggaatgaaatttggatttttttcggttgtatctttcctaattgacctgataatttaaacttcctccctcaagggaaaggtgggggttcccacaaattcagcttacctcagcctcaaggcagctcagtctacagctcagcgcccatcagcagagtgggcagtgggcctgtggaagaaatgaatccaactgagccagaaaaggccttttttggtccaaattttttttttctttcaggccctctcctgtgtataactgtcatgcaccgcataacaacgttttggtcaactagggaccacatatgtaactggtcatccagtaagctatagttattttattattgaagaaagaaaatttttaggccaggcgctgtggaggctcatgcttgtaatcccagcattttgggagcccaaggcgggcagctcatttgaggtcaggagtttgagaccagcctggtcaacatggtgaaaccctgtctctaccaaaaatacaaaaaattagccgggcgtggtggtatgtgcctgtaatcccagctacttgggaggctgaggcaggagaatcgcttgaacccaggaggcggaggttgcagtgagctgagattgtgctactgcactccagcctgggcaatagagtgagactccatctcaaaaaaaaaggaaaatgtttaatataagtgtgttgcagcctaagtgtacagtgtttataaagtctaaagtagtgtacaataatgtcttaggccttcacattcactcaccactcacacccacagcaacttccagtcctgcacctctgttcatggcaagtgccctaaccagttctattttttattttttgcactgtacttttactgtacctttgctatgattaggtgcactaataccactgtgtcacaattgcctacattgttcagtagagtcactgtgcaagtttgtagcccaggagcaacaggccttaccatacagcctaggtgtgtagtaggctctaccatcttagtttgtgtaagttactctatgaggatccctccatgacaaaatcgcctagtgacacatttctcagagtgtatccccacagttaagtgacatatgactgtttttttattgtggtaaaatatagtaacatttaccattttagccatttttaggtatacagttcaggagcattaagtacattcatgctgttgtatatccagtgatcactatttatttctagaactttttcttcactccagaacattaactcctcttcccctcccactcgcaacccctggtaaccatcattctatattctgtctctgtgaatttaattactctaggtacctcatataagtggaatcatacagtatttatcattttgtgactggattatttcactcaacatgttttcaaggttcatccacatcgtagcatgtgtcagaacttccttcatttttaaggctgtgtaatattcctttgtacacattgaccagattttgtttattcatttgttgattgacacttgggttgttttcaccttttggctattgtgaataatgctgctatgaacattagtgtacaagtatatgtttgagtccctgctttcagtacataagagtgaaattgctgaatgatacggtaatattttgtttgactttttgagagattgccaaacttttccatagcaagtgaaccattttacattcccaccaacagtgcacaggagttccaacttctccacatcctcaccaacacttggttaccttctcttttgtttttttccaatagccatcctaacggtatgaagtggtgtcccattgtgattttaatttgcatttctctaatgactagtgagattgagcatcttttcctgttattggccatttgtatatcttcactggagaaatggctattcaagtcctatgcccatttttcactggatttttgtttttattgttgagttgtaagatttttctagatattctggatattaatcccttgtcagatatatcatttgcaagtatttctccataggctgccttttcactctgttgatagtgtcttttgatacacagaagtttttcattttcattaaaatgtcattaacttaatttcactaaattaatttcattaatttccaagtctaatttgtctatatgttggtggtagtggtggtgttatatctaaatcattgccaaatccagtgctatgaagttttgccctatgttttctgctaagttttataggtttaggtctttatatttaggactttgacccattttgagttcatttttacatacggtgttaggtagggatccagcttcattcttttgcatttgaatatccagatgtcccagcatgatttgttgaagactatcctttccctatcttagtacccttgttgaaaatcatttgaccatatatgcaagggtttatttccaggctctctagtctgttccattggtctgtatgtctgtctttcttttttcaggaaagtacagtgttcaaactacacagtcttgattactgtggctttgttttaaattttgaaatcaggaagtgagaagcctctaagtttgttctttttcaagatggttttggctattaggagttcctacagattccatatgaattttaggatgggttttatcttcctttcttttttattttttttatttttttttttgagacagaatcttgctctgtcgcctaggctggagtgcagtggtgcaatctcggctcactgcaacctctgcctcccaggttcacgccattctcctgcctcagcctcctgagtagctgggactacaggcacccgccaccacgcctggctaattttttttatttttagtagagacagggtttcaccgtgttagccaggatggtcttgatctcttgacctcgtgatccacccatctcggcctcccaaagtgctgggattacaggcgtgagccaccgtgcccggcctttttttttttttttttaaactagacacagggtctcccctgtcacccagactagagtttagtagcctgataatagctcactgctgcctcaaattcttgggctcaagtgatcctcctgcctcaacctctaaagtacctatgactacagacatgtgctaccacacctggctttttgttgttgttgttgttaaagctagggtctcgttatattgcccaggctggtcttgaactcctaggcttggcaaaatattgggattacaggcatgaacaaccgaacctggcctgtgataggtttttatatttctaaaaaaacactgttgggatgttaataggattgcattgcctctgatgaccactttgggtagtactgacatgtgaacaatattaaactttccaacacaggatgtctttccatttaattgtgtctttaaatggatataattgaacacaggatgtctttccatttaattatgtcttctttaatttctttcaacaatattttgtagttttctgtgtacaagtctttcacctccttggttaattcctatgtattttattctttttgatgctatttaaatgaaactgctaatttccttcatgaagtgttcactgctagtactatatagaaatgcaactgatttctgtgtgttgattttgtatttgacaactttgctgaatttgttaattattctgtttttatagaatcgctataagatcatgtcattggtgaaaaaatataattttactccctatccaatgtggatgccttttattttcttgtctaattgctctggctaggactttcagtactatcttgaatagaagtggcaaaagcgggtatctttgccctgttgctgatctttggggaaaagctttcagtcgttcaccattgagtgtgatgttggctgtgggtttttcatgtatgggctttatcatattgaggaagtgtctttctgttcctcgtttatttagtatttttatcatgaaaaggtgttgaattttgtcaagtgctttttctgtatcaattgagatgatcatgtgttttttccccttctttctaatgtggtgtattacattgatttcaatgtatacattttttcttttttctttttttattgagatagggtctcgctccatcactcagcctggacacagctcgctgcagcctcaattcctgggctcaagtgatcctaccccctcggcctcccgagcagctgggacaacaggtgtgtgccaccacattggcacttttttctttttctgtagagacagggtctccctatgttgcccaggctggtcccaaacccctgggctcaagcaatcctcccaccttggcctcccaaagtactgggattataggtgtgagccaccacacccggcttcaatgtatatatttttaaatgattttaggccatgtgtggtggcttatgcatgtaatcccagcactttgggaggctagggtgggaggattgattgaacccaggaattcgagactagactggacaacatagggagagcccatctctaaaacaaaacaaattttaaaattagctgggcatggtgttgtgcacctgtggccccagctactcaggacgctgaggcagaaggattgcttgagtccgggaggtttggggcttcagtgagctatgattgtgccactgcactccagcctgtgcaagagtgagaccctgtctcaaattaaaaaaaaaaaaatgtggaactgaatcctttcgtatccatcagaggccccagtttcattcccagaaaggagtctccttcctgccctgctggtggggctgcaccctacttgactcctttggatacttcagacaccctaccatcttagccagggcagggaggtggctgggcacccaagcctggtgaccctggggctgtttgcgcttcaccccttagaaaccagtgttctctttgtgggtttccttccattctttagttttgttttaattaaaaaacaatttttttaaaggcagggtctctgttgcccaggctgagtacagtggcacgatcatagctcactgcagccccaaactcctgggctcaagtgattctcctgcctcagcctcctgagtagtggggaccacaggtgtgtaccaccatgtctggctaactttttaaatttttgtagaggtggaactcactccattcttttttattttttttaattgaggtaagacttaagtctcaggtacgaacaacaacaaaattgaggtaagatttactacaatggaaggcacggatcttttatatttttaaaaaatgttatcaggcagcctcccaaaccagaataggtttggagagactcccagaatgcacagatcttaacagcagggtttcatgacttttgtatgtgcagaccactgccacatacgagtaagctacggaacactcctttccctgaaagcacccacaggcccgttcctcacaggcaccgttctgatttctactccatccctttattttgctcactctggaacttctcacaaatggaatgctacagtatagactcttgagtctggccttttccagtcaatacagcatttgcaagattcatcaatgttgcggtcacatgtgtctcatttgtttttttgtttttgtttttcttaagcacagtgtgatagtaaatctcatttgttctgagtgctgtgtagcatctcattgcatgactacagtttgtctgtccattctctctgtctctttaattttttgtagagatggggtcttgcttgttgccaaggccagtctcgaactcctggtctcaagtgatttgcgcgcctcggcctcccaaagtgctgggactacaagtgtgatccactgtgccaggcccctgttctcttattgatggacattcttgtgatttctggtttggaaccattatgaataaagctgctctcagcattcttgaacaagttctttttgttcacctaaggtttcattacttctgggtaaatatctaagagtggacttgctggatcatagggtaggtgcatatatttaactttatttatttgtttattttattttgagacagagtctgtagcccaagctgaagtgcagtggcacaatctcagcccactgcaacctctgccttctgggttcaagcaattctcctgccccagcctcttgagtagctgggattacaggcatctgccaccatgaccggctactttttgtatttttagtagagctgggggtttcaccatgttggccaggctggtctcgaactcctgacctcaggtgatccacccaccttggcctccctaagtgctgggattacaggcatgaaccaccacgcctggccaatacatttaactcaactttatatgaaactgccctctaggcgcagtggctcatgcctgtaatcccagcactttgggaggccaaggccgggcagttcacgaggtcaagagatcgagaccatcctggcgaacatggtgaaaccctgtctctatttaaaaatataaaaattagctgggcatcgtggcacacgcctgtagtcccagctactcgggaggctgaggcaggagaatcgcttgaacccgggaggtggaggttgcagtgagccgagatcgcaccactgcactccaacctgggtgagagagtgaaactccatctcaaaaaaaaaaaaaagaagaaactgccaagagcgtttcacagtagctgaaactcatctttcctgcagcattgtatgtgcattccagttgtcagttgttccacatcctcaccacacttgctattgtcaatcttttacattttaatcattctggcgggaatggagtggtatctcattgtagttttgatttgcattttcctggtaactaatgatgtccatgattttatgtggttgtttttcaccttctattaatttgcaagagccttggggggtgttttgttttgttttgttttgttttgttttgtttgttgtgtctcgctgtgtctcccaggctggagtgcaggggcgcaatctccagtcactgcaacctccgcctcccaggttcaggtgattctcctgcctcagtctcctgagtagcttggattacaagtgtgcgccaccacacccggctaattttttagtaaagacggggtttcaccatgttggccaggttgctctcgaactcctgacttcaagtgatccacccatctcagcctccccaaagtgctgggattacaggtgtaggccactgtgcccggccaagagtttttgcatatattctgaataaaagtctttgtcagatataaatattgcaaacactctttcctaatctgtcacttgcctactcgctttcttgatgtgcccttttgaagagcaaaacttttacatttggatgcctgtgctttttgtgccctaagaagctttgctacctgaacgttatgaaggttttcttctgtttagttttggaagttctattattttcacttctacatgcaggtctgtggtgtattttgcattgattttcatgtgtgatgtgagtcaaagtttgttttctccttatggacatcccattgttttagcaccattaattaaaaggactgtcgtcttctccattgaatcaccttggcactcttgttaaaatccaggtactacatttgtgcggatctacttccggacccctattgtgttccactgatttttgtcctcaggcccaaagcataccgtattcattattgtagctggccaggcacaatgctcacgactgtaatctttgggaggccaaggtgggagaatcacttaaggccaggaatttgagaccatcctgggcaacatagcaagactctgtctctataaacaaaatgatagctttatagtaacacttgaaattagatagtgtaagtcctccaactctgttttcctttttcaaaattgttttggccattctagttcttctgcacatacatgtaaactttgtaatcaatctgtgaatttctataaaaataatcagcctgacaattgctcatgggattttgattaagattttgttgaatctataaatttggggacatagaacatcttaaaaatatctcatctttcaatccttgaacagattacatctcttcattgatttaggtcttcattaatttcttttcttttttctttttttttttttttgagacagggtctcactctgttgcccaggccggagtgcagtagcacaatctcggcttactgcaacctccacttcacaggctcaaacgatcctcctgcctcagcctcccaagtagctgggactacaggcatgtgtcaccatgcctggctaatttttgtatttttaatagagatgggtcttaccatgttgtccaggctggtcttgaactcctggactcaagtgatctgcttgtctcggcctcccgaagtgctgggattacaggcatgagccaccgtgcccgaccttaggtcttcattaatttctttcaggaatgtttatagttggcagtgcataggtttgggcatgttttattaaatttatccctacacattttatgttttttgatgctactgtaaatggtacttttaaccaccacatgtcctcactcatatgtggaaggtaaaaaaaatgatctcacattagtcaaaagtaaaacagaggctattagagctgggggaagggagggagagagagagacgtgttgaaggatacaaaattccagctagatgggaggaatacattctagtgttctacaccactgtaggatgactgcagttaacaaaaatgtatagtttcaaatagctaggaggaggatagcaaatgttccctaacgcaaagaaatgataagcgctagagatgatggataagctagttgaccggcatctaatcaccacacattgtatgtattgaaacatcactatgtaccccatgggtatgtgtcattatttgtccatttaaattgttttaaatttcactttctggttgttcatagctaatatataaaagtagatttgacattttcccttgagttcctgctaaattcacgtattaggtctagtagttgtcttatagattccttaggagtttccatgtccatgatcgtgtcatctacaattaaaaacaattgcgcttttctttcatatatatatgttcatttgtatatgacatttgcatattgatttacctataatgtacatatgatgtgtacacatatgcatacatatctatacaggatttttttgcctatgtcagtggccaggtccgtcagtgacaatgttcagtgaaagtggtgtgagtgggcgtccttgacgtgttcctgattttaagaaagcgtttggtctttcacaattaagtacagcgtaagctgtagatgtttctcctaaatgcctttttatcaggttgagtgagtttccttttcattttagttcctagagagttttattttttcgtaaatgggtgttgaattcggtcaaatgctctttctctgttgatatgatcacggtattattctttgtcattctgttaatgtgataaattacgttgattaaatgttggctgtgaaattgtcttgcattcctgggataaattccatgtggtcataatgaatgctttgtacgtgttgctaagtacaatttgttcacattttgttaaggacttttgcgtctgtattcttgagggatgatgctggcctcataaaatgagtttggaggtgcttctcccttctctattttcctaaataattggtgtaatattggcattatctcttccttaaatgtttgatcaaattaaccaatgaaaccatctgggcctggagttttctttatgggatagaatttaattattttaatagatatagagctactcatattttctgctgcttcttgtgtaaattaaggaatctgtctagttcatctaaattttcaaatttagtgaactaaatttgttcatattgatttattctccttttaatgccagtagtctctgtagcagtatttcctctttcatctttgatataggtaattttatggctttttattttcaaataaccaacattttaccttactggttttctccattatttgtttcctattttattgatttccacttttatgtttatttccatccttctatttactttggttttaatttgaacttctttttctgttttttgtgttttgtgtttttttttttttttttttttgagacagagtctcactctgtcgccccggctggagtgcagtggcgcattctcggctcactgcaagctctgcctccggggttcatgccattctcctgcctcagcctcccaagtagctgggactacaggcaccaccaccacgcccagctaattttttctgtatttttagtagagatggggtttcaccgtgttagtcaggatggtctcgatctcctgaccttgtgatctgcctgcctcggcctcccaaagtcctggaattataggcatgagccactgcgcccggccctttttctggtttcttaaggaggttgcttagggcatagattgtaaacctttcttcttttttaacataagtatttaaagctataaatttccctccaaccactgccttagctacgttctagaaatattgatgtgttattttttcattgtcatttaattcaaaatattttccaatttctcttatgagttcgtctttgattcttaagttatttagaatgtgttgtataatttcccagttgggagcattgccaagctatctttttatgattgatatttattattgttgttatgtcctagtgtatggtctacttggtgaaagttccatgtgcaactgaaaagaatatgaagtgtgaaacgtatgtgaagaatgatggtgggactctggtataatcatcttggaaaaagtatttgtcattcttgtgttaaacatatacctacctatgacctagccatttcactcgtagatgttcatccaagagaactgaaaatgtatgtctacacagaaagttttacattaacattcattgtagcttcatttgtaatagccaaaaacaacccaccagtaggtgagtggataaacaaaattggcgtatctatacaatggaccaccacttaccaaaaaaaacaaaaaagaaaaaaaaaacagctcctgatactggctttttagatgtacctctttgtattttagtggttgctctagaagtttacattgtacatctttattataacctacttactgtatatctttattataacctacttactacctacaccttatatgtactacttcccattaagtgtaagaaccttgcatctgtataattaattccattggcaaccatgtttttgctattgctgtcatatgtttttcattaatataaacccaaatatacattgttataattcttaagtaatcagtattgtttaaagaaaataagagaaggaaaaatacggtatttttctttacctgtatattcccacttcctgtacccttcatttcggtctgtccatctaagtttccatctgggaaaatttcccttctgcctgcagaactttttactgcagtttttgtagtgcaggtctgctggtaaggagtgatcttggctgactttatctgaaatgcctttatgtctgtttagggtttgaaaagtagttcactgcacatagatcttggagttgccttcttttttttttttttttttttttttaagacggggtttcaccatgttggccaggctggtctcaaactcctgacctcaagcgatccgcccacctcggcctcccagagggctgggattacaggtgtgagccactgtgcctggcccggagttggctttttcttctttctgcccatacacttttttctgatgggaagttgccaggcgtgtacaacatgtcccggctgctttcaaggttttctcttaatcttggggtgtccaagagtttgactgtgataggcctggctgtgtttctttatccttatattgcttggagtttgctgtgattctttgatgtttgtcaacaaattcatgaaactttaggtcattgtttcttcagtttttttttcctgcctcattctctctcctctcctgagacatcaggatgtgagttgttttaatattgtcgctcaggtccctaaggctgttttttcattgttctttttaatcttgttactctctatacttttgattggagaactttttaaaaatctctcttcaagttcattgacccttacttctgccatctccaatctcttcttaagaatacagtccatccagttaaatgtccaattttcacttgttatttttacctttactttttgtcctagaattttcctttcttttttctttgagatggggtctccctgtgttgcccaggctggaggtcatgcatgcagtggtgtgatcatagctcactgcagcctcgaactcctgggttcaagtgttcctcccacctcagcctcctgagtagctttcaagagtgagccactgcgccctgtcaaccatggacacttaaaaacagaaaacatagcataaagccttcatgccatgctttacagccatgctttgagcacctactatgtggcaggtaccatgctggggacaaaaatgtgaagaagggaggcccctgcagggcaagagagaaagacaggctttagagtaatcaagaaacagcattctgtgggagccctaagcgggtgcctcatcttgccagctgacagggaggactcctggaggggagcctgtgtgttgaatcttaaccaatgagggggcattagccagggcagaaagaggaaggcacagctttgggctgagggaacagcatgggcaaaggcacagaggccagacaaggcgggtgcagaagaaagtcccaggcaggagtaaaggcagtgtccccacccactgggggcccccaccgtggtggctgtctggtcctcacggcggccctccgcgggtggggtgggatcagagcttgtctgagctggtgaaggcgggactcatccctgctgtgtctgggcctcctggtgcggtcttccgccctgacatgcctgggcacctgggagctgacaggtacagcacctttccagagatgtaaggcactggatgggagactctgatctgtaaagaactggctgatgggaagcgcctgctgcattgatatggcatctccgccccaccgaggctttgaaaatcaaatactccccaagctatggaaacccaaccacaggcggactgttaggactttattattataatcactcggcccaattccagccaccgcgggcagaacaatgagccattgaatccttgcagaggtctcgcctctcccatgggcagggacccggtgctgaggccttggcagggagggtggtggcaggcctgtgcgctactgcacagcccgggggcccgtggggggtctgggcttcggtctcctcactcatcgagcaggaggcctgaagagaacacatccggatggtgctgcactctcctgacattctgtcccacattgtgacccttgtaggtcaggaactaactctgcttcagggagaccatgatgcagaagacaccagcgtccttcgcagtcctcagcatgcatggcctcgcctatataatcacaaaaagggagcctgtggggtgttcccgccccaagctggggtgcctagtataggggtggccctgggagtcccagctgggtcagaggccagcagccagggtagagggctgggcacagttggctgcacccccagctgctgagttacaaggccacaccacctcctgccggtggctccactttattctcaagcatttggtgttatttgatcaccagttataagccaaaaagattccagttttaattaggggggaaaagttccattctgtggaaccgcaaggccccatgattgtcccacgaaaccctagaggccaggacctcgccaggcttgagccaggtctgccctgcccttcggtcctgcttcaccggcaccgctggctttgcatctccatgtcctgaacacacttgggtttgttgggcctggattttcactcctgtgggtgcccagccctctgccctgcccctgtgagagtcagctaccaaccaaaaggcacagcgggggaagttctcttctgtctccaaagagtctctgcttgtccccctcactgggaagtaagggaaggctctgggaacgccagcttgggttttgggattagggtaacctgagcaccgtacaccatgtcagggctgggatcaggcaggctcgggcctaagatgctttgctgggccccacagacggccccctcgctgtcctcataggcacacaggattggctgggggccaggacaagcagggctccagaaccctctggcggcaggaccagaggtcagggagatttgagggagttaggccacgcctcgagagcaggcataggggaagatgagggacagaagggtggtcagggtgcggcaggagtgaggctcggctgcatctgcaggacagcaccaagggcccacgggcaccaggcccaggtctgaagctgcagccctgacggttcccatgatcaagtgtgcagggattaaggagcagtatctggaaaatgggcccacagtcttgcctctctctcccagggttgcccagaagacccatccagggtgttgacagcagcaatcactggcatttagtgcatggacttggccgcagggcgtaggcaccgtgtgggttgtcgtcctccactcctggccagtgcaggcagtctcggctgctgtcgcctgtattccctgacgacccgtagtgccagcccgagctggatgctgtcaccgcctgacggagcgcagggtgtctgtggcaagtcctcaactcttggccaaacttcaccctgcatggtggattctgggaacagaaatcgatgatgccagccacgcctgccgggcttggaggtgggccctgtggctgacgctcagggggctgctgcaggtgaggcccaaggagcgcccaggtgtccggggtcccatccctcccacactctgcctcccagaaccccgtcggggctgcatcacatccatttcctgggttatcagtctcgtggcagctcttgcctgttgaagaatcttctgtccagctatttcccaagctgaacattccaggttgtggctggacaggcccttgcccgcctgcccccaaccctgagctccttccttcactagcccaccagcagctcggctccctgcagccggccccgtgggacctggtctgggcaggggcacagcagagctgggatctgcacagcactggagcactggatcctgcctggaagagcacagcccagaagccccaagcacaggggggaggcccctcagcccgggcgcagagggacatgggagcacacggagccagttcctccctgcctgccttctgctcggggtggcagccaggacgccagcgtgtacctctttatgcccctgcctggtccaggaagaacctcaggcagcttgcagggccatgcagtgcccagccagagagcccagctcgaagatggtggtagaggaaggagaccaggctgggcataggatgctcccgtgccaggctctgttgagctctgggcttccgctgggagggctggggaggggagggccagggagacagaggtgggctagcccaaggacgcagcctgggggcccatgggaggggtcttgtgggccagtggccctaccaggacgggcgtggggctgctgcctagggctccatggaagcccagggagtgggatctggaagtctctctcagcagctggctggctctctggcctggccaagcaggcaaaagtaggggccaaggtgctgggtggatgggctgcggggtccctggtggcatgggggcccacgtccaggccctgctagagcagtcccaggtggggggtagctgggttgtggagagggacaccaccccagcacactcccattctagtcttcgccccatgtgagttgggctgaggcccccacatgggctgggaggtccacagcctgtgcatttggggccaggagagggcatcttcctctactgcccaagagtaagacctggcccaggcccatctggatggagaggcagttcagagggagatgcttcctgatggggcgccctgtgcctgggccttaatacctgtaggggctgcaccacctgccctggccactgatgctggcccgctggccttgggtgtagaccccctgctgcttcctgctccagagggtggggatccccgtgtctggcaatgaatgacccacaccaaccctcctggaccctgactaggcccaagggtgggaagtggcgatgagtgagggcaggtgggcagaggccagcaggtctcatcaggctgggcgggaggatctcttgcccaggacaggggcactcagggaccctggggaggagaagtggctcccagagggacacggggtggggcagcagcctgggaccgagaccaggaggctcaggtggctctgagctctgggaggcaggagtggcccccacccaccagcccaacgcagacaccaacacgcttctcatgccacccactgaagccaggtgccaacctgtgctctcttggggagggatgtgagcatggggcggtgacgccactaggatggagcctcaacccgaggtggcccaggcacctggagcctcaatagggcctggaggggttagtgtggcctcatggccctgccccgatgagcacactgcccagccacctcagggcatccctcattaaaggtcttgggtcacctccagttcttgcccagtgtgtgaggggtaggtgggggcctcaggcctgcctctgggtcctgcttcaacctggggaggggaccagggcccagtgcccaggcactggcggcacctccaagctgctgcactggggctggagtggccgtgggccaggtaaggcaagcaggtgtcagccgaggtgagctcatgtgccaagaccctgtgggaggagcccaaacccgaggccaggaaacaggtgctctcaactgcagccccaccaaactgcagccccacctgacgctgctgctctcacaggggcagccctgcctgagggcctagccagcactaaggtcacctcacggccaggagagcagggccgaggtgcccgatggctgccaagtgaggctagggccaagcaagggtgcagcatgctcagggagggggctgcagtctgagcatctcagttacccctccccttgagctgatgacccctgctgtaccccctgtccactcctcagagccctgccaggccctgccctcccctgctgccccgctgtggccctcgaagccctccataactgtgtgtcccctcccctgcatgtggaccacccagggggcctggggaactgcccaatgtcactcaggggtgttgggggcaggagagggtgacactgccccatgcagggtgtggcagagaggggccactcagcctcgctgggcagcaccccccgcccacttctcctgctcccacgtctttgcgagatccggtgccacagcagaagtgtggaggatgtcgccgggggtaattgcaggttacacagaacaatctgaggaattaaagtcatatttttattgcaccataaaaacatgtgaaggcggcaggacggcggccgcggggccaggcggagagcacccggctctggccccaccctgcactccctgggccgtctccagggagacgcaggatcgaaaccactgttggcccagcacaccggtcccacgctgggcaagggagaccgggagagcggccgctttgcccacattgccctgctgggccctggttcctgccctggctgtgcagctgcctgggtgggggctctgggccagtgtcccaccagagtagtgaggtgtggggatggcctgtgcctgcggggtcccctgggcctggtctgcagccaggtgcctgccagttcagcaccggccctgagagggcctggggcagcagtgctggcctctttgtggccactcttcacctgcagcacccattgcttgtaaactgggctggacccctgcctaccacttaccaggagggtatgagcccctgtgcagcaggagcccaaggacccacggctgcctgggatgtgtgtggtggatgttttggtccctcctaggggatgtgcaggccggctgaatgggccacacagcgtgggagagccgaggtcacagagagcaggtgtgtggtacacggtgtgttctgggaagaaggggcacgcagagaaaaccacctggaggggccagtggggacatggacgtgtgggtggctctcaggccaccagcaacaggtactcctggtcggctgggcagacagggaggcaagaggccctcccggcagaatgcggcccagtgtgtagtgcgggctccacacagctgcatcctctccatcaccacaaaagcaccaaggccatttcaagctttccccatgctccctggcaggggctgatcccagggccaaggaatccacaggccctctgcccccttcctggctgctgcccagagccaccccccagagcccaggcagcaggtgtaggctgacctcccagcctggcggtgcctccacggcaaaaaaaacttgcaggcctagaggcgagccccacccacaggatccggcccaggcatgccaccagccgtgtgttaaatgggacacggctgatctagagctgcacttgtgggagggcctggcccagcacttggcatcttaagtgggcgtctgagagctcacgcgcacgtttcacacagcaagtcgggctcctgcaggcccattaaggtgcaaaggcattcctctgtgtgctgacaagcagggtcccatccacggctccgggccggcagactaagtgatgttttcttaaggaagacacgcgattagccacagctaaagccccagcacaatgcagggcccggccatggctgtcagcgctgtctctcggcagtgactgacaggcactccccagcccatcaagcctcaatgcacaggattagcctgacgcagccgacaagctgacttggagggccacggtggaaaaccggcaaagtgactgacatccggggacagagagcctcacacagccctgctacctcctgtcatgggcctgcctgctggcgggctgttccagaacaaagccggtgttgccgcccctcccaagagcctccctggcactgggctgcccttcttgcttcaaggtgcagagacctaggcagagggtcccaggaaaaaccctcagtgggcgtcttcaggccagaggccaggcagctgtggggcaggtggggcggctccgcctcctgcctaagtggggtccctagcactgcaagtctgctcccctctgcccagggctgcttggaattgtgctcgggggttcaaggggccccagcggactctgggctgccctggatggaagctactcacgattgaagaggggcctggtggcctggccagaccccacccacctgggcgatcctgggggaccatcagggacaccgcaggcagagcacacttcagaaaaagtaccctctttatttgcattgcagaaatgccagggggctcggacatgggtgcccacagggtaggtttccacccaggtcgtcatcatctggcaccaggagcctgggggggggtgcccggcggcagaggctgagaggtgcaggggtgaggtggacagtcccctgagccatccctgtggggcacacgggccacctgtccagcacttgcgctccacgctgaccatctcacaggcgctccaggagagggttgaggccccccaaacctggcctgcagccatcctgccaacaacaggaaggtcagcacaggtcagccacccacccctcacatcagcctagctatgtctcccactgccacacccagggacccccaagggagatgggtgagaaataaacccagcagagaatggccccaccccagggcgatgcgtcacagggagcgacgcggtgctacaaaaatattttgaaatgataaaaatttatagcaggctcctaacaaaacagctctgggaggtgtaatgttctgataagagtttcctcaggatgccctttgtttatccctatcgagcgcggccccgccggggggaggcggccacggtgaagcagggggccctgagtacccccagagaggcctccccagagcccctcggcgccatgcagaccctagagcctgtccacaggcatcttggggggagcccactgctctgcctggtctccacctcagccccgggggagagatggagcccaaacaccccaaccctgggaggggctgacagccatgggggtgccccaggtgggctggatggcacgggctgagggcccaccctgccccggcccctgccctgcagcccaggccggaggatgcactattagaccacgaggcgagggggctctggcacaggcatccctggggcagaggccaggagcccttgccagtttcttcctccccagaagaggtcacgatgaacaacatgccccccggtcagcctggctctgcagagctggaacagaaccagatgtgcagggcaggctgggcagggccggccatcacagggcagcgtctccaccttctgggagatagggaaatgagcgggcgctgaactctgcaggagccaggccttggtgggaggcctcggtgggaggccagcttcccgactgcagccccctgtggggcagcaacttgagatgcccgactttagcccacccgggacaccttccacgccaacatccacctgggataggctgctaaggatgagccccgtttcttgatacctcctgtgtgtggggagcagctgtggccaggccggggtctggggtcccccggggaggtttgggcccctgggaacttccccttctgcctgtcaccgctgtggcctggttacaggatggagcacccattctgggtggcgtggcaggtgtagccttgctgtacacctggagggagcccatggccagggctcctgcacccctgccacatgccctgtcctcaaacagagccagccccacctgcatacctgggtctggcctccgaggagctggcggcgggcgcaccgtgtgccctggcctgcagggatggcgcttaccctcagcagcctgtcaccgtggggtccaggcctgagcgcttggagatgcgcagcttgactacctcctcagagcatgtgggatggatacccacggtccgcatcacctgcgcataggaagccccacacctgcacatgggggatgggggaggcaggcggggtcagcacagggaggggggtccacagcatcccacccccgggaagaggagggcctcagaggctgctggtctcctcactgtcccctgacccccagccagcagccaggacccctgcccacacccgtgggtgccatccacctccctcccagcagatgcctagtgctcgtccagcccacctcccacccagccacgccctggcttgccctggcctggcttcctgctgttccatcctcccctgctaggcacagtcctgccttaggcctctgctctctgctttacccacagacagcgcatcctggcctcaccacaccaccacctcccaggccccacatccagccagccacctctctcaggccatgcacaatgtcccaacctccaactacccctgtcaacccacccagagcctttgccatggcttcctttgaccccgggaccccgaaaacacacagcctgagcccaagacccaggcaatggccccagctccagaagacacacagcagccctggggtggctctccaggtactggcactctgctcatggtggcgtggtgcttggccaggtgggcaagggccctagcagcgacccggggccacaggggacacctcacctggctctggctggctcaacagcgtctggctggggcagaaccgcctcttgtccccctaaaacccgccctgtctgaggggcctgaggaatctctgctgcaaacccacgaaggccacataaatgccgcaagagtggcagcagctctccactgtaggactgccggcactcgagggatacccagctgcacatcgcatcgcagcctgcattcctcgggacttacttgatccccagagcaaatccttgagtaacttcgcctgcgttggggccaaggaaatgcaggcccagcaccagctgtgggggctccctcaggcacaccatctgaaagccgcacatctcagccaccagcccaggagggggctgggttgcgtccaccctgcatccaccctgcaccctgcctgggaggcatgggtggggccagtcctcgggtgttcaccctgccaggctctttgccaccctccctctcatcctcagcaccctgggccacagggatgctcacctttacataacactgggatgcatctcgtccagccaccgtgaactccagtggtttataatgggcgtgatagacctgaggacaggataccaaccctggatcagtgctgcgacaaacaaacctcgtggcacctgcagctcccacaggctgcatgggcaaggcagggtcatggcgggcaggaaccatccatctggcctgaaggtctggtctgggatggggatgagggcttggctggccacggggtgtgtgcaggccctctcacgtgcaggcagccagtggctggagccatgctctgcaggacagaccctgtcccacccaggcctgggacccccgtaaaccacagcagcagagcaggcatcaggcaatccaagcagccaggccaggcacagcaaacctgggtggacgtagctcacccacaacaaatggtggaggcaagaatgggtgagcaggaggccacctgggctccctcaggcaccctggtgtttgcttggccctcactggagcaaggccgctgtggccacaccggagccggagctgttggacaaaggctttcagcacccctgaagggctcgacagcgtgtccggggctgcggccaagtaaaaaatgagtggggccctcacatgtgctgtacagccattattaattaatggaacttcagagaatattgttctaactaagacagaattgaaaagaaaacaaacagagtatttggccattcaacattgtgaaacataaaacaacattataaaatgccaggaacatatgtcccagcacacttgtgatgaatcaaacaaaaatagcaaataaagtgcctcggggaaggctggcctgtcaggcccgtcctgttgatggagagttctggggtgcagggggaaggggccagccctggagcccagtgtctcatccccaaaggccgcaggccccaccgcccaggctgcaggctccggtttctctgggtgcctgcaagctgcagcggcagcaagatgaaaccgcaccgaaggcttccagctaccacggcccggcaggcttcagagcccccgcatccctccaggccaccccggagccacagccacctgccagagcagacccccaaagcaggcttgctcgatgaaaacccctttcctcaagggtgagtgcctgagcctggaagaagctggaagaggatgggtatcaggatgtggtggggggcggggggcggggggctctcgcctgggagaaaccctgggcagtccaggaagacgaggtgcagggtggtggggggggtgggggtggaagcagaggtcggaggcccctgggagaaacttttctgggtagagtgagattcatggccctgcaaggtggggacagcacagaggcatcttcggggccctggtgctttcagggacaagctgctgtgtgctggagtggggccagtgctcagctgacctcagcaggggagcgggtggcaccgtggtggtgaccctgctggtgctgggcacccctgcagcatggctggggtggggctgggggcttctgggccacagggcttctccttgccctcagaacaaggcagccaagggccttcccctcactgctgtgacacatggtggcagagaccagaggcacctaagcccagtcaccccaaggctgccaaagcccaggcacccccacttctgaggctgcccccaacgtgtcccttcccgctacacacagccactgctcagggcccctggaaaggagagaccttggcaccctgctcacaaggcctccgcccagagcatggggtgaggtcgtggagtcgccactgtcctcagctgtgctgctcccaggcctcacctcaacatgctcctgcccgtggcgagccactgcctcctcctcggacagccccacacagccatactccagcggggtgaagacggtcgtgggaacctgaaagcaggtctggagtcagggagggcccttgggccccgaaaaccgaagttccccactgcatgtgacacaaagagcagcgatcacagaccaggaccagatgcgcccagagcaggctgcaagcacagtaggcgacccacctgcccacgcctgcgccacactctcagaactgagccacacacccatgcatgcacacacacgtgtgtacaacacacccacataagcgcacacacacgcatgcccacatctacatgcagacacacagcgcacaaaggcccctcaccccagaagagctagcctcgaactcagcctgtcctaggctgcacgtggcgtcctgctagagaactcacattgtcgtagtccatcagatctgaggacccgccgaagagccgctgcaccaggagcctcccggccatgatcgctatgggtgtcagctcaggccgccccttggggaaggcacaggggggccacgtcagcaccatgtccggggttatatgcagcccctatgccatcaccctttgccctccgagtgggcatctccctttagaaaatccccaacactggcaccgagcatggtgacgtacagcattccccctagagctcgtcctcctgaggggcatcccaaggacctaggtaggttgctcattctcctgtttgctgccctccactctgccctgggaaaggagtccgctgctgatgaggctggccgtgccaccctcacatgctcaagccttctctccaaaccccttctgcacattgctgacctcggagggctgccccatgaccaagctcaaaagagcccctgctaccgttttcattcactggaatccccggctaaaaagggaccccaaagcgttccatgtgctcctgacgtgcagcttgatctgcacgtcacagtccataacaaattccaaatcagaatgtcgctgtgctggagatccctccgtcccagggtgtgcccagccttgggggttccagcaccgtcctctgggatgggctgccaatcaccatggcagcaggaaatgcagatgttgtttggcattccagaaatgcatagagatccgtggagataaactcagagcgcagcctgcgcattccagcaggcctgactaactacggaaacatcccggcgggcggcgcacagcacacaacatctcattaaacaatagcccccgccccgcccacaggctcttcccagccgctcaagggaccactggttgggtgttaactctttggactattcagaacgacctttctgacagagtggatttaatgtttaaataaagaatgcctttgtgtgcgccatgcatttctggcaaaacggtttgaaatgttccagtttccaacacaggagcctgggagctacacacttgcagagggaaaactcagattcccagacagaagggaggcttcccgctgtgcacagagatgcacatggcactgtctcagggtgcagcgcccacaggattcaacagaccctgcaaccagagaccactgcacctacatggtccacaggcagaggctgcgcttgcagaaatcactgagcagctgaaccatccagctaagcaagctggggctgcagggtggctgaggcacatggagccacatgctctgtccacacaatcgggtcggctagatgggccctacaggaccctgcagggtctgcctggagcctcagagtgtgaccttatttggaaataagatctttgcagatacaattaaggtaaggatggaaatgaagtcatcctggattagggtggaccctaagtccaattgcagagaaactgtaagaggcaaatcagggcccagagacacacccaggagactgtcacatgacgatgaggcagagagaggagtgatatagccacaacccgagggacgcctggggcatcctaccccagaggcttccgagggagcctggcccagctgacactttctgacatggagtctcgctctgtcacccaggctggagtgcagtggcacaatcttggctcacggtaacctccgccttcctcctcccgagttcaaatgattctcctgcctcagcctcccgggtagctgggattacagatacgtgccaccacgcctggctaatttttgtatttttttagtagagacggtttcaccatgttggctaggctggtcttgaactcctgacctcaagtaatctgcctgcctcggagtcccaaagtgctgggattacaagcatgagacactgcacccagccccagctgacactttcatttcagactactgccccccaaacgtgagataatccatgtctgttgttctgggccacccgtgtgtggtgatttggtaccacagccccaggacgcagacactgacaggtctcgctacaaagaagctctcagcgaccctccagagccactttcagcagcaggtgctggacacatgcaggacaggccgagcactcctgaggctgccagggtgcagtatcccaagactgaccaccacagtcccttactggggccatgtgtaaggagggctccagagcccccacccaggaaagactggcaccggtctccacttcacagcagcagcagcagctgagagcaaaggacctgccccggtgtgatgcccagagaggcaagccagaggatactgaggcggggagggcggggccaggtgggcccgaactagacctgcctctcaaccctgtggggacaggacggccccaaggccatggtggcatttctaagcctatgcctctagcctacctgccaggggttgaggcctgcgtgcagagctgacccatgccccattcccagcaggcgtctgctgctggtgcttgcagctgtctttagaccatccacactcccaccacagaaaggaaaggaaaggcagagagccgaggcccatgtccaggttgccccagaactccagacaggctggccctggggtttggcccagagcctctgtcatcagagaaagtgtcgtttctctcctacaggacggcagcagccggagcccagcgagcaggggtggtggagcaggcaggggcaggggccctggtcccgggacgcatgccgtacctccaccacgtcaccaatggcgtagatgtggggcacagaggtggcttcccgggagtccaccaggatcttctgagtgtcggggctagtatctaccccagccttctccaaattcagacttctggtgtctgggactcgacctgaaggaaacagagagggggctgaaaggttatcttcagtggctttgacctagagcggttgtgtttaaactgtttctcagaatgtccacttagagaccgggtgcagtggctcctgcctgtaatcccagcactgtaggaggacgaggtgggcaaatcacctgaggtcatgagttcgagaccaggctggccaacatgatgaaaccctgtctcagccaggcgtgatggctcatgcctataatcccaacactttgggaggccgaggcaagtggatcacctgaggtctggagttcaaaaccagcctggccaacatggtgaaaccccatctctactaaaaatacaaaattacctaggcgtagtggtgcacacctatagtcccagctactcgggaggttgaatcgcttgaacccaggaggtggaggctgcagtgagctaagattgcaccattgcgctccagcctgcgcaacaagagcaaaactctgtctcaaaaaaaaaaaaagaaagaaaagaaaagaaagaaaccctgtctctattaaaaatacaaaaatagctgggtgtggtggcatgcacccgtaatcccagctacttgggagggtgaggcatgagaattgcttgaacccgggaggtgtcggttgcagtgagccaagatcacaccactgcacttcagcctgggcgacagagtgagactgtctcaagaaaaaagaatgtccacttagaactggccaaatgtgaagcaccagcagcgtagaggggctcctggcctctgcaggaggtggcaggcaggtctgaaacggacactggtcagatgacagccggcacaggagacaaggcaggggtgccaccggtggaaactggagtcggccttagactggttcctggcacgcgggaaaggaagaggcacttgccaatgctggggctccctgacatcaaagagtgctaagcgcgggactccagaatcttccgcatgcccaggcctcaggccctgctgcagggccaccagcacagtgccagtggctctggtactgacttcatccggagaaaccagcccttcatggggagctgttggcacctggcctgcctggcctccctgcatctgtctgcagcaccacagcctgataccattaggcagtgagatccatcagctcccaggcctcaagagtccagaggggcctccttcaagggacacctgctggctcccaatggcctcctccctatctggacaagctgaagaggagccagccacaccctggactgtaccccaacaatgctcaagtcctgggatctggccctctgcccaggtagggcttgaaggtctctccccattaggagaaagcaagcccccgtaacccgctagtagagggccaggtgagcagagctagcagccgggtctcccacctgctctgtgctgcagcccctcgtggctgcctggcacacagtcccagcctagagacctcagggccaaggggagctgagctaaggggcagtgtccaaactacaccgtgcccattctagggggcagctggctcagctgatcctgctcttgggtgcaaaggccaagaggggcaggggatggccagtccagggggtcagcacagctgccccctgccagtctccacacagcctggggcccggagagagggcaccgcatgggcctcttcatagccgaacagccagcagaggtccctttctcccctaactcagatgggtgtgattttgccaggccagcggatggccacagcagcttttccctcccaaccccaggtgctctcggctcccaggggctcaggatgatccaccaatggcgaaggcaattttgcctcaaaagcatagctcccctgctcatcgtggctgggacaaaccagctgctggccggtatgcgggtggcgcccacctaagcatctggaagctgaagctcccgtgagagggaacccttaagtctccagctgctgtcccggggcaggagtcaaaacataccaacttggctaagccagcttgcgggaggccggctccagcctctgtgctctgctcagccgcaggaattgggtgccgggagggctggcaccggtcggggatcagcccagacacaggggatgccagcccacatcagaggaaggagctgggccccatgggcagggctggggcacgaaggaggggctgtggtccctgcaggccgggggctcacgctcagccgtctggtccctctccaacctggtgtccagcccaccaggcccagcacttcctggtgcctgctccgtgccggaacagaacatctgacgctgcacccacactctcctctgcacgcttgcctggctggtcctgggaagccaagagcactcatcatgttcctcatggtaactatggcactatggcaactacagaccttgcaggtgctgaccaaaccctgtccccaggtcccgaaggaaataaagataaatttaaaagtagtcacaagagataaaagaggcatggaaataggtggcccatccaaagccaggactcttccgcacatgctctgtggatcactctgggaagtcggtgggaatgtaatggagccactaatgtgaaaggcatgacagctggacaggctggatggccaggggagagtgggctgcgcggcacagacacgcctggccctgcagggactccacagcccttcgggaatgaacagcaaaagaagagtgagtggcctgtggcaggcagcaggctcagccctgaggagggcagccgagggcacagtggggttagaagctgggctggtgggacgtggctgggagtgggtgcagggaagaggccagctccacttgggtggggccacgtccctagccgtggccagccctgatggcaggacaccaggccctgagccccactatgggtcttgctgagcaaaggactgggcagtggccagagaagggccagatctccctgctggtgctggacagccaatcaggcgtcctaggccctactggctcaggcctggagccctgcaggaggttggacgacttgtgccaaggtggggacccactggggcccgaatgctgtgagcagcaggatgcaggtggctgtgcccagtcagctccccaccatttccctcctatgccaggataaagcagttgtgcctggtcagctcccgaccatttccctcctatgccaggataaatgtgcactattcaggccatttagggaaagaagggtgcctgcaccggtgtctttcgccctgcatgttgtgctcagagctttcccagctgtgcctgtggcccactgcaggcctccccatggggcggctctgtgctccctgcagctccgtcctcgaagccttggctctggagtgcccagtgcagcatttgccaagtgctgctgaatggcccctcctggggtaggacaggcactctcaaggctctgcttcctagacaccaccaggatggagacctggggcaccagcttgccatgtgtcagttgagttcctggggcagaccctcaaaggaagggcggccagctgagtgggggcttctgggcgcagggcagtccttagactctgttccttcctggggcaggcggcgcacagcactctctgtcatgctgctttaatttgcacttctttgatgactagtaagatgaagtaatttttggccacgtgtttatgaactgtatttcctcttttgtaaattaccagttcctgccttttctcatccatttataggcatcttcaccatgttccttctttgtaagagcttattacgtaatggatacatgacactctggcatattttctgcaaacgacaagggcattaaaattccaggtacagctcttcaggctgtattcatgagcagtcgtgggccacgggattcgtgggcagaggaagggcaccagctctgtgttccttgtgcacatgaagcaggagggctcataggcctgcatgctgtggacttagctgagcggcacagctacatcaagggcaccttgaaggacatgcccctgctgagatggtctccaggatccacaccagtttaagcagcagacagagctgtccatcaccaccaagggcctccacacgggccaatttctgtttgtgtactgtagcaagagggcccagctggacgtcggcagcgtcctccctgcaggcaccacacctgtaccatcaagcgctgcctggaggagaggctgagactggaacttgttagcctgggcctttgagaactacaccgcagtcacctcccctagcccggaaaccaggaagacttacatgaagctgccctccaagaggatcatctcagccaacagagctgtggtcaatgtgggagccagaggtggccgaactgaccagccatcctgaaggcaggccatgcccactacatataaggcaaagaagagctgctgaccatggtgcagagtatggccgcaagccccaaggaacgtcccttcagagatggcaaccactggcacgttggcgaacctgccactgcagagatgtctctgctggtagcaaagtgggtctcattgctgcccactggacttggttcagaattggggctgatgggcccaacaaagtttgtccttctgccaaaaaaatagtaattccaggtacaaatggacgtgctcacttcctatgtatatgtgtggctggcccacaacactgacactcaggaagcactgggctgagcatctctgcagcccggagctgcctccagccccaggcccagcagtgcagcacccctgacgcaggacagcccatctccatgtgtggccagtgctaggaacagccgtgcagggcagccctcctctgatcacaatgagagccccaccagctgctgtcaatggcccaggagatggagggcagccaccatgcttgtccagccagcctggccccaaggagggaccagagaaggctgaagcccaaaaaccacccacacagtcaccatgggtcactcccatctattctgatggacacagggacacggggacggccagccgcatgcagtatcatgcgcctctctcatccatgatgggaagaacaggcatgccctctgatttcacgcccgcctgggacacattttcccaagagaagagcaaggaggcagcgccccaggtgagaggtaagtgccagcaggagtacagcagggtgagccagtggctgtgatccagacagaggcagccagggccaagcactgcgcctgaggacgagggtgtgggagtgggaggctccagggccggtgggcgatgcgaggcgggcacggcttcacacacaggccctgtgggccacctggcgactgtctcatgaggcatgtggcccccagagccagccaccctcacggggcctggcctgccacttgccccagtgaggcaccttggaccaggcacagaggagcgtatgcctttggaactggacttagattcttgaagcttattattttaaaatatttatcttctttttttttttttttctggaatcgcaccttctcaatgagccccgggcccctacccgcagctatgagcccaccagggggaaggggacgcacctgccctgctggcctcaggtcccatcgagacgccatgttagttgaataaatgagtgagcccctgggcctcaatgggacctgattggccacttgctgtgactgccagcagccaccagggacccctaggccgttccagggatgtctcatacccagggcggctccttggggggtgggggtgagcttcccctcaggcagcataagggcctttcctactcaagctgcctatgtgcattatgatgtgtaagaccccacagtcagccttggagtacggcgcagcccccagctcaggcccagaggacccccaggaaggagcgtgctctgtggcgagtggtcattattgctttaacagttattattagaccgggtgcagtggctcacgcctgtaatcccaacactttgggaggctgaggcgggcggatcatgacgtcaggagttcgagaccagcctggctaacacagtgaaaccctgtctctactaaaaatacaaaaattagctgggcgcggtggcgggtgcctgtaatcccagctacttggaaggctgaggcaggagaatcgcttgaattcgggaggtggaggttgcggtgagccagatcgcgctcctgcactccaacctgggcaacagagctagacaccgtctcaaaaacaaacaaaaaacaattattattattattattattattaattatttgaaaagaggtttcactctgttgctcaggctggtcttgaactcctgggctcaaatgatcctcccaccttggcattccaaagtgttgggattacaggcatgagccacctcacccggccctttaacaattgttaacataattgcaattgtaacaggttggctgccccagggcacctgcagacattagagggtgcatggtaatatgcataaatggtgctgacctatctctagaagacttttcaccatgttgttcttttttttttaattggtttccactcagttctaatcattaagtactgaatttgtcatggtaacaagacccagttggacaaccatgtatgcaggtgccggctggcctgtcagatagctgtgggctctggacataagtgtgaactagccctcaagccaagcgtggggcaccaggctggtgggtaagcacagggcgctgcctcctgctactctggcctggcctctgtgaggtgttagcaccaccatgagctagggctgagccaacagtgctgtctcaggagcagcagcgcacgcccggggccacgtggtgtggaggggaaggccgcagccaccgctcataggaagagctccatgaatgttcatcttggccccacttcaaaaaatatcaaactcacaatggaggcagatttgggtctctcttgatgtcattaattacaaactaaatttgcactaaaataaaaaggtgttagactatcaaagaggggcctccgatccgtgtcacctgctcagggatggccactccaccctgagagcatggaggcatgtggatgccagggtcactgctgggcccatccccaccgggaagagcatagccacaaacttggtttcacgcagctgcagcaaggcgcatccctgagagcagtcctgatgggcccaccgcagccccctcgcccgggcagcatccacacccaccgcggcccctaagccccagctgcacccacaccagcacagagggcatccaggaggagccgccccttccctctcaccaggcttaggatgctcccacccatccccagcttggttcttgctttctgccctttcctgctgcctggcactcaacagagggacaatccgcagggacttgtgtagctgagtctgcggtgtacgggagccatcagccgagcacagctgagcaaagacagttgcctgccgtgtacatgccagcaaacagtgcctgggtggagagaggagcccagggctgcagcccaccctggcaacagctcccctcctgggcaccgccagcccccatcatcatctcctgggcaccccagtctctctggctgtggtccaggcacacgtgccacgtgggggagactatacaggggcaggctgtgggggtggcctctgtgtggtgccaagaggaagccgggaagccaagctcccatgctccatgcatgttgtgtttcaggctctgatgctggtttacacacaggtggacatctctgagttatctaagataaagcccaaagaggaaatagcttcagtggctggggtaagatccagacggattccttccctgggtctcgtctcacctgccatatcacaaggccccaggcagacctgtggccaccctccctggcactcaggcacaacagctgcctggctgtgggacccccaggtttagcgagtcccctcctgtgtctgctggctcttctggccatgggcaggactcctgtggtgcagggagggatacgccagagccttcagcatctcaccctcaagagagggacagagaaccatccagaggggctggggacgccaaaggggcacatgaagatctcaacttccagtttttcagggctgcagtccagaggcagtctgtcccttctttaaaaccaaatctaaacttaactgcacttagaagcccctgcactgggaggcgtttgctcaggatgccccagcctggccctgctcccctagacagccagggattcaggccacaactggttaactcagcgggcgaattcgagcccgcagcagtgctggctgactgtcttcactcagcgctgtaatcggcacatctgcagacaggaaatcctcctcactgaagttcccagtctattatctgagacacctggtgtgggcgggtgattcagagacaaacaatgagcgggggccccctgcacagcaattaactgctttaactgctaatatgtttaatccaccacgtggagatcaaggctgcgtcgaggaaggggctctggtcctcctctgcttccagactgcagggcccacttcgcaatgccaatgtccatggtcctcgccagctgcggccaggcgccaggcacacgggcaacgggcagggccagcactcggccccacacgggagctctgtgcagcacctgggccccttctgtgtgtgtgtgcaccgggcacggaggcatccccccttcctgtcggagcccagcttgtgcggacgtagtgcacacccggtacaggaagcagagtcggagatgttggcattgccagctgtgccgcccctagggcgctttattttaacctcccagagtggatcatcctttattgcaagtagaaataaagcttggttaaaggcttatcgtacaaaccagcagaaaacgctcgcagttgctgacctgggaagtggctcctgaatgtttacaaaacctggctctgagcagcagcgaagtcagcacatgcccgagcggcccccagcaggcgcgcagaagccgcgccgccctcgggaagcagggtcagaggccaaggactgtgaaaagcttccacccccagcatcaatcatgccaggcagactgtctgggggatgctcattttgaaagtacaaaaaaataaaacagactcctagcaagggaggatgggcgtgcaggccacggcagctctgctgagtagggaggggcctcgcttgttgcctgccaggctgacgccccggctttccggggacacagcccccggcccattggtctgctacatccctatgggcttggtcgagggctgcccctcggttcaatggcaacagctcccttatgctgtgggtgaacggaggtgtcagcagacagaggaggagggctagggcgcggtgggagggagaaactcgccacctcccctttagagtggagtttatttgggaatgacagtaggaggataaattttgaaagaaaaataaagtggagtttaggatgagaaccatcagtacactccagagtccaaaatgttacctaatccttcgtagtgtttatcataataaacttacttaaaatctacttttacaacgtggctgagaacattgctcttgctgactgatcacctccgggccaagagccctgcgtgcgctcaggcatctcaggtcctccccggtcatcacctctgcgcttgtgtccactgcacaaaagtgaagcctcagccgctccaggctggtttcctttctgatttcccattccgagtgactgcttcagaagtgcatcaccctatgacacagcttgtgcctctgggagccctcccccaggagacactgacccctggccagccccacgcaagcccggttagctgatggaggtggaggcaggtgatctgagagggaccctggctctgatcttgggctctcgcaggggacaacggaccaggctcagcacagaaaggcctcggagaactaacaacactgactaggttgctcccgccttcaacatgcaagttgacagggtgattgggaaaactaggagcctaaactagacggccaggcaccgaggtgggtaggacatctgagcaggcatgctgtgtgtgccgccacccaccctgacgaggacccgcagccctccttgcggcggcccatctgcaatggcctcctctgcagcaggcctgggacagagcagtgtctgggcgatccctgttggctccagctgccccttgccagtcccgtcagacagccccggcccaggcctgggcacaggtatcccctggctgtgtccacactccccacacctgctcggccactgccccatgcaaaaccggacctacacctgacagagagcaagaaggtgagaccagactgtgcccagcaagttgtagccagcccacgcctggccgggaaacgcccaggcctctgcccagcactggaagggtgatgtctttggaagccttcgaaatgtgacttctggaaaggcctgcaaaatgccactcctggcatgtgatgacctgccaggcccaaagggacccactgggaaacactgaaagccacgagaaggctggacagaactttaaaaactctgtgtcatttttatgtgctgaaaacaggcggcttgtgcacacccatgttcacagcagcatgatccacaacagccaaaagacggaagcaacctaagtgtccactgacagataatggacacacatacaactcagccttcaacaggaaggaaatgctggcacatgctacacaaatgctaactctaacaaatgctgcaacatggatgcaccctgaaaacattgtgctaagagaaatgagccagtcacaaaaggacaaacactgcatgattctacttacatgaagtccctcgaggagtcagatccatagagacacacagtgaagggtgagtgcccgggcagcagggagtgagtgtttaatggggacagagctcagtttggagataatggaaaagttctagagatggatggtcatgctgcttgtacaatatgaacgtacttaacaccactgaactatatactttaaaatgcttaagatgatgaatttgatgttatgtgtatgtcaccataatttttaaaactttcaaatccatatcatttttatgttaaaaacaacaaactagcttggctgggcacagtagctcaaacctgtaatcccagcacttagaaggctgagatgggaagattgattgagcctgggaggtggaggctgcagtgagctatgatcacaccaccacactcctcctaggcaacagagagagaccctgtttcacacgcaaaaaaagaaaaaaacctagctggaaagcctgaagcagcaaaacatttaatatgctaaagaaaaaatacatactggccaggtgcggtggctcacacctgtaatctcagtactttgggaggccaaggcaggtggatcacaaggtcaggagattgagaccatcctggcctacatggtgaaaccccgtctctactaaaaatacaaaaattagtcaggtgtagtggtgggcgcctgtagccccagctacccaggaggctgaggcaggagaatcgcttgaacccgggaggcggaggttgccactgcactccagcctgggcgacagagcgagactccatctcaaaaaaaaaaaaaaaaagaaaagaaacataccaagacttaaacctggaaggtgacaagtaggatttatgtgctgaaaccttaataagcaattgctcaagggccagggaaggcgaggatgattgcctagttgatcctcgatgaggacacctggctgatgccgtctcagtctcttctctggttttttccagcatgtcccacggtggtggggagacacgcagagatgcaaggtgctggggatggcaagatgggcacagcctagtgtgagtgccgccccacaggccttcacggttgctctcgaggtgcactggggagcggccaacccgcctggcagccagcaggatgggggagccctgggaggtgacaggaagtggggcaaagattctccatgcacctcggggagaccagagacagagcgtgtggctcgacgtgcccttacctatggcccacaggacggtgtcaaaggtgcccgtgtcctccttgccggtggtgctgtcctcccaggtgacctgcagctggccatcagggagcctcctgacccgcgagggggcacagcccctcaggaaccgggtgccatgagatgccatgtgctctatgaccatggaggacatttgctgcaaagcacaagaagacaggccatgaagaccaggtggccgtgggagagaggctctggccctgccctgctctcgaaggcctcaatgaagggcggagaggggtctgtgcggaagacggggtgagacaccctgccccctgctctacgtcctcttgctctctgtggagtgtctagcccctgtcctggctccaagtcctcaaccctgggccctatggtcaggattcactcagcctgtgggctcctctctagatgctaattaactaagtcttcatcagccagatacggtcacacctgtaatcccaaccttttgggaggctgaagtgggagaatccctcaagcccaggagtttgaggctgcaatgaactgtgatcacaccactgcactccagcctgggcgacagagtgagactctatctctaaaagaaaaaataagcaaggccgggtgcgatggctcacacctgtgatcccagcactttgagaagctgaggcgggcggatcacgaggtcaggagatagagatcatcctggctaacacggtgaaacactgtctctactaaaaaacacaaaaaattagccaggcgtggtggcaggtacctgtagttccagctaactgggaggctgaggcaggagaatggcgtgaacccgggaggtggagcttgcagtgagccgagattgtgccactgcactccagcctgggtgacagagtgagactctgtctcaaaccaaaaaaaaagaaagaaaaaaaagaaaaacaaccaaatcctggtacatctacacatttctttaaaaaacaaaaacaaaaaacttagtcttcactaaaaccaatggcagagaagcgtgccttcccccaggagctgtgccctggtccaacaagatggcccctgctcctggcccacccctccacatgtggccaacatgcccctctgccatccaggagccaggagggtaggtaggagactctgctcccgcctagaaatgtaggcacagcaggctcaggtccagatcagggacagagagagtcctgcttctccctcccggcccaggaggcctgtgcgccccaagtccagctacagatgggggccctgttcccaggacaatggggacttgcacggaccagcagtgaagctggccacagcttctggtttcaagaggagaaaaacagtcactgctaacatcctctgacacctgtgcgggtgtgccagctggctctagatggcgtgtgtgggagtctggcccgccgggcagggctggctgtgctgcagaggggctgccgcacaggctgttcatcactcctgcacccctccagaggcctggagggcatggccatcccaggctctgagggagaaccatggagcctgtccaggacacagggtccctcgcccctcagcctggctgcctagactgtgcatcctccttgcctgggcacggcccccattctgcaggcccctttcctcctccgtccactgccagctcaccctccccacatctgaaggctctgaggccttcctagacactgcgtccctaccacagggctcggtgggtttgcactgagggacatgatgggagtgtgccatagctttaggatggaacaacacatggccacacgggtggagggacacgtctctgagtcagcctgggggtggcactgggagtctggagatgacaggcctggctcctcccacctcaggtgacctcctcaggctctgtgagctgagggtcggccgaggacctgtagcagggcctgcagatctgcacagctcaccctgcaaggggcctccttcgtggcagtcatggagtgtttgacatctccacaatgacaactccagacttctattttaacaggagactttcccttgaagagtttttagctaaaaaaagaaaatctctattgctccaatctaggagctcgtcctgctggccacatgagtgtgtgtaccccagacacagatgaaggccactgtacacagcgcacctgtccagaagccaagatcccacgggctgtctcggagccagcgctgccctgtgtccctcaccccagctcacacattacagcttatttcacccccactccctcagaggggacaggcaaggggagagcagggagttgggggtctctgaggtggggctaacacttctgcagcacacaccggcctcttactaatgggacgacccggagggtgacctgctctgccggcacaaggctgggctgagcctcccttcactgtgcctgtggtcggctggaggcctctgtgcagctgtgcgccccactgccaccctcctccctcgctccggccgagtgtctgcatatttcctggacaacctcctcatccaattcaagggttatctctaaagattcaggcatcactcgtggcccatgactgcactgcacctgcctgggagggggctgtgggaggaaggcctcagagccacaggggcgggagctggggcctccagcactacctggtcgaagccgcggagggggatgctgcgcatcatgatggtggtgtccagcccaatcccggtgaggaagccagcacactccagggccacatctgtggggtgccagctaaggagcactgtagatcccaattttggaaatgatgggacaacaccccagggccctgtgccacagcccacaccccacccatccatggctggccctggaggaggctcccaactcaagacccccacctccacatctcaagtgcacaggctggggttagcaaggagccgccaagcagcacccacggactaggccggcctctggcctctgctcccatgtgctgtccatcccggctccagggcgaggcctgcatcctggtggattccagttgggatggagaggagtggctggttcagggaggacctcagccacgggagatgccaggcagctgctttcttccacctgtgctctcagccagcggcttggggcttttttttttttttttttttttgagatggagtctcattctgttgcctaggctggagtgcagtggcatgatctcagctcacagcaacgtctgcctcccaggttcaagcggttcccctgcctcagcctcccaagtagctgggactacaggcatgagccaccgcgcccggccagggactttcatctccctcagatgtccccttgaccccaggccctcctgcagctcctctcctgaccctccctgtctaattgtcccttctgaagcaatgggtccaggctggggctgctcttgagggaggacagcccagctgcctcatggccatgtccagctgtcccagctcaggaagagcctccaggaatccctggccagaggtcagcctcaaactgtccccaggcacagtagatcctccacgccgagaggcccagtaagtgccgatctgaggcagcaaagagcctgccggaagggcgggtggcagggagggactcaagggaaggagtgtccagttcccaggacggccacctgcacgcttgcaaaggatacagctggccccgaccaccaacctgttagagaaacagagagagagcacatgtaaagctgaggcccttattgaccaagtgcagtcagagcagaaccccgcagcctttgcccaggcccttggtcagctcgtgggctccaaggttactgttcaaacagcttgccccaggggacaaagcccactttccaaggctacactgtcaagcatgttgtgaatcagcaaatcgcctggtggtgaagggcgtgtgtgtcagtgacaagtggtacctgtcccctggaaggcacccggaggcatggagaaacatccaccagagcagcacatggctttccttctctccccccggggcctcctgggctagggtggaagctgggagatgcttggcaggatggggaggccaccagaccgcaagggaagacatcatctgagcaaagcactctcaagaccacagaaggctgggcccttccatgtgccagaggcacatccaaccctatcacagctaggcgcagggccaggagggccagctccccagagaggggactgaaggaccccagggacaagggaggcagcacaggacactgcgaccagcagtcattggaaatatttgctcttgtagtgaaaaccctctattgttcaaccccacactccacatgtgttttgcatgcacatgtactcacgcacacttgtatgtgcacacatgccacacacctgcatgcacatactcttacacgggcacaaatgtacacacacacgcacatactcgcatgggtacattcattcatatatacatatgcacacactcatgtagacacatgcatgcacacacatgcaaacgggcacagaacctaacacgaacaagaactcccagcggggcagctgcacgtgggtgggctcccacattacccttcagtctttgaacaagaggaggtgatgtaaggacggataagcccaatgtcattgctaatcccagcaggtactaatgatataattccatttcaaaacacggtgtatcccttggaatcattctgcaggtgccctgcgggaagcatctggcatgcagcttcctcactgtggctggggacagaaccgcaccactgtcaggattagggtgagcagacagagctctgttggccggctgagcacaaggtggttacatgcctcactcagcatgtgaggacagcgaagggggaccctgggacccccagccaagcaggattgcagagatgcattcccagccccgctcagggccggcaacacttgggaaacaggcaccacggtatgcacgcacttccacacatgcacacacacataggcaccacatacacatctctacacggaagtgcacttccaaaatggcgaaaccaaactctttttggacttgctatatgcagtgaaaggtacaagcttttgtttaagatatgaagttatggccaggtgcggtggctcacgcctgtaatcccagcactttgggaggccgaagcaggcagatcacgaggtcaggagatcgagaccatcctggctaacatggtgaaaccccatctctactaaaaatacaaaaaattagctgagcatggcgatgtgcgcctgtagtcccagctgctggggaggccgagacaggagaatggtgtaaacccaggaggtggagcttgcagtgagccaagatcgtgtcactgcactccagcctgggcaacagagcaagactccatcacaaaaaaaaaaaaaagatatgaagttatgagttactgcaaatataaacagaactctgctgctttgcatatcctgccctaaatgcaagggtgtaactgggcgagagcccattgtgtggtgccctttgccccctgctcccagaggtggctgtgcatgggctagatgcttcctgctgggctgtgcaggcactggcagagtgaggccaatgcatcccctctgtgggcagctgggcccctgcacgtcagggccttcctggccctgaaggccaacccttctccaggaatgggccctgcagctgcaggatgggggccaggctgctctccgggcctcctagctcattgctagggatacagcaacacaccctcctgattttgccacaaatgtttgctgtctctgccaccgacgtgtacatccccacctcctacacgatgctgacccaccaggcctggattggagcgggggcaggtgactctccaggccctccctcggagtcccccagtgcccgggcctcctgtcctggcacccacggggcacaggagaagctcccgcctcaagggccaccttcaaagtcacaggtgcccccatccctcagctgccagctctgaatcagcaactgagggtacagctaggaggaggtgggtgcagtgggcatattcccgagtgggcatccttgaccctatgtgttcggctgaaatctctcaacaaaagctcacgtctcgctcgtgtggagggtcattttgggcctcttcttgttgtcatgagcaaggattattgacagcattggttttcactgtacgcctccccgcattgatcaaattatgtgaatgtttaccctttgaagaatgcaggatacgagaattccaacagagaactccgttcagaccagctaaagtaaaaaaatgcccgagcaaaataagacagacaccaaagcctccagatcacagggatagagagtacccaaagacagggacctacagacaccttcttcaggccattcacggcccagcaggggtagggacagacaggaacgtggtgcagcaaccaactcaagccatgactggccacaggaagtcagaggtgctggccacagaagtcaggggaccagctcacaggacctgggggtagggggctggaaccactcaacttaccgctgcattaaaagacccagaggttgggtgcggtgggtcatgtgtgcaatcccagcactctgggaggccaaggtggacagactgcttgagcccgggagttcaagaccagcctgagcaatacagcttgtccccatctctacaaactaaaaaaattactggggcatggtggtatgcacctgtagtcccggctactcgggaggctgaggaaggaggatcacttgagcctaggagtttgaggctgcagtaagctgcactccagcccgggaaacagagtgagaccctgtctctaaaacaaacaaaacaaaacaaataaaaatcagttttccatgtgatcccagcagctcagctctctgtgctttttggtgtgcaaacattttccaaagaggcataataactactgcaggatgagcctaatcacagggcaggctttcttgttcaaaattggaatggggggaggaagcagaaacaaaagcattaattcaggcccacgaagcctaggcttaaagagcaatccatctgcctcttgagcttgaaggcctgctctccagagggaatactcacacaaagtgagtctcatgggaggcacctggccccttggaggtcctgccagcccaggaaataccagatgggccgccaagctgcagatgccccagggaggcagcacagggctgggggtgctacgaaggcctccttccccggcttggctggaaccccgccgccccacccaacccctcaggggcagatgctgggccggagcctctgtgtgctggccctgtaacaaatgccactgaaagccctaccttgtcatgtcttagccacagggacgcacacagagaggtggcgggggctttgcagtctggtaacaagccccaggaggacagctggtctccctattgctgaacacaaggacatcccatcacaccagcggaatgtgccacttaaattaaattttctcccaaatggctgtggttcttcccaagataaaatttatcttcttccctcttgtgcttaggaagagagaaaaatgatcgcagtacctggctggcttccggacttcctaagggtcaaataaaagctctttccatgacacactgacaggcagccttaaaccagcccaagttataaaaacactctgcctcttggagccccaggagtgcgaggacagacagcagcaggctggtggagcagcctcagagggtggacaggcctggctggctgcagcccctcccccagggcccagtgtgtgggctggtcagcccctgagccagcctggcagctgcaggagaggctggccccatgctctgtaaacccccacggggacctgggcaggggctacagagctggcagcaggaacaggcagaccctggttgtttccgggaagcagtacctccgttatcggacctgagaggaggctgcggtctcattcacgccctcggccccatcccagtgttgccagctcagagccctgctttgcagaaagcggacctacagacacagcaagagggaggactagaatagagggaccacaattccctatattggggttagggcacctgagctccaaaacctggcactgagggagaagacgaagcccagggccgtgggtgtgcaagaggcagagacaaggcacactggcggggcccaagtccctgccgggtgcggaggcttcccggtggaggcagccctccaggtcaggaagtggcaggaagattgtgcggctgtgggactggagttggagctcagctccttggccccccttaattgccaggcccctctgggcctcgggctcctcttggctgcacttggatcccgacccccagtgcctgcctctgtaaaggagctccccggtgtgggctcaccatcctcgccttccacattcctccacctgccgggggcttgctctgtggaatggaaggtttggtttgcaaggctgcatgccccctctgagcctagtcatttggggtcacgtgcccctccgcacccctgcctccctgcagtggccattgttcccagaggggctccactgcctgcccagggtcactgtacctccccagaaacctcctctcttcttcaacctgtcttgcagttccagagaaggaaagacacaacacagcagaaaaggcaaacgggctggcacaaggcgggcatctgcatggcagaggcggagcaggagccgacctggagtccttcccagggtccccaccaagactgggaggacagtcccttgcgccagggcgtggctatgggagtggggcagccagaacgtcccccgccccaccccagtgcactcaagggtcctgctcacccacccacaagctcacactgctttttcaggagttttctgagttttctgcacgtcttcctcaccctcctaggttacaaaccaggtgctcagcccactctggtcaacaggtatggccccattttgccagcatatggctgtttagtgaagtgcactgtttaattctgtctccccttgactgagcttggacacgatccccctgcctctgccatctgtccagccctgggctccctaagacctggatgcaaacaaaggaggaagggggctcccaacttggggcccgaggtgcactgtgatgcctgagtggcctctctggggcaaaagtggcatggtacgaccttgcaggctgggtcccaggccccactgtgggcaccactcgccagatctggagctcccggcagtgggccccacacagacgtgcgctgaaaggagttcctggtggcagcctgtgcctgtagtagagagggacgagggaggcctcgtgcacgccgcagagcccaccgagggcctggggccagggggacagggagcctccttggtggaggagccaaccaggggacagagtgcccactgcaggaggggcactgtgatgccaggcaccgtgagttgcgcacctggcctccaggatgggaccaggtagaaatgtcccacccgactacgggaggcactcaggggccaggggagcagccccggggtccatattaatttcagctccattttaaaggcgagttaaaataaacatggggaatatttataaggcaaataaatctggcagaaacagcccctccaagtgtgagtggaggcctcccctcagccccagcccaagctgataaaatacagaaatgctactgtagaccctccgggcttattttgactgcagcagaggaatgtaacatgtaaacactgactcccatattacactgttacaacttgcattaacagcgccggacaaaagccgcattttcacagaagcatcgtacagggatatatctccagcttaatttttaaaaaaaccatttcctcacataaatcatgctcagaatgaaacgggtgactgatacattgcaaacactttttttcttaaacaataacatacctagattccttctaaacgaaagagctttaaaaaaaatcttctaaatgttttttttctgaagaaaataaacactgcagtttcttttctgaacaaaatatctggagctgtgtcttcccggccgagccagctgcccccagcacagggttgcagaggagcgctccccaagccccagccaccttgctagggagacagcaaggccagggcacccagagcaccgggccccctccccaggcccaagcgggcagcctctgaggggaacaggcacaacgagggtggtgaaagtgctgggctgcagtgaccgtcaccgaagaccccagtacatcgaggggcccagcagacatcctggggctgccagacatccaaggccatttccctgaaggtccagcagacaaagcatcctgcaggggctggaggggcatccagactccacccagagaagcctacgtgaaagacaaccagaggcacaggcagaactcaggacgccgagtgagaacagtgcctcgagatgggcactggggcccgggcaacccatctccaccacaccgcagaagaagtgcagccagcccaaggaagtaaaagaaaatccgacttgtggacgcccataaggaaaatacagggcttaaaaaaaaaaaaaaaaaatcttgggggtggggcaggcctttctgaacatgcaataaatcaaaaagccactaagtgtaaaagatttaagttacattaaaaaaaacttaaaccatttgtacatcacacaagttaaaagacactagaagctgagaaaatctgcaccacaagcgacagaggatcacatccctaatacacaaaccagctggagggtaagaagagataagagaagagaaaagccagacgtgaaagtggacaaggaccatgctggcgatttgtgcagcacacatgggcatgctcacagacacgctcatctcaaatgaggctgtgacacgaggcttttcaggtaaatgtgtgaaaagaccactgatcacagcaaatgcaaacagagtcagatcatgtgtaactcagcagatagtcaaagattaaaaaaacagtctgggtgccgtagctcacacctgtaatcccagcactttgaggggccagggtgatcacttgagcccaggagttcaagactagcctgggccacatagcgagtccttgccctaaaaaaaataatcattagctgggcgtggtggcgagcgcctgtaatcccagctactcaggaggctgaggcaggagaattgcttgaatccaggagatcaaggctgcagcgagccatgatcgcaccactgcactccagcctgggcgacagagcaagaccctgtctcaaagataaaaaaacagataacccagaaattatggcataacaggaaaaagtgattggtgtgacaacagaaaaacttaaaatttctgcatgaaatactatcaccaagtccaaagacaaaccacgatcagtgggtccaatggaaggcagcaggcagtcgatggaaaccagcacaagctcagcacagtctcaggagagtgtgggcgccgtgggtagcagtgaccactctcaggagagtgtgggcgccgtgggtagcagtgaccgctctcaggagggtgtgggcgccgtggatagcagtgacggctctcaggagagtgtgggcaccgtaagtagcagtgaccgctctcaggagagtgtgggcaccgtgggtagcagtgaccgctctcaggagagtgtgggcgcaccgtaagtagcagtgaccgctctcaggagagtgtgggcgccgtggatagcagtgacggctctcaggagagtgtgggcgccatgggtagcagtgacggctctcaggagagtgtgggcaccatgggtagcactgaccgctctcaggagagtgtgggcgcaccatgagtagcagtgaccgctctcaggagagtgtgggcgccgtgagtagcagtgaccgctctcaggagagtgtgggcgccgtgggtagcagtgaccgctctcaggagggtgtgggcgccgtggatagcagtgaccgctctcaggagagtgtgggcaccgtaagtagcagtgaccgctctcaggagagtgtgggcaccgtgggtagcagtgaccgctctcaggagagtgtgggcgcaccgtaagtagcagtgaccgctctcaggagagtgtgggcgctgtgagtagcagtgaccgctctcaggagagtgtgggtgcaccgtgggtagcagtgaccgctctcaggagagtgtgggcgccgtgggtagcagtgaccgctctcaggagagtgtgggcgccgtgggtagcagtgaccgctctcaggagtgtgggcgccgtggatagcagtgaccgctctcaggagagtgtgggcgcaccatgagtagcagtgaccgctctcaggagagtgtgggcgccgtgggtagcagtgaccgctctcaggagagtgtgggcgcaccatgggtagcagcgaccgctctcaggagagtgtgggcgccgtgggtagcagtgaccgctctcaggagagtgtgggcaccgtgggtagcagtgaccgctctcaggagagtgtgggcgccatgggtagcagtgaccgctctcaggagagtgtgggcgccgtgggtagcagtgaccgctctcaggagagtgtgggcacaccatgggtagcagtgacagctctcaggagagtgtgggcgccgtgggtagcagtgacagctctcaggagagtgtgggcgccgtggggagcagtgaccgttctcaggagagtgtgggcgccgtgggtagcagtgaccgctctcaggagagtgtgggcgccgtgggtagcagtgactgctctcaggagagtgtgggtgcaccgtgggtagcagtgaccgctctcaggagagtgtgggcgccgtgggtagcagtgactgctctcaggagagtgtgggcgccatgggtagcagtgaccactgcccaggccaggggtatgggaggagaggctcctttctgttttgtgtcttatcaaaaagctgatgcctgagttaccaaggacagggaagcaggcagagtacacatggaattggcctgtcagcacaaagtgttaagacggaagggcagctccccttgtaaagcgtataagaccacctcacagccactaggatggccactgtcaaaaaaacagaaaacatcaagaaaacagtttaaaggaaaaaataaaaattaaagaaagaaaaacagaaaacaacatgcactggcgaggatgtggggagcccagagtcctcctgaactgctggtgagaatgtaagatggtgtgggcgctgttgggaacaggatggaggttcctcaagaccataagatccagcaatcccacttctgggtttgcatccaaaagaactgaaaggtcttcaagaggtatttgcacacctatgttcacggcagcactgctcacaacagccaagaagcagaggcaacttgggtgtccactgacagatgaatggataaacaaaatgtggtgtgcctgtacaatggaatattactcagtcttaaaaagaaggaaatgcagatacaacatggatgaaaagagttccagacatggatagtggtgatggtttcacgacattattaatacatttaataccattgaactgtatacttaaaaatggttaacgtgggctgggcgtggtggctcacccctgtaatcccagcactttggaaggccaaggcaggtggatcacctgaggtcaggagtttgagaccagcctggccaacatggtgaaaccccatctccactaaaaacacaaaaaattagcggggtgtggtggcagacacctgtagtcccggctactcagagggctgagacaggagaatcgcttgaacccgggaggcagaggttgcagtgagccgagatcgcaccactgcactccagcctgggcaacagagtgagactctgtttcaaaaaaaaaaaaaaaaaaggttaaagtggtaaattttatactatgtctgttttatcacaatgaataattgggaaaatgtgtcagaagcacttctgatggtaaacagatgcacctccaaggttttcactgcagcattgataatgatgaagaagagaaactactgagatgctcattaacaagagaaaggtcaaaggaactataccacatccattcaagggaatccagtcctgaccccacacaaagatgccccgtgaagtgtgaaacaatgacaagcagagcatgtgacacaccactcacacacacacacaccactcacacacacacaccacacacacacataaccactcacacactactcacatacacacaccacacacacacaccacacacaccactcacacacacacaccacacacaccactcacacaccactcacatacacacaccattcacacacacaccactcacacacactactcacacacactgctcacacacaccacacacaccacgcacacacaccactcacacacacaccacacacacccacacccttcacacacacacaccacacacaccacacacacaccactcacacacaccactcacacacacaccacacaccacacacacccacacccttcacacacacaccacacacacaccactcacacacaccactcacacacacacacaccacacacccacacccttcacacacacacaccactcacacaccacacacacacaccactcacacacacaccacacacaccattcacacacacacaccacacacatctgcacgcacaccatgcacattcgggcacacacagaagtgggacccttttccactgatattttctcctggggaaggctcgagactgctattgaccaagcctctgccgccctctggtggtctctctgctccctgccaacatgaagtctccacaccccacaggcaggagctgcctggacctgggacctcgggatggcccactctgtgggcatcggaatgcacttagtgactctgcacctgctcccatggggagtgagagccacttgcacgctgctagcctcccttccacaatcaagatgttgtttctgaggcctttggagtctttgctagatttcagggaaacccaatgtacaaatcagaagacagtgagggtgttagatgagggctgggatagggattgctggctctcccctccttaatgttctccctgatgtccttgaggggacccactggaaccccagggctcctgggaaccccatttgacaaccactgacctagataacaaacagctgactccatttatatggcagtcctgttattgttattacctccaaggcagccacaggacagagtaaatcaacagccctgcagaggggcacaagtcacaggtttattgtttagttttgagacaaggtctcactctcccaggctgagcgcagtggtgcaatcacagctcactgcagcctcaacctcctgggctcaagcaatcctcccacctaaagcctcccaagtagctgggactacaggtgcacagtactatgctcggttaatattttcagatttttgtaggctgggtgtggtggctcacgcttgtaatcccagcactttaggaggacgaggtgggcggatcacctgaggtcaggagttcaagaccagcctgaccaagatggtgaaaccccatttctactaaaaatacaaaaattagccagatgtggtggtgggcgcctgtaatttcagctactttggaggctgaagcaggagaatcacttgaacctgggaggcagggattgcagtgagccaagattgggccattgcaattcagtttgggggacagagtgagaattcacctaaaaaaaaaagccaaaaaaaaaaccaaaacagatttttgtagagtagaggtctcactatattgcccaggctgatgctgatctcgaactcctggcctcaagcaatcctcccgctcagtctcccaaagtgctaggctaacaagcatgagccaccacacctggccacaaataacaggccttttttccttcttttgggtaaaccggaaagaaagccccaggagcccagcaccagcacaggctctaagggtccagtgctcactctggtgaacaaaaagaggaccccaccaagcacgcgcaggccttacgtttttccaggggattccttcagccagaagatgtcatcacttgtgattccatattccaaggcaccttcgatctgtcaagacagaaatgaccccttggacaagagctccatttggcctgtcctagggcttccttaaagaggatgccagctttgcagaatcaagcagagctttcccagggcacacatgcacagggcttccctgctgccagtccttgtctgcaggctgtggcctctttggggctgcaggtggcctgtctgcatctaagctgctgcactccaggtcccggtgccctcgcagggtacctttcccctctgttccccaggaccctccccttgaccctggttcagagcaggatacagggcctgaggtgggtacagcaactgcaggggccatacaggcagacagctgggacccctcaagtctgcccgggttctggacagacacatcaaacagacaggggcatgcagccccagggagcaacacctgggttctgggggatccaaactcagagagaggaagtggggagagaacaggtcagcaaatcagggccagcagagctcaggtgtgtctgcgcggcaggggtggcctacaaggccagccagaggagaggaggcacagggggtaagtgccacaggctgaggtgggcagggactgaggggcagctctgagggcacctggctgaagccaggacggacttcacactctcgagggctggcccgggtgggctctgagcccagaaatcatacaggtcacctgaagaggggcggccaagcaggtgggaggcccagggtgaacgtccccttagcggccatgagaacaagatgtgctggtggaggaagcggatctcaaacagtttatgcttccaactggcaaaaaaaaataaagtcaggaatttctcaggtttactcaaggaaaaccgaaaggtctggcaatcaaagggactaaaacgcaagcaagccttggcagacaccctgggagggcgtggcagggagagcgaagcagccctgagctgcctgcctcctaaggaccaggagcgcctgctggatcccctgtgagcccaaagagccgtcagcagctgcccgtgaggtgcagagcagggccgggccaggccagggcccctgtgcagtgctccctggtgcggatgcacgtgcagctctgcctggggcctcagagaaacccaatgaccgctgggctgctggaagctggctgtggccttctttaagcagaaccaccatgagcccagctgccaggagaggggatcactgggaccctgtctgcagcagctgccttgaacaactgcacagtgtcatcctacaaagtcacgcagccctgagccccacctctgtgcataagcaacctgccccctctagaggctgctgtggctgcctggcggccagacaagtcccacggcctctaaggactgggggtgcttgtgctcctcggggccgctcctttccctgtttccacagtaagcacaggacgaagtggaggctggggtcacatccaagaagtggcagaacctccccttgctctgcctccaccggactgcccctgggtctaagtcagaggtggtgtggcctccaggccgagagagccgtggtcttcaagagcttggctgcagcctacttagaggcttggagcaggcggcacacggttccctgggagacccgtggggactggtctcagccaaacctctctgctcacccccagcccatttgctttccctgctgcagctgccccccaacccctcaccccggggccccttcctcaactctgcccccacaacccacaagactgggccaggagttattcacctctctgttaaaaacagcgataaaactggcaagaactgggagattcagaattatggaaattaaccacaggcttgcagcaacacagggaacatttaaagtcaggaaaaacagctgaagctgagtgagaatgggaactccagggtgttttaactcactctggtcccactcccacctcagcggcagccctgaacagtgatgtgtcagagagagcagaactcagctggggtctttcaaagcccccccacaaagaagagtcagagtcagcaactatagggtcatcttcatccaacttcaccggagctcagccagggctaaaagcctttctctgggggcatttgtctgaggttttcttctcacagctgcctgaggggataggtaacagttagagccaacaacagactgcccaaaaagcttcaaaggaaaagccaaagtatgagatgtctgctggagctttgaaaggttccagcatattcctgggaacctaggccaggcgcatgcacagcactgtgcacacatcaggaaggaccaacgaggccctgaaccctcacctccagctgaccttgatctctgcagaagcaggaagtgaaggctagggcagagctgtctgctgcctgttgagtgtggaaggcatcccctccaaacgcacacagagccctcagcaaagaccgggagagttcttagtttagggaaatctccatgcagttcttagctgaccactaagctaaccaagtaaagacttcagtggccacatacatcaaagaataagagtctacaaagtcagttccgaaaagtcaccaaataagcagctgtaacaacagaatcctggggcagagggagaatctggtttccaaagttatcgcattaaattatttgaaatgttcagctttcaataaaaaaattacaagatacgtgaagaaacaagaaaccatgacccttacaccccactggaaggaatgtaaaacacagtcattgtggaaaacagtctgaggttccttgaaacgttccttgaaagattcaacataaagttaccacatgacccagcagttctgctcctaagtgtaacccaagagaagtgaaaactgaagtccaccaaaaaacttctttgcagatgttcacagcggcactattcataatagctaaaaagtggaaataacacatgtgtttatccaagcaagtagataaacaaagtgtggtctatccatacaatggaatagtatctagccataaaaaggaatgatactgacacacactacaatgtaggtgaacctggaggatgttatgctcagtgaagtaagccagtcactaagggacacacacatacgagtcactaagggacacacacgtaccagttacatgagaaggacttacatgtacgatttcacttacacgaggtgcctagtgttgtcacattcatagagacagaaagtaggtggtggtttctaggggctgggggaggaggcgctggggagtagggtttaatgggaatagtttcagttcagggatgatggaaggagttctggcaatggatggtggtgactgatggccgcacagctctgtgaatgtactaaaaaccactgaattgtaccctaaaaaaggctaaattttatagcgtgtgaattttatttcaaactttttttaaactgggggacgtgaaggaggaagatgaagaatgaggcttatatcctgaatgttccaacattctgaggctgaagggaaaagggggaatcagcaatggagacttaggaagcaggatcctggtgtggaaggggacagatccagcggggcagggggagagcagaacgagagctgtcctgaggatctggcagcgtggaggccactggggaccccacatttcagcagtgtggattcaagagaattggaaagcagaaagtgatgatagtgagtatagggggaaagggtgtgcaagctgctgctgtgggaagcacgtgtgtaaaaacgtatccctcaaagaggccgggaatgggccacggcagcagggacgctatgctctggggacactcacgtgcgtggggtatctcggccgccctccagtagcaatgatgatgtgatcggctgacagcagaatctgaggagaaaaagagaaagccgtgggtcagacaggtgcatggtgatcaccccaccggagggcctgagcaccacagaccttggccagcagttcccacggcccctgccctgtagcgtggacccttggccagcagttcagaggccctatggagctggaatcccatcaaccatcagcctggcaggagggggacaggcagaaagcacagggagatgttctaactccaagcacttcaaggcaccctcaaatccccaaaaaatcctgcaaaaagggtgtggtcaccaaccctgttgccatgccactccgagcagcagggcagcaaattatttgatcacgttaaagacaagtgcccagcctcaaaagaagccacctttttgattccagcagcacgtgttactaagaacagcacccaggccaaacacagctgcagttggtgcccaaggtctgcagaagggtccacaaggagccacgcgagtaagtcagatgctcacctctttcccacctttggcaacgccgcaaaccgtgtgctcgtcaacaaagctggctttgatgttaaagtacttgacttttctgaaagataaagataagattttcaaacacttcctctgcaaattaaacctcaccaactggatcaatagggaacactggtaaaagggagctccagcccccagcagggcctggtgctgtggctcagatggaccaagaggtaagcggcaaccatgctgagaagcatggaggggatgtgggggcacctcgcctgtcccccagggatcccagggacatgttaaccacaggtgtcaaagcagggacggaagccagctcagcacggtcctaagaggccacgtacagccctggtgtgcagcaagaggtggctggacctctcttggggacagtcctcatcacccggacatgttccagcagggagctgtggtgcccaccagatggtgtcaccttctgatttcaggggtgtggtaacaccaagagaacgggcatgacaaggctggcaaaacagtggctgggagcatagtgcacagaaacaaatgacccacgctttcttttcttttttttttttctgagtcaaagtctcactctgtcgcccaggctggagttcagtggcacgatcttggctcactgcaatctccacctcccaggttcaagccattctcttgcctcagctcttgcctcagcctcctgagaagctgggattacaggcttgcgccaccacgcctggctaatttttgtatttttagtagagacggggtttcgccatgttggccaggctggtcttgaactcctgacctcaagtgatccacccacctcagcctcccaaagtgctaggattacaggcatgagccaccgcgccccacccttttttttttttttaaagacatcttctcactctgtcacccaggctggagtgcagtggcatgatcatagctcacggaagccttgtttcaagtaactggaactataggcatgggcaaccatacctggctagttcattttattttttgtagggatgtagcaataaaactatgttgctcaggctggtctccaactcctgggctcaagtgatcctcccacctcagcctcccaaagtgctaggattacaggcatgagccactgcacccgaccaacactttctaatgacaaaaggaccgtgctgcagcaagggttctgggaaggctctgcctcctgcttgagcctgccttctccccactggcaagcctgtgcctctatgggctgtctgagctgcgtgaagttcctacagcaagagcccttcaatcacctcgacagccaggaagctgccacgggacacagccgggcaatgctcatggcagcacttttcagaagagtgaaaaagcagaaacagcccaggtgcgccccagcctccttctgcaggtggctccggagcaggcagtgggctgggcctgtttggtgcccgtccaggagctgcccagggcagggaggagggagggcagagcctgctgtccccaggaaactgtaccaggggatacagagccccacagagaaacacagaaatgccacagcacaatgtggcttagctccctggataggggagagcttgtgaggtccaggtggagggcaagcagttggcttcctggctccactttcctggatttagtgagcacaaaactgctgcctgctgtgaagccccaggaagacccgccctggggccaagcaaatggtgcatgaggagagccaccagacctctgcgggaccactgtcccctccacagccccgggagaaaggctgggccagaggcggtaccagtttcaggcatctgctgtgctggcagctgagccccaggagaaggttgtaggccaggggagcataggcctctgtgctggagatccccaggggctgacaggaacggtgaccaagtagggacatttgctccagcggaaagcaccaagctcctgcacccacacccaaggagctggaggtgtgcagtaagaagggggttcacggggtgggggcttgccactgggatgaccctcaccacatattagccccaggcctagctatgtccacgctctctggcctgaggccttccagccccaagcgcctcctccctgtgcagccctgggctctggccattctgccaatgtggcctcactcattccttggcagcacctccaggctctgctcagcagcaaagggcagtctccccttcccctacagtcactcccatctgctccttgtcctcatccccacccatgagcaggacatgaacccccagagcctgccagagcatgctctgcacagtaagtaagtgtgtgtccaggcacagaacgcccaagagaaggcccagagggcggcccattcccggagagagcttcagtacctgtcctgaagctggacacggtggccccagttcaaggatttcacgtgattttgaacagcttctgccatcttcctcctgtgaagatacgaaacaaaatgtaaaatccacaacacaggtgttagctgcagggcctcacgatggactattagattcaaatggtacattcatagaaatatcaaaaaacaagagtgcttttaaaggtggcaaaacgtgacatccatccctacgtgcaaccgcctgtcccaggctcagggctgcagacctttggactcacagaaaacaggggctctgacccacggctctccagatgcagctgctctgtgccccaaaggctacccactgcaggcagaggcctatctgagccaatgtgggtgtggctgggccacgtggtccccttcccagaagagctcagctgaagcggcctcccacccgcactcctggccttggagatgcactgttcttggtggggctgtgctgtgcatggctgtagcatccctgggctccccgcaaaggggagcaaacccttccccagtgacaaccaaaactgtctccagacattcccaaatgtctgaggcagacagcgcagagtcgcccctggctgagaaacccatcctacggcccactccccatgagggctcatcgaggataagcctcctcttcctcttccacccaagagtagaagaaaagcactggaatgccacggcgccagatccttaccagtcatgcggcacgggctgggccacctcccagccatagttgggggcatcttggatcaggcctcccagcagtgccgcctggtgcatcagcttcttggggatgcagcccacgttgacgcaggtgccgccgaggccccaccgggtgcctgggacgtgggaagagcacatttgaatttatgttcaggtgactgctggaggcttccctgttcttctagagtgtttggaattccttaaagttgctttgtaactctaacacagaccagctgacatgccacacgaatctgctctctataactgtactcgaaaataaaaacagttgtttttactttttaatatttattaatttatttatttgagatggagttttgctcttgttacccaggctggagtgcagtagtgcaatcatagctcactatagcctcgaactcctgggctcaagtgatcaaggcctgccttggcttcccaaagtgctgtgagtacaggcgtgagcaactgcacctggccagagttgttttcgataatggtcaagaactttaaagtaatgatgagtgaaacaggacactgtccagaaaccatggacagcagggctgaaggactttggtgtcagctgccctctgtacaggaactgggcccacctcccacctccttccccaggacacccggctcccatagggtgctgcctaccttggggagaaggttccacgtagtccaccacggccaccttccttcccagctgggcggctggaaggataaggagagcagcaggtgagcatggggagctggctcaggactcaagaacaggcactcctcagggcttgtgaggtccagaagagtgtgggcagggcctgggcctgcggctgcccacacagtggctgagctgcgcaatgctagggacccctgatctgcctctgcgctctggcctgctgagctgcgctgcctgctggctctgcattgagtcttccagtctctttctggcactgcccacccagctgcgctgcccacaggcaggagccctcagacctctcagggcccgcagcctttgtaccatccacccctcacagtgctggcatcagccccacctgcccctgcatgttcacgttcaccataagcccagtgcccacccaagcatccctgggtggcatcccccaggtagccactcaccgggaatggctcctgactcagaggctctcccttgccccttcccatcccagccagagccccctaggtgggcattcgctgcctcactctcaggaccaggacaccaaagctcaggagaagtgacgcagcagccccagggtggaccagccccagagcaggagccgagacctgactccaaaccacacttcccgctgcagagccacccagttgccctcccagccagcagtgtggccacccagggccacaggttctggggccaactcagaaaccattagccaggaccgggcatggtggctcacacctgttatcccagcactttgggaggctgaggaaggtgtatcacttgtggtcaggagttcaagaccagcctggccaacatggtaaaacgtgtctccactaaaaataaaaattaaaaaattggccaggtgtggtggtgcaagcctgtagccccagctacccgggaggctgaggcaagagaatcgtttgagcccaagaggcagaggctgcagtgagcagagatcacaccactgtactccagcctgggcgacagagcaagactctgtctcaaaaaagaaagaaagaaaaaaaaaaaaaaacattagctagggctaatttcaagcttccatttgcccgggcttgggcactgcatcagcaaacttcaggccttggacttgactgcctcccaaggcacacacaaatctcatgaaccctaaaatgccaaggaaagtgtttgattcgtggctattagaaagcaagattagaacaaagttttgtaagagttcatttttaaaatccattttgcttggctgggtgcagcggctcatgcctgtaatcccagcactttgggaggccaaggtgggcagatcacgagggcaggagatcgagaacatcctggctaacacggtgaaaccctgtctctactaaaaaatacaaaaacaaaattagttgggcgtggtggcaggtgcctatagtcccagttactcgggaggctgaggcgggagaacggtgtgaacccaggaagcggagcttgcagtgagccgagattgtgccactgtactccagactgggtgacagagcgagactctgtctcaaaaaaaaaaaaaaaaagctaatgtccacaaggcacagtggctcacgcctataatctcaacactttgggaggccgcagcaggcagattgcttgagcccaggagtttgagaccagcctgggcaatatagcaaaaccctgtctctacaaaaaatacaaaaattagctgggtgtggtggcatgcgcctgtggtcccagctgctcgggaggctaaggtggggggatggcttgagcttagcaggtggaggatgcagtgagtcaagattgtgccactgcactccagcctaggtgacagagcaagaccctgtctcaaaaaaaaaaaaaaaaaaagccagtgtgccagtgtgtaactcccacatctgaccacgatggagcagcagggcccagatttaccctccccctgaagcaacccaaaacccaggtaaaatgcatgaaacaacgggctttcaggtactccatgtcaggtaacaaaggacctgagagagaggaaacaaacatggtgagccctggggagtctccaggacccagcactgcaggctggggaagatggggagaatccagcacaggagagggctgagaactgggggagactgaggcagccagaggtcatgcacagaagacagtgaggagggggctgcccagagaatctgagagatctgatcggcgcatgtgtcttgggaaactacctgagaccagacagaaccacctggaaggactggaggggacagagcccacacagggcaggggacagtgcctgttcccagaatctggactgggaaaagcatataattcctggggcgttgggtcatgccccagtagttgagaatcattagccctagactgggcactgctccatacccacctaacaaatcttttgcagaagacccaaaaggatcaaactgactcttaataactgcatcccagaacagagctcaataatagtatttctagaaatacaaaaatgcccagaacccaacaaggtaaattcaagtgtctggcattcaaccaaaaattaccagtcacacaaagaagcaggaaaatacacctataaaggggacaaaaaaaaatcagtcaatggagactgacttggaacagacacagatgtcagaattagcagaaaagatcaataaaacaggtattctaactattccatacttttttatttttatttccttgcttagatgcctcacttgtgtgccctaactccaccttatcacatatgatgaactatctgttcatgtgtctgtctcggtaactaaactgcagaactccgtcagtcaggggctttggtcctggtttgtctttgttgttccgggtcctggcccagagcttggaccacattaagtattcaaatggtttgttgaagaaattaacatgttaaaaacaaacctttctcacagaacactgttcctccttcagtgttcaagatcccagacctttgggtccctttttacctacttactccctaccaaaagttctctctccttcgactccagggtggttttataaacctcttatgcatctcaacttgcactatatggtagctacttttcacagctacagacttttggtgtgggaaggatctttttttctctttttttgagatggagtctagctctgtcacccaggctggagtgcagtggcgtgatcttggctcactgcaacctccacctcctgggttcaagcgattctcctgcctaagcctcctgaatagctgggattacaggtgcgcaccaccatgcccggccaatttttttgtatttttagtagagatggggtttcaccatgttggtcaggctggtcttaaactcctgatctcatgatccgcccacctcggcctcccaaagtgctgggattacaggcgtgagccaccatgcccggccaggaaggatattatatgcaatttgttctacctgcttacctgaagtttgagtctccttcataacatcctcaccaagtgttcacctatgcctggtgcctttgtctgggaatgtattgccttcccaagtggccatttaattttgggaactctcccaatataaaatttctcctcatattaattggaaatgttttcctataactcttaactatctccaccccctctcccacatgcccactctttaaaatttaaaactatttttttcctttcccttaagttttctctttttgaattccttcaatgatgactttcaaggatagattccttcaactaggatagtttaggtcacttctctccaaatgacccaccttctccaaacctctgttcagaaggggctgcgatgctcccagtaggaagtctgaggccctaaaaatgggcagctctcgacctgtcctggctctgggctgtatcagccttgaactcggtcacatcaaacatctgacttatagaagttaacaagcagactgggcgtggtaactgacgcctgtaatcccagcattttgggaggccgaggcgggcagatcacctgaggtcaggagttcgagaccagcctgaccaactgtagtttcacgaccagtagtgaaagctcgtctctactaaaaatacaaaattagccaggtgtggtggtgggcgcctgtaatcccagctactcgggaggctgaggcagaagaactgcttgaacccgggaggcagaggttgcagtgagccgagatggcaccactgcactcaagcctgggcaacaagagtgaaactatgtctcaaaaaaaaaagttaacacagcattcactgaaacccctgaggcttttttttttttttttttttttcaaatcttgtggacttctgactggtacaactgcagctgccttgcctggtaacttgggtacctggtttgtgggtccaactgcaggccattcaggtagacttgattttttttttaatttaaaaaaaggcttttttttcttttttcttttaaagagacagagtctcactttgttgcccaggcactggtgtgcagcggtgcgatcacagcttgcttacgccttgacctcctgggctcaagcaatcctcccagctcagcctcccaaagtgctgggaccacaggcacacaccaacgcccagccctcagtggttttgatggattagtgtatccccagaccctccgaaggggaggacagtgccttatctctctctttcttccaccaagaaggccacaaccggccttttaaccttgatccaagcgaggctgaaaagcaaacagggcgttcatcttcatcctttatagccacatagccacatctcccgcccacaagcagattccaccaccccccgcaccctaaggcccagcctcatcagctgcagcatcttcacctggcctttcacactgaagcagaaggggtgacggtttactttcagctgcatggtctccatcatacccgtagacccaacagctgagcttcccctctgtcccttctcctcagctcactgccccactagccattctgcatgttcaaacagtgcaggagcaacatggaagatataaccaaaggctcaagctggattgtagagatgaaaactacaatacaggagatgaaaaatacactggacgggattaatggcaggtcagatgttgcagaatcttttattggtgggtttgaaaacataggaatagaaactatccaaaatgaaacgcagagtaagaaatgtttctaatgaaaagagcatcagtaggttgtggggaagcttcatgcagcctaatatacatggaattaaaagtccccacatgtgaggggaagaaggagggactcaaggccaatgaaaagagaaaatcctaaaagcaaccaagacacactacagagacactaagataaaaatagtagcagatttctcactggaaacaatgcaagccagaagtcagaggggcaaaatttttaaagtactgaaaaaaaaaaaaaaagcggggggccaggcatggtggctcacgcctgtaatcccagcactttgggaggccaaggggggcggatcacaaggtcaggagatcgagaccatcctggctaacacggcgaagccccgtttctactaaaatcacaaaaaattagacgggcatggtggcatgcgcctgtagtcccagctactcaggaggctgaggcaggagaatggcgcaaacccgggaggcagagcttgcagtgagctgagatcgcaccactgcactccagcctgggcgacagagcaagactccatctcaaaaaacaaaacaaaacaaaacaacaacaacaaaaaagaaggcaaaataaagacgttttcagacatacaaaagctgagagaattcattacccccagagccatattacaagaaatgctaaaggatgcccttaaggtagaagaaaaataccagatggaaatgtggatcctcacaaaggaatgaagagcacagaaatacaatgggtgagtatgtgagattttctcacacgatttaagtatattttaaacaaaaataataatgatgtatcatggatttataacatgtaacagtaaacacatgatataataacatagaatgaaggttaggaggggtggaatagatgtatgcttttttaagggtagactggcaagttaaggtacatgccataaaccctaaagcaactcaaaataaatcaaagacctaactgtaagagcttgaactataaaatgcttagaagaaaacacaggtgtaaatctttgtgatcttggatttcttagctatgataccaaaatcataagcaacaaaggaaaaaaatagataaattaggacttcaccaaaatttaaaacttttgtggcacaaaggataccatcaagaaagtgcagggccgggcatggtggctcacgcctgtaatcccagcactttgggaggccgaggcgggtggatcacctgaggtcaggagttcaagaccagcctcaacatggagaaaccctttctctactaaaaatacaaaattagccaggcgtggtggtgcatgcctgtaatcccagctactcaggaggctgaggcaggagaattgcttgaacctgggaggcggaggttgcggtgagccgagattgtgccatggtactccagcctgggcaacaagagcgaaactccgtctcaaaaaaaaaaaaaaagaaagaaaaagaaaaagaaaatgcgaagaggccaggcacggtggctcatgcctgtaataccggcactctgggaggccgaggtgggcggatcacctgaggtcaagagttcaagaccagcctggccaacatggtgaaaccccatctctactaaaagtacaaaaattagtcgggtatagtggtgtgtgcctgtggtcccagctacttgggaggctgaggcaggagaatcatttgagcccaggaggcacaggttgcagtgagccaagatcacaccactgcactccagtcagggtgacagagcgagactccatctcaaaaaacaaaacaacggcggctcacacctgttaatcccaaccctttgggaggccaaggtgggtggaacacttgagaggtcaagagttcaagaccagcctggccagtatggtgaaaccccgtctctactaaaaatacaaaaaattagctggatgtggtggtgcacacctgtaatcccagctactcgggaggctgaggtgggagaattgcttgagcccgagaggccgaggttgcagtgagccgagatggtgccactgcaccccagcctgggcaacagagtcagaccctgtctgaaaacaaacaaccaaccaaccaaaaaacagctgaaatgtccagaacagacacatccacggatataggaagtagattagtggttgccaggggctggggagaggggggaagagactgactgccaatgggtacagggtattttggggagaaactaaaatgttcttgaataacacaggtttgaactgcacaggtccactcatacatggattttttttcaataaatataatcccttgaccgggcacagtggctcccacctgtaatcccaacactttggaaggccaaggtgggcggatcacctgaggtcaggagttcgagaccagcctggccaacatggtgaaaccccgtctctactaaaaatacaaaaattagctgggcgtggtggcaggcacctgtaatcccagctactcgggaggctgaggcaagagaactgcttgaatccaggaggtggagagtgcagtgagctgagattgtgccattgcactccagcctgggtgacaagagcgaaactcggtctcaaaaaaatatatatattatctctccatatcagcaagttccaaatctgtaaccaaactcggattggaaatacagtactccactggacatggtggctcatgcctgtaatccagcactttgggaggctgaggcagacggatcacttgagctcaggaattcaacaccagcctgggcaacatagcgaaacccaccttctccaccaaaaaaatacaaaaagtagctgggcatggtggcgcctgtggtcccagccactcgggaggctgaggtgggaaaatcgcttgaacccgggaggtggaggttgcagtgagccgagattgcaccatttactgcagcctgggcaacacatgagaccttgtctcaaaaaaaaaaaaaaaaaaaagaaaagaaagaaagaaagaaaagaaagaaaaagaaaaaaacagtattcataggatgcaaaactatatatacagagggctgactctgtatctgtgggtgcttcagggccaactgcctgactccagtatgcacaaatttcagtgtccatggattctgctaacagcgggagttcctgaacccagtcgtcctcgggtaccaagggacaaatgcatacgtaatgtgaggtatatctcaataaaactattctaaaaatatgaaacacttagggatgtatctgataaaatatgtgaaagacgtagacattgaaaaccacaggccaggcaccgtggctcattcctgtaatcccaacgttttgggaggccaaggtgggaggatcatttgagcccaggattttgagaccagcctgggcaacacagagagaccctcatctttcttttttttaataaaaaaaaaaaacttgagtaaaaaagaaactacaaaatgctgctaaaagaaatgaaaaaatacctaaataagagatataccacacgatccagttggtccatttttaggcacttacccaaaataatttaaaacatatatccacacaaacacacagacagacgttcacagcaatactgtccacaatggccaaaaggtggaaacaattcaagtgtccagctacaggggaacacgtacacgaaacggcacagccataaacagaacactactcagcaatgaaaagcaagaaaccatcgacactcgcgccaacgaagatgagtctcaaggtcattaccctgagtgaaagaagccagaagaggaagatgacatacagcagcattccgtttatacgcaattatagaaaatgcaaactatagtgacagacagcacatgcctggttgcctaggatgcagaagtgggggaagccggaaggaactgccaaggtttcagaaaatgttggggtgttatgggctgagccatatcccctcaaaatccctatgtggaagccctaaaccctagcacttcagaatgtgactgtatttagagatagggtcttcaaaaaggtaattaagttggctggacacggtgactcatgcctgtaatcccagaactttgggaggccgaggcaggcggatcccttgaggccagaagttcgagaccagcttgacaaacatggtgaaaccccgtctctactaaaatacaaaaattagccaggtgtggtggcaggcgcctgtaatcctagctactcaggaggctgtggcaggagaatcgcttgaacccagaaggcacaggttgcagtgagccaagatctcaccactgcactccagcctgggtgacaaagcaagactcgcttgcaaaaaaaaaaaagaggtagttaagttaaaatgaggccataggccgggcgcggtggctcacgcctgtaatcccagcactttgggaggccgaggtgggtggatcatgaggtcaggagattgagaccatcctggttaacacagtgaaaccccgtctctactaaaaataaaaaaaattagccgggcgtggtggtgggcgcctgtagtcccagctactcgggaggctgagacaggagaatggcgtgaacccgggaggcagaggttgcagtgagctgagatcacaccactgcactccagcctgggcaacagagcgagactccatctcaaaaaaaaaaaaaaaaaaattaggccatatacaggtacagtggccacacttgtaatagcattttgggaggctaaggcaggaggatggcttgaacccaggagtttgaggttgcagtgagctgagatcacgccactgcactccagcctgggaggcagaacaagaccctgtctccaataaaaagccaacaaaataagagggcatccacctgatccattaggacaggtacaggtagagattaggacatagacatgcacagagggacgacaactgccatctacagcccaacggagaggcctcagaagaaatcagccctgcccgcacctggatgatttctagcctccagaactgagagacaataagcatgtgttgtttcagccgcccagtctgttatggcagtctgtttattacggcagccctggcagactaacggggtggaggacacactcgccaatcttgactgcggtactggctgcatggacacatgcacacataagaatgatcaggttgcccattttgataggtacagttcatctcaaaaaagccacaaaaccacgtcatcctctgcagggaaatgccactctcatgaaaggcggagacatacccaggagctgtccacattccggattaaaggggactcaggtctctgcagctggtcactcccagcatgggagtgaacgcacagcccaggtgcccggtctgctaaaaggaacagcactaggcctcgtggctgcctgcgccatcgtttctgggagtggttctgagagtacagtgtggcactgatcctgggtgcctctgcggatccccaataggccaggagacttcccaggttcctacacactccccggcccccacagagcaagagtagtggatttcttttacaccatgtatgcttctagagcccaatactggacatcagagaagcacagcttcagggccaaagtgcccagttaactccctctcatttcagccccacctccctctcatccccttccctccccattcaccacaactgccctcttatcattgtgtagacatggccagagcagaccaggaactcctacagcagggcacagagtctggcaaagtgctggtggcctgtgcatcacgtgggttagcagagaactgcaaagtgtcatctctggacacctctgggtccagcccgttcgcccaacatctttactcaatgggtgccaggccaagtacaagactcacccagcagaactgaccatggaccctgggggaaggcaccagcactaagaacaaggacagggacaagcaggagggtgcagctccagcctcgcagctagccgggcaggggcagagagcaggcaggcagggtgacagccacagtaaggtgaaggagaggactgtccagaagcacgtgaaggaaagtggggagcccacggagggtgtgagtggtgggagctgagactagtcggattggggctgtcactgtgagtaaagcagaagagctggagggctggagctgaggaaggcagttcagccatgaagtgccacggcggccgctgggtacagcagacagctggagagtggcagggaacaagccacaacacagaggccactggggtgaccccagcagggaggcaacgcattttgctcatggacgttttctggacagcaccaccctctctaggggccctaaaagcttcgaggccttgccacgaagtatacagaatacataccctccttggcacaagccaggccaccagatcccccgccgaccaccaggagatcatagtcccgctgacctgctgagagaagggatgagaggtgggacggactgtctgtctggttaaacgtggtacaggatcaattttatcaggattggacactccattctgtgatggtcaggggtgacaagacaccacacaacagagcagaaagagtgactcgatacacatagtctgtgcaaatccagagaccaagccatatggtggtgaggttggccgtgggcgtgtgtgatcatctttgcaaatcacacgcacaccataccaaccactctgaactcaaacctcacccagtgttctcagccagacacagaactaagatattttcttttttattctatttatttttgagacaggatctcactctgtcacccagaagattgtagtccactgccctgcttgggggagggatgaaaggtgagaaggaacacggtcagcacagggctgggacatagacccggaagggcccccacgacaggggcacagtggcacaatcacagctcactgcagcctctacctcttgggctcaagtgatcctctagcctcagcctccagaatagctgggactacaagcaccgatcaccacgtccagctaaatttttttgttttgtagagatggggtctggctatgttgcccaggctggtctcaaacacctggcctcaagcaatccttccaccttggcctcccaaggtgctagaattacaagcatgagccaccaaggtggactaaaacattctcaagtccacgtgcctttcagttgtgaaggctgccctccgtcacaagtgagcaagaataaaagcacaggctaggggcggtagctcacgcctgtaatcccagcacttttggaggccaaggcgggtggatcacaaggttaggagatcgagaccatcctggctaacacagtgaaaccccgtctctactaaaaatacaaaaaaattagccgggcatggtggtgggcgcctgtagtcccagctactcgggaggctgaggcaggagaatggcgtgaacccgggaggcggagcttgcagtgagcggataccacgccactgcactccagcctgggagacagagtgagactccgtctcaaaaaaaaaaaaaaaaaaaagaataaaagcacaagcagcccctgtccctcacagctggccagtgcacacagccagggtcttggtgtgcccagctgcagtcagctaggagggaagccaccctgggcacagggagagctgcctgggctcaggtttcatccctggaattccttttgggctggttgtggtgtcgcctcaccttggtcctccatggtggctcactgcacatagtgccactctcagcctttttagcctgcaaaaggtgtcatcgtgtctactctgcaagctactggcgaggaaggcaggcaaggggcagccaaaaaagggagggatggagaagggactggagggaggaagtagagaggggaagtacactgaactgggcctgaggtccgggacacccagcaccaggcaccagccaactccctgctgaaggaaggaagaaataatagcaagtcatcagtctgctggggtgagggcagggtggggactgatgacaagactctagggtataaaacaagtagtgccctcagcccctctgcagacacgagcctgcccagatgagaagcaccaccctcccagagcatctggagccggtcgctgcttcagacaaggccaagaggttccatgatcagagcagggtctgtcatacaaggctgggcaacctgcccaacacctccatcagagcctagcgtctgccatgagaaggctgcacttatctttgcagccacctccaccttcctaggcaggcaaggctgcagagagtgtacttggagtgtcatgtctctccacaccctggccctgcagatgccccacagacaggtctagaacatgcactcctaaaggatacaagagctggagcctagaggagccctggctcacagctgagaaagcttgggaagctgcatccaggcactcaggccatggcctgcagcgagcctgccccacaaccaaacccacccactctttcacctggcagccagcctctgagtgcacgtgagatgtgtgcgcacctgcgggaactgacagagccacaactcggttccaacagccagtccaaagcacactcaattcctaattcaactcaagggctctggaaaggcctaaattgttgtaaattattctaatggctttaatataagtctagagaaccaaggactgctggtcagggagaaaatgccaccaggtcccccggggagcatgaacctgctgatggagaagcatctctctcctccagctgcctggtagccggaagctttgctcagaacgtccctaccttccatggcaggtgcctgtccttcttgttgccatagcagggcccttgttaggtcatcctgccctgcagcctcgcactgtgccccctctgtctgctatcaggcagggtgagcagctgtctgtatggatgtgcttatcttgggcagcttgctcgccccctgtgcacacccaggagccctctcgggctgataaacactggcatagggcagtcgtttgcaagcataggaaatctgcctttaagcacttggaagggcttgggtagcctgctgggaaggaaggaccccaaagtacctcaaaggtgggtagggcagatgctgttctgtgggaggaagggctgggtggcaggcgttacctggggacacaccacctgtgcactccagtgtcctggagaacctcataaccttgcctttcacccactttagccaggcataccctctccacctgcagggcttggccccagcaagtgtctgtcttgcctctgccttctgacatattgtccattaattttctgctcctctttgaacccactgcctggtacaggccagcaaagagcaggagcccagagctcatagcaaggcccaagagaatgcagcactgcaccagtgagggcaagtggaagggtcccccaaaatgtgcacccacaggcaggctggccacctcagggtgccacctcaggggccctcctgtatggctgctctatctagagctctttcctggcagcaggtgttgtcattctggctcctgttcaggggctgcatcgcccacccactccaagcctgggacagttcaggtcttcctactctaaaaggagaaactgcagggcccacagtcccagctactagggaggctgaggctggagggtgagttgaacccaggagttcaaggctgcagtgagctatgatagcaccactgcactccagcctggttaacagagtgagactctgtctcagaaaaaaaaaaaaaaaaaaactgcacccctagtctgggtacagtggctcacacctgtgttgcaggaagtcaggaaccccgaatggagggactggctggagccgtggcagaggaacataaatagtgaagatttcatttcaatatgaacatttatcaattcccaagtaatacttttatacttttttcttttttttttttttgaggcagattctctctctgtcgcccaggctggggtgcagtggcacaatctcagctcactgcaagctccgcctcctgggttcacaccattctcctgtctcagcctcctgagtagctgggactacaggcacccgccaccacacctggctaattttttgtactttcaggagagacagggtttcaccatgttagccaggatggtcttgatctcctcaccttgtgatatggctgcctcggcctctcaaagtgctaggattacaggcatgagccaccgcgcctgggcccccaagtaatacttttataatttcttatgcctgtctttatctcttaatcctgttatcttcataagctgataatatacatcacctcaggaccactgtgataattgtgttaactgtagaaattgattgtaaaacgtgtgtttgaacaatatgaaatcagcgcaccttgaaaaagaacagaataacagtgatttttagggaacgaagacaaccataaggtctgactgcctgtggggtcaggcaaaaagagccatatttttcttcttgcagagagcttataaatggacgtgcaagtaggagagatatcgctaaattcttttcctagcaaggaatattactattaagaccctggaaaaggaatgcattcctggggggaggtctgtaaacggccactctgggagtgtctgtcttatgcggttgagataaggactgaaatacgccctggtctcctgcagtaccctcaggcttattagggtggggaaaaaactccgtcctggtaaatttgtggtcagactggttctctgctcttaaaccatgttttccgttgtttaagatgtttatcaagacaatatgtgcacagctgaacatagacccttatcaggagttctgattttgcccttgtcctgtttcctcagaagcatgtgatctttgctctgccttttgccctttgaagcatgtgatctttgtgacctactccctattggcacaacccctccccttttaaaatccttaataaaaacttgctggttttgcggctcaggtgggcatcatggtcctaccgatacgtgatgtcacccccagcagcccagctgtaaaattcctctttgtactctttctcttcatttctcagccggctgacacttacagaaaatagaaagaacgtacgttgaaatattaggggcaggttcccccaatatctggcgcccaacgtggttttctttttcctaagtgcatgtgggaacccgattccctttggtaggtgcggagaaatgttcatcggtccagtccacagaaatgcttgtttggctccccaacgattggtgagttgtctgtgtattctccggggtaactatgggtcacgcagagtctaaacattatgcttatctctgctatattaaattcctgttaaaatgggggagttcgggttcccatggaaaatatggtcaccctattcagggcagtggaagaacactgtccttggtttcctgaaaagggaacgttagatgtggaactatgggatcatgttggtgcaaaattccgagaactggtcccaacaggaaattatgttcctgtcactgtttggggtgattgggccttggtacgtgccatcctaatgacataccaatcccgtgacaccctgcagttaccacagttttctgaatctggccaccctctacctcttcctcagctttcctctcccactcggccttcattatctgctcagcccctccctttgcctactcctcccccacctgacgatactgaggattcaatatctaactccagtgactttggcttaacatcaccccctgatgatcttatttcttttcacgaagagccgacacttgtagctcctgcggccccaactcagacagcccaggaccatatctatgctaactcttccctctccaaacctttacagtctttgcctccggagccatccaaactacaatttacctgtaattctgcaggccctcccccatccaccacagcccctcaccctcctatcattttggtccctcaaccggtcactttgccatccactcaacctgcttctctgtacccttcttcatgcagggacacccctgccactctggttgtgcaggactgggccagtaatcaccagtatgcttctgcctcttctgctcccccaatgcccctttctcacactcttataccagtccgaccccgtcaatctcagtttctcttatctatacatacttttcctgtcacttctatgccgactctatctcatgtgcctgctcttgaaactttcatgcaatgcttattacgccaaaacaaacaagtagattagaggcgtgggcttattcggtcatgctggaacctcctaatgctcaaggggtacaagtgtgtcgatatacgccgctcaatcttacctttttaaaagaattcaaggatgcttgtactcagtatgttcctacttctccatatgttaaaacggtattacagactctttgtaccgaggtcattttgcttcctatagactgcgaccttttggcaaaagctgttctaactccatctcagcatttacaattccatacctggtggtcagaggaggcccgcctgcaggctcagctaaatcgggctgatggcattccaattactcaggctcagctcacaggctccgataattactctgatactactgctcatttaggctttgatgctctcaccacggaacaagtaacaaaggtgtgtatgagagcttgggataaattacgcaccccaggccaagcttctgtttcttttactattgttaaacagggtcacaatgaattatatcttgattttttagctaaattacaagatgctgttgaaaaatctgtctctgatgagcacactcaaggtattcttcttcatatgttagcttttcaaaatgcgaaccatgagtgtaaaatggccgtgcattccatcctacgtcaaaatttacctgatcatgaggtgttgcctgcatatattaaagcttgtgaaggcgttggatcggagacccacagagctattctgtgggcaccggccatgaagcacggcaaccaaactggctcgactgattcttttcttggagcctgctataattgtggccaacttggtcatacccaaaaaaactacactgttaaaaacttaaaagcggccaagccggctcaacaaacacggccaaatgctcctgctactgtttgcctgcgttgtcgtaagggtaaacattgggcaagtacttgccactcagtctgatatagatgaaaatcccttgccacagaaccagggaaacaggaagcaaggccagtcccaggccccaatatcaaatgggacacctcggactcagaccaatgttgtgtttttgcgtcaagcagtcccaacgcagcccccagcacaaacaaatttacctacagccaatccagatgggtcccagcctcttcttctgtctcagtacaatgcttgtctacctccacagtaggcagcagggcggtcgatctctgtagtaccattcctctaaatttactacctaattctttgcctttaattgtccccatgggggtcactggccctttacctcaaggttcggtgggcctggtgttaggcagggcatccacctcatgatactaaaggtatcatagttcatactagtctcattaattctgattcctctgatgagattaaacttatgtaaacttatggtgtctgccaaagttcctgtttccattccggccagtgagtcaattgctcaattacttttactacctaacattgttttaaacaaaggagataagacatggggccctgggatgggctccagcggtgaaaaagccgcttattggattaatgtaatttctaaacaatggcctacctgcaccatacacattcaaggaaaaaaggttgagggcctagttgatactggggctgatgtttctattatttcctctaatttatggccttcctcctggcttaaacatcccactaacatgaaactagaaggtgttagaaaagctgaagaagttcaccagagcacatttatcttggcttgcactggccctgatggtcaaaagggaacaattcagccttatatcatgcccatccccattaatcttcggggcagagatttgctggcacaaattggggctgaaattaatattccacataacttttacagtgctcccagtcaacatataatggaaaacatggggtttgtttccagactcggtctcggtccaaaacgtgaaaaaattactaaacctcttcaagttactgtaaaagaagacaaggctggtttaaaagcataatttaactactccccactcccaattatatttagcattgtttaagctttctaaatgttcctaaaaacaatactctgactgcagctaaatgccattatacaggcaaaaaattctccctaaacgaaggcaagccagtgtcatggaaaaactcccaaaccaatacctgggaacctggaacaattataacgtggggaagagggtatgcttgtgttttaccaggagatcgtcaatcccgtctgggtgcccactaggagacttaaacttcgtgtgaatactgacaataaaaaccacgaggaagagacgttcgcgtcagagactgccctcatacctgatgagatctgtaccgactcctcagaaactggcatgccaaatcaaaatgggtctggttcaatcctccctaatggcaatgtaaacccctctaactaatcccacttctcctaattatctttttctccttacgaacctaaaaatctcaccatttctattagcctgaaaataacatccctctgttcttctcttcctccttcagcactggatctcacttacaataggttttatttaataattatcttccttacactttctgtctcaccagtttccccttaaactgatttacctgctacacaaaattattcttattgggcttatgtgccttttcctccacttattcgacctctcacctggatggatgctcctgcagaaatctatactaacgatagtgtgtggatgcctggaactacagatgaccgttgcaccgctcagccaggagaaggcactgcatttaatgttactatgggttataaataccctcctctgtgccttggacatgcacctggttgtatccatctagaagctcaagtctgggctgcttgtcttccagagagattagctatagggaaatggggacatttggtctctggcctctccctttctcctttaagacaaataaaaagaggagtaataggagataccccatactttcaatataaacctgtaggaaaaccatatcctaaaaattttgagggcccatctaaaacttcaatttgggaatgattgtgttaactcacatgcagtagtattaaaaaatgactcggctgggcgcagtggctcatgcctgtaatcccagcactttgggaggccaaggcaggtggatcatgaggtcaggagattgagaccatcctggctaatacagtgaaatcccgtctctactaaaaatacaaaaaaaattagccaggcgtggtggcagatgcctgtagtcccagctactcgggaggctgaggcaggagaatggcgtgaacccgggaggcggagcttgcagtgagctgagatcgcaccactgtactccagcttgggcgacagagcaagacactgtctcaaaaaaaaaaaaaaaaaaaaaaccccaaaaaaacaactcatatggtttagtaacagactgggcacgaaagggctatttaaaaaacagttgctcctctggcggaaaggaatgcctggagactacttattttatttcttactgggaggaccaggatcatcatcctattttgcatagaaggttcagtttgttctttcccttaaaataggaagataagggcattatccccctaagtctcgtatgatattccccattctgagtccagaatacctagaaatttggaatttggctattgccgtgtctggactgtgagtatgggaaggggaagcttttctgtctgttgtccccactaccgcccctcacatccgtgattctgaaccccatgataaatgccctttgaacctttttcctccttttgatgccgaatccccttttatgggactccgccagcacgggtgcatttaaccttcctgagcttgcccacctgacgcatgcagccaagaagctttgaaagatggagtgccctggctgagggttccaggtctcagcaaggccacgaggtggtgactgcctcccagaactctgttgggccaccctccgtcctggagacccccaaaacctccatagcaccaactctgcccattcacacacacagtcagccctccctcccgagtccaccgcgggcagagggccagccaccatgcctcccatagccgccatccctgggaaggagccctgaccccgtccttacacccctctacactcactgcctgtggggagagctgctcgctgtcacaagcatccagggggctgggtcgaggggccccctgcatggtgggggaccatgttgtcgtgcatggaatgaaactggccacacataacagatatggtggcgctctggtcggatctaggggagtctgtcctacaggatgaggcttgaactgtcctgagtgaccagacacccagcctctgcttcgagtgctcagttatgattattgtcctgatttagttaactgttcttcaggggctccaggaggacgagtgtgtatcctcccattgctctgtgcagcctctaacctctagagtctaggggtctggggagaagttgggaagtctggccagtggggccggtgcctggtgacctcgggaggtgggatatcatcatcttcagaactgtagttgttactgggataccagctctgggagaccacaggtgcagtcagcacagcaggaccttagacaaggcacccagccccagtttccccacctgggaagggggctacttgtggctagaagcagcccggactcctgagcaagactagaccaagaggccggtatgtggacacccccgcgtgggcacccccacggggacaccctggccaccgccgcgcggacaccctcacgaggacaccccggccgcgcggacacctaccgcggggacgccccgaccccatcctacctgctgcgccccgcgccgcgccccgcaccccgcccgccacggcctgcgtccgccaccggaagcgccctcctaatccccgcagcgccaccgccattgccgccatcgtcgtggggcttctggggcagctagggctgcccgccgcgctgcctgcgccggaccggggcgggtccagtcccgggcgggccgtcgcgggagaggtgagagcgctggctagaccggggccgaatgcggccggattcggggcgggggccttcagacctagggtggaacactgggatagggtgtggggaattcggaccgctgtgaagtgatctgacgttgggtgggagtctccggacttggggtggggaatctggatgggaactggggaattcggaccttgggtggggatctttggaccggggtggggtccccagactccttgtggaaagctgaggttgaagatctgtgctgtgatgaggggctccagatagcggtgagagatcccgcttcaagactgggttgggggtccagaccaggaggataagcctctccctggagtagggcttgacctggtgagggtgtggtagagtcacaggggagggtcccacttggtccttgggctgggatcagactctcagagctggagagttgcaggaggcctgggggagggtctgtggagccccagactcagagggccttggtgacttctccaacaggctccctgttggaggccttggggtaccccagggcctttccctgcaagagagaggctgctccaccaggaaggggcccaggactccccagggtcggggggatgtgtggtgtgcaggaccacgtgggaatgttagagaaaggggaagtcactccgggcctgccctgctaacagacctgctttttggatttttccagccagggatttttgtgtcctgttgctttttattgtttaaagtgaccctccaagcctgagggaccgtaggagctgccctgcagagcccagtgagacactagttaatgcagaaaaaacagattttacttggtaactactgacaacatgagaaaaagctggctccatgctgatttgtctagatgtgcctggagtttaaagggagagtgagggagtgggaaggggtggggactcagtagagttagggaaacagaaaatcaccaaaactgggaagggagggttggcccctgtgaaaccaactgatctgggtttgccactggggcttaccgaagtcaggcccccaacctcccacagagactgggagacaggggccccatcctcaggtgttggctggaacacacaggaaattcttgtggcagccttgaacttctcaggcaggcactttagagggggctaggatcgttctgggaatgtggccttgagctgttaggagctatgttagtgttcgttccagcctagataggccagggtgaggcccagtggagaaggggactctaaggagcctggctggagtgtggggagggagggtctttgtcagcactccccctgtgcaagaagagcagagacctgcttctttcctctcaacagtccccgtccattttctgttctgtgttgtgttcataaactaccagcgggaccatctgttgagacttggtagcaaaggatttttgctggatgatgcaagcagtcaagcatttaatgaggaaacaaaaataacaggccaggcacagtggctcatgtctgtaatcccagcacttttggaggccgaggaggatcacttgaggccaggagtttgaaacaagcctgggcaacataaagaccccatctctacaaaaaatttaaaaattagcccggcgtggtggcatgggcctatagttccagctacttgggaggctgaggtgaaaagatcgtttgagcctgggaggcggaggctgccatgagccatgatcttgcctctatactccagcctgagcaacagagagcccctatctttaaaaaaaaaaaataataataaaataaaaaaataaaaagaaagaaagaaataaaaacaaagatgaatggagctgttgataaacccagtttttgagcctacagggcagcagttgaggtttctggccgttgggccctaacaaggccagcaggggcactcagggacttcctggtgtgtggtgtgaagtctgtgatgatggcataggcattggtatcccagttgtggttactttctggagagagcatgtggcatgcaggagctggagggggggtcttcctgggcggcctgtgtagcagcagctccaggcacaaaggctgcccctggagaatctgttgtggttctgagttctttcaagtttatatcaagttttccggcttcagtctgcagggctgtttttttcagatcctgggggcaaagggcagctacaagaccacctgagtcccaatagggatttgagttcttggtgacaccaagtcagggaggagacaaattagaaatgtcagtctgaagagagtggtaggtagccagatactgaaggaaagtagatgggaggatttggtaagggctgacgtgtaggaaggcagtgacagtccaagtgacaggcagatcataaaacctcaaggataggccgggcccggtggctcatgcctgtaatcccaagcacttcgggaggccgaggtgggcaaatcacccgagtccagaagttcgagaccagcctggctaacatggcaaaaccctgtctctactaaaaatacaaaacattagccgggcgtggtggtgcactcaggaggctgaggcgggataatcgcttgaactgggaggtggggggctgcagtaagccgagatcgcaccactgcactccagcctgggcaacaagagcgaaactccatctcaaaaaagaattaggccgggagcggtggctcacgcctgtaatcccagcactttgggaggccgaggcgggtggatcacgaggtcaggagatcgagaccatcctggctaacacggtgaaaccccatctctactaaaaatacaaaattagccaggcgtggtggcgggcacctgtagtcccagctacttgggaggctgaggcaggagaatggtgtgaacccgggaggtggagcttgcaatgagccgagatcacaccactgcactccagcctgggcgacacagcaagactgcgtctcaaaaacaaaacaaaacaaaacaaaacacctacaaaagacagtgaactagactaggatctgataactcccaagggggtgttatatttctccactgaagcatagcatttctctttacaaacccttcccttttgattgaagataatcaaagtgagattattcttatttaccaaataattctggtctcattaaatttggcctgattatttacataaatgcagcacgaacagtaattgaccacacaggcctttttaagtttgctgaaacttttaatagggaatcttagattgagctttttaaagccttt[450 bp omitted]aaagataattgcttcaattttgtttagagaagtatcatttactataatattacgagtcattgataggttaagagaaaagggaaaggtttctttctttttttcttttttgaggcagagtctcactctgttccccaggctggagtgcagtggcgtgatctcagctcactgcaagctccgcctcctgggtttacaccattctcctgcctcagcctcccgagtagctgggactacaggtgcctgccaccacgcccggctaattttttgtgtttttagtagagatggggtttcactgtgttagcaaggatggtctcgctctccagacctcgtgatccacccgcctcggcctcccaaagtactgggattacaggcgtgagccaccgtgcccagccggggaaaggtttctttttttaatattcagaaaataaaacataaagagccaacaatattctgaacaaaagtcataaaaagactgtaatcatccttcagcagtttactcagttgcatgcaggtactgaattcttgttctgcttgatcttgggctagcaggtacatgaacccatcttttctcaaccagtggagatcctggctcagtgcagtcatgtgatctcaaagttaagaaatgctgtcacgcccaggtgcagtggctcaggcctgtaatcccaacactttgggaggccaacgtggctatatcacttgaagtcaggagttcgagaccagcttggccaacatggtgaaaccctgtctctaccaaaaaatacaaaaattagccagttgtggtagcagacgcctgtaatcccaactactcgggaggctgaagtgggagaatcgcttgaacccgggacatggaggttgcagtgagccaagatcacgccactgcactccagcctgggcaacacagtgagactccatctcaaaaaaagaaataaagaaatgctgtcagaagcctaccccatggtacctgtcatgggccttttcattggtccctttttgttgaagatgaagcactttgccctgtagctgattgcaagagatttcaggaaagcatcagagtaaaactctaatgacaaaagacttaaaatagtgtagttaaatatctaatgagagatcattacaaaatcaaacgatttacaaggaatgttggttgtttatgacacatagcattttaaataataaccagaatgatgattgctgttatatgaggacatgtcattggcagaagggtattcaccagtttgtgggaactttatacaatatctggaatccttatattaacatttaccaatatgcatgtaactcaaggaagtttaaatagcattaaaaaaaatttttttttagtttttttttttttttttttttttgagacagagtcccactgtgttgctcaggctggagtgcagtggcacgatctcggctcactgcaacctccgcctcctgggctcaagcgattctcctgcctcagccccccaagtagctgggattacaggtgtgcaccatcacacccagctaatttttgtatttttagtagagatggggtttcgccacactggccaggctggtcttgaactcctgaccccaggtgacctgcccaccttggccttccaaagtgttgggattacaggcgtgagtcaccgcgtccggccctaaataacattttttatttgacagcaccttgcatgaaattctgtagggtccagccctacagggtctgtgggtttttctccccgtgtgcagagatgagagatcgtagaaataaagacacaagacaaagagatagaagaaaagacagctgggcccggggaccactaccaccaagatgcggagaccagtagtggccccgaatgccaggctgcgctgttatttattggatacaagacaagggggcagggtaaggagtgtgagctatctccagtgacaggtaaggtcacatgggtcacgtgtccactggacgggggcccttccctgtttggcagccgaggcggacagcgagaggagacagcttatgtcattatttctgtatttcagagacctttagtactttcactaattttgttactgctagttagaaggcatagccaggtacagggtggaacatgaaagcggaccaggagcgtgactgcttaagcacagcatcacagggagacggttaggcctccggataactgtgggcaaacctgacactccacaagaggtggttgagcagagtcttctctaactcccacagggaaagggagacttcctttcccggtctgctaagtaacgggtgctttttctaggcactgacgcaactgctagaccaaggtccgctaagtaacaggcgtcttcccaggcgctgacgttaccactagaccaaggagccctctagtggccctgtccgggcataacagaaggctcacacgcttgtcttctggtcacttctcaccgtgtcccttcagctcttatcactgtatggcctggtttctcctaggttataattgtagagcgaagattattataatattggaataaagagtaattgctacaaactaatgattaacaatattcatatataatcatatctatgatctatatctaatgtaactattcttattttatatattttctttattatactggaacagctcgtgccctcggtctcttgcctcggcacctgggcgacttgctgcccacaaaattcaccattgaaataaacctaattagtttaacatctctcttataaggtcacaggacagatcctttgaggtcttccaggggccctccaggaaatctcaagtcagtctgagatcaagacaatgtcacaggccacatgcagtggttcacgcctataatcccaacactttgggagtccgaggagggaggactccttgagcccaggagtttgagaccagcctgagaaacatgctgaggccctgtctctacaaaacaaaaagttgaaaaattagctgggcatggtggtacatgtctgtagtcccatgtactctgaagactgaggcgggaggatcacttgagcccaggagttcaaggttgcagtgagctgtaattgcaccactgcactccagcctcagtaacagagtgagactctgtcactaaaaaaaatttaggctgggtgcagcggctcacgcctataatcccagcattttgggaggtcaaggtggacagatcacctgagatcaggagttcaagaccaggctggccaacatggcaaaaccccacctgtactaaaaatacaaaaattagctgggcgtggtgccatgtgcctgtggtcccagctacttgggaggctgagacagcagaattgcttaagcctgggaggcagaggttacagtgagcccagatcacaccatggcactccagcctgggtaacagagcgagactctgtctcaaaaaaaaaaaaaaaaaaaaaaaaatttaaagaaactttatacataaatccattcaatgattatgaggtcaattctagccagctttgacctcataacataaaatttcttttctgcagactttcttgaggccaggagttcaagaccagcctgggaaacatagggataactttctgtatccattcacagttgcttttgttttgagacagaatctcagtctgtcacccaggatggagtgcagtggtgagatctcagcttactgcagccttgacctcctgggctcaagcgatcctcctgcctcaccctcccaagtagctgggactacaggcatgtaccaccatgccaggctaataatttttgagtttttttatagaaacagggtttcatcatgtttcccaggcttgtctcgaattcctgggccattcaggctttgtcccatatttttcctctttttgtaattttacttcaggacaaaattacatccctttctttaacaaaaacactctacattctttgcatacttttcatataaaaacacatcctatcttcctcccatactttgtataggaaattgtttccctcattcttattgtttctaggagttttgttttcatatattgattataatttttaaccattagtaaccggtattttttttttaaagagacagcgtcttgctcttttgcccaggctggagtgcagtggcacaatcaggactcactgcacccttgaactcccgggctcaagtaattctccaacctcagccccctaaagcactgagattacaggcatgagtcaccacgcccggccataacttgtattttacaagtaaaactgggaagaagacaattggaaattgtctgtcatttaccagtttgttggcaaattttatgaatataccatcttataatctctagaggtatatcctttttatagtacaatgtttttaagtgccaagtacatgtttattaacagaccagaatacctttagccagtctgtaccatataaaaataagaagccaaaaagtacaaaaagttacgcttaataatgaatgtttcagcactttcttctcttcaggtattatttagatattcaatgaatgtctattatttaacttcacttagtatgactctgaggttgaaagttactgaaaacatcttgtaagcttttttaggccaatatattatcaaacgcaattaacaaaacacaactcactagtttatataagagctagttctcacttttttttttactctattttatatattttttcttttcttttcttttcttttttttttttttttttttttctgtagagacaaggtcttgctgtgttgcccaggctggtcttgaactcctagcctcaagtgatccacttaccttggcctcccaaagtgctgggattacaggtgtgagccaccacccagccctattttatatttttatctgaactgtgtttctggcaaattggacaagttaagggtcacttgctccatgtgaggggaaggctttctacctgtatttgtggataagacctttacgacttgttttgccctgatggatgactacatgtttccagtgagctcagctggttgcttttgtgggtccctgaggcactgcgagcccctgatggggcaggaagcctaaagttccagggaccgtggggagttgaggggctggagggggaagagagaggcctgcagcggggatccacaggtggaggaggccagacttgaagggggtgtctccttcaagagaaagtagggaagtatggaggtgataggaagggagaggcctgagaggagctagtttggggagatctcaagtatcccaaaggagccactgatgttccaaattatccttggtaaagtcacatcaacaaggaaggaagcagacagaggcgcacttgttccttgcagttttgttttgatgtgctgattaaagtagcgcagagggcatgatcagcagggctccagtaagacgctcccacgggaggagcaagaacacagaacagagggggcaagacagctccaccaggagtcaggagtgaatcccctctgggaacgaggcactaggaagaagaacttccagcccaggaggtaggtagcgttcagaagaagcctggggcgggcgcggtggcgcacgcctgtaatcccagcactttgggaggccgaggcgggcgaatcacgaggtcaggagatcaagaccatcctggctaacacggtgaaaccccatctctactaaaaatacaaaaaattagccgggcgttgtggtgggcacctatagtcccagctacttgggaggctgaggcaggagaatggcatgaacccgggggacggagcttgcaatgagccgagattatgccactgcactccagcctgggcgacagagcaagactctgtcccaaaaaaaaaaaaaaaaaaagcctgggactcttagcgcctcagagccttactcagaatcataaaatcattagaagcaatgtctgtcctcactgctgcatccgatattcttccggaccactggatcacaaatcaaaccatgtgactcccgcatgagcaggcagagtggagataacacggatcgctgtgtacactgtgtgctccggttgttgcatccgagggttgatcggatggtggttcccatccagatccaagtcctggcccctgatcacagagaaacacagctggacattaaagtggtgaggacggaaattataatatttggtgaccagtgacaggaggggagagagccgagctccgctccgagttgtgcaaagaagtggggagtggggaggaagaacagtggggactcagtggagtgaggaaagtggaaaattaccaaaagcaggaagggagggttagccttgggaaaccaatctgggtttgccacgggggcttactgaagtcaggcccccagtcccacagaggctgggagacaggggccccatcttcaggtgttggccagaacacaggaaattctcttggtagccatgactttctcaggcaggcgctttgaagggggctgggatcattttaggaatgtggccttgagctgttagaagccatgtgcagtatggcttacacctgtaatcccagcactttgggaggctgaggctggagaatcacttgaggccaggagtttaagaccagcctgggcaacatagcaagacgctgtctctacaaaaataatttttaaaaaattagccaggcactgcggcatgcccctgtgtagtcccagttactcaggaggctgaagcaggaggactgctggagcccaagagttcaaggttgcagcaagctgattgcaccactgcactccagcctgggcggcagaggtgatcacgccactgcactcccgcctgggcgacagagcaagaccctgtctttaaaaacaaaaaggccaggcaggtgcggtggctcatgcctgtaatcccagcactttgggaggccaaggcgggcggatcatgaggtcaggagatcgagaccatcctggctaacatggtgaaaccccgtctctaccaaaaacacaaaaaagttagccgggcgtggtggcgggcgcctgtagtcccagctactgggaggctgaggcaggagaatgccatgaacccgggggatggagcttgcagtgagccgagattgcgccactgcactctagcctgggagacagagcaagactccgtctcaaaacaaaacaaaacaacaacaaaaaaaaaacagccgagcgcagtggctcacgcctgtaatcccagcactttgggaggccgaggtgggcagatcacaaggtcaggagttcaagaccagcctgaccaacatggtgaaaccttgtctctactaaaaatacaaaaattagctaggcgtggtggtgtgagcctataatcccagctactcaggaggctgaggcaggagaatcgcttgaacccaggaggcggaggttgcagtgagccgagatcgcgccactgcactccagtctgtgtgacagagtgacagcccgtctcaaaaaataaataaataaataaataaataaataaataaataaataaataaataaataaaatgaagcagcagcagctttgttagtgtttgttcaaggcctgataggccaaggtgaggctcagccgagaaacgtgctcagaggagcctggccggagtgtgatgggggagtctttgtccaggctgctgccacggtgggcctcaggactcatggcctgggcgctgggggtggggctgccactcagccttgaggagagcaatgaggaggtcagattccactcacatccagtgcggtctggatgcaggcctggcccagagcctggtccagatgctggggctttgtttttttgttgttgtttttttgagacagagtctcgctctgttgcccaggctggagtgcagtggcactatctccactcactgcaacaacctccacctccacggttcaagcgattctcctgcctcagcctcccgagtagctgggactacaggcacccgccaccatgcccggctcattttttgcatttttagtggaaacagagtttcaccatgttggccaggatggtctccaactccagaccttgtgatctgcctgcctcagcctcccaaagtgctgggattacaggcgtgagccactgcacccagccggctttgtttacagtactcagcagctgccaaaatagtccccattcccaggcagggcaggctcccgggctcagtccagcggggcagatggccagcctgcacgtcaccccactaggcatgtccaggccctttctgcccctccctaaaggcacccctgtcctttctgtcccctccacactgagccaagccagcctccactcttgccccaggcctgccctctgctgggagccgggacactgagctcctgccacatgagcaggttgacctgcagggggcctccaagcaggtgccaaggcagaatcggatgtgaccaggagaacacccttgaaggataaagcgaatgtgcgaccaccatgcaggtctggcccatggaagggaggggagggggccccgacggggccacagtaaaggagtggaggggccccacaggcagggatggcccagctggccccctggggctgtgaatctgcaggtgcagtgcagcctcttgcctctctcagcccagcccttgcatctgcctcttggtgtgtctgtgaagacaaagtcaccgtggtccctgcagcacctggcttgaagcaggtgtgcagtccgtgtgaaagccttccctttagctattaggtattgagtcaaaaaaaaaaaaagccttcccctgagcctgggggcctggccccactgaggataccaggcgggggaggctacaggaggctgccctctgcctggccatctgaccttccattctgaccccttcccttccacaccagcccctttccctatgtagggtgcagtctttgttgcaactgctcacctctgccatggtcggatgagagcagccacggacaatgtctgtgcaattgtgcgttttttgttttgttttgttttgagatggagtcccactcttgttgcccaggctggagtgtaatggcaccatctcggctcactgcaacctccacctcccgagttctagcgattctcctgcctcagcctcccaagtagctgggattacaggcatgcatcaccatgtctggctaattgtgtatttttaatagagactggggtttcaccatgttggtcaggctgttcttgaactcctgacctcaggtgatccacccgcctcagcctcccaaaatgctgggattacagacgtgagccaccgtgcctggttgattgtgcgttctgataaagcttcatttacagaaatagcaggtaggcccctcgcagggtgcccagagcaggtgcactgtctcacctcttctcaggtgtcaccggggtgagaggctagtcctctgcctcctccttcctctctgcaggttggagaaatgacagcttcttgtactgggggttatgagacagtggcaggagggggacactcccagagtgctgccagaaagaggcgaggccccatctggatttgatggcatttttattgtggtgttgttttagagacagtgtctgtcgcccaggatggacgacatggtgcaatcatggctcactccagcctccaactcctgggcccaagcaatcctcccacttcagcctcctgagtagctgcagctataggcacaccaccatgcctggctcaatgggtattttgtggccattaaacttctggtcattcctttagattcccagaggctggatggaggtgagtggccagcccctgggtccagagatgagcgcggggcctggctgcagcctgtggggtctcccaggctggcctccaggtgtcctctcagcctgtccacaggcgctgcccaagcgtgtggcctacctggtgctgcctggcctgtctctacgcacctgtactggctctccctggattactggatcgcagtcgaatcccctgccagaatcctggtccccctttatcacaccggatcagccccaaagggcagggcttcttgcagcagttccagcctttgctgggggtttccagccctgttgagcaagccccaggtagggccctctgcagcccccgtgggggacctgtgtgccgagcagagctgccccgtgtgtaaacgcttagaactggcctccttcctgccatctgtgtcctgtttgtcatcacgcctgtggctctatgcttgtctccccgactgggccaccagccctgtgagggcaggatgaggcacgtccaagccacagtggctctcagtgtgcagggtgctgttagcattggttctgtgttctggaatagtgagaacagtgtgccccaaatggccagtggcctttccgagggtcactgcagccgcatgttggccctctgtggagaacggaggatgcacagccatttcagagcacaacctgaggtctcctgagcttgctgtgcagcccagtctttctctccgtggcccctggtagctgtctttctcccaggaggaggagaaagacaccttcctgagcaggaggatgtgggtgaatagagaccaaagtgtcaatcactcttctgacagaggtgatagcagaatgaaaaactgatggaccccagatctttgcaaagagaacaaagtcagtttctagttatctttctttcttttttttctttttttctttttttttttttttttttttttttgagatggagtctcgctctgctgcccaggctggagtgcagtggtgtgatctcagctcactgcaaccgcctcccgggttcaagtgattctcctgcctcagcctcctgagtaaccaggactacaggcacacaccaccacgcccagctaatttttgttatttttagcagagacagggtttcaccatgttggccaggatggtcttgagctctcttttttttttttttttttttttttgagacggagtctcgctctgtcacccaggctggagtgcaatggagtgatcttagctccctgcaacctctgcctcccaggttcaggctattctcctgcctcagcctcctgagtagctgggactaacaggtgcttgccaccaagcctggctaatttttgtatttttagtagagacagggtttcaccatattggccaggctgatctcgaaatcctgaccttgtggtctgcccgccttggcctcccaaagtgctgggattacaggcgtaagccaccacaccaggcccattttctagttatcttttacggattttttaaaatgagcctagaaaccaggtcatataattagtttattttttaatttcttatagagacagggtcttactatgttgcccagagtggtcctgaacgcctgggctcaagtgatcctcctgcctcagcctcccaaagtattgggattacaggtgtggccactgttccagccatagttcatattttaaaggatttttaagagtctcatttcactgatgttacttgcagtatatttatggaaaacattcctgtcttttttttttttttgagacggagtctcactctgttacccaggctggagtgcagtggcgtgatctcggctcactgcaagctccgcctctggggttcacgccattctcctgcctcagcctcccgagtagctgggactacaggtgcctgccaccacacccggccaattttttgtatttttagtagagacagggtttcactgtgttagccaggatggtctcgatctcctgacctcgtgatctgcccgccccggcctcccaaagtgctgggattacaggcatgagccaccgcgcccggccagcattcctgtcttttaaagaaagatgagaccagatgcagtggtgtgcacctgtggtcccagctactcaggaggatgccttgagcctgggagttcaaggctgcagctgcagtgagccttgatcacgccactgcactccagcctgggcaattgaacaggaccctgtctctaaagaaataaaataaaggcagatgaatgtcatctagggtgtgtccaatgtgagagagaatactgaccaggtgacagaggtgatggactctctagctctgcagcagactgctgggcagagaagcttgggcaggcctggcactgaggcccagaagcttcatgctctttagagccagaggtgtcaagcccagctgcctgtgtcctggccgcactgtgaggcactgaggatgccctcacacgtgcatctgcatgtggcgtgcatgtggcaagcatgtgcaggtgctgtgtgggcacgatcatgcctgccctctactgtgctggagaggtaagaccatcagccgtttcacagaggagggaatgtggacctcacgggggtctcatgagcttgcgagccgatggccaggcagccggtgcagaaggttcatccattttgatgaaccgtgaattcatctgtactttattcattttaataactgaatcatacctcattgtatggctctaccatgttttattatccattcaggtgctaacggatggaagggttgtttctacctgttggccattgtggatgatgttgctatgcatattggggtacgagtatctggtttagtccctgttttcaattcttggtatacacctaggagtagaattgctgggtcatatggtagttctattttaacttttttttatttttaatttttgtgggtttttaagaattttttaatatttgtgggtgcatagcatgtttaattttttttttttttttgagacggggtcttgctctgttgcccaggctggagtgcagtggcaggatcacagccctgtgcagcctcaacctcctgggctcaggtgatcctcccgcctcagcctcccaagtatctgggactacacgtgcggaccaccacgcctggctaatttttaagttttttgtagagatggggtcttgccatgtttcccagactggtatgggactcctgggctcaagcaatcctcccatcccaacctcccaaagtgctggaattacagtcatgagccaccaggtctgaccacatgtttaactttttgaagaactaccaaactgttttccacggcattcacaccagcaatgcaagagggttcccatttcatcacatccttgctaacacttgttattttccttaaaaaaaaaaaaaaaaaaaagccagctgggcacggtggctcatgcatgtaatcccagcactttggaaggccaagggggtggagcacttgagctcaggagactagcctgggcaaaatatcgagaccccacctccactccatctctaccaaaaaaaaaaaaaaaaaaaagctgggtgtgcggtggtgcacatctgtcgtcccagctacttgggggggctgaggcaggaggatcccttgagcccaggaggtcgagactgcagtgagctgcgaccgcgccactgcactccaggctgagcgacagagtgagaccctgtttcaaaaaaacaaaaaaaaagcacatttcaaacatacacaaaagcagagagaattcccctcggtcctccggcctgcaccccaccgccccccaccacaggggcattcaaaactgtctttttgcctctctgtaaggtaaggggggactcttgacgctccccagaccacacagccaaagtagggcgatcggatcatagggggtcccgagtcggacactgagctggcgtgcccactctcgagtcctgggaccccaaactaaaggagctgttccttttccccatggagggctgacggggcaaaatcccagggctgggaacatccgagcagctttgagtagcacaggtgggtttctacgtggctttctttaaagggaggcctgattctcggcttttcaggacccgccctccattttctcacttgcctgctctttcgtcctgcgaaactgggcagtggccggtgacagcgcagggtcagccctcggatggccaggtgggcgtgatcccaccctcctccgtggctgggtgggcgtggtcccaaagtcaattggatgtggtcccgcgtccctcccggcccagtgggcggggcctccccttctggggcctcccatcccacaccagcgagcagagaggagggtgggcggggaggccctacggggctggggcggggcggagcggaggtggttagctgtcgggaggtggggtgggcaggggccagggctctgttggtggcccggggcagccagtccctctgctcagggcttcagttcacactcacaagggaatcccagcgctcttctcctctggcggttgctggagggccttgtgaggtggccgtgggcactgtagcccccaggcactgcattgtggcctgggcgtgttggcctttgagcctttggccttgagcacttccccatcccccatggctcttggccgttggggcccagttggccgcagagcctttggccttgagcacttccccagcccccatggctcttggccattggaccccagttggccacagagccgcgggcaggtgggacaggcgggcactgggtgcctccttgcaccagccaggcccagcctgcagagtggagtgggccggtccctcctgccaggcaaaggaagggggcttcgggcccctccctgctgtggcctcctcccctctgctgcctcccactaggccctgggagacactgcctgcagatttatgaacagacagacctagagattagagattcaaaagccaaattcttacacaattcaagtattaacgcagatttggatttataatttgggactccaaggtctaccaagtaatttgctgtttcagaatagcccttttaatttggggtatatatttctaacactgttttttaaatatggagagtaaacaaaatggcccattatctgaccacacaaatactagtagtcattatagataaaccatagcagataaataatagtaaacaaagcaacaggctgtgtcataggaaatccccaccatgaagaaaggagcaaggtggaaagttctggctgcttcaggtctgcatggtccctctccaccatggttccccctgtcatcttcctgccagaataaggacactgtccttagggaagcaccatctcttgttttttccccacgagccctgtgggtcatggcacgtcctgccccgctgggaaacacagtgggccacgggtttccctgcaggcctgggacccttcccaagggtagcagcagaaggcagcacgattcccactcctgcagctgtggacaggggcacccccactgtcactgagccctgcaccgggttccatcacctgctcggggctctggcctttggccttttcctgtgagctgcatgttggccactgtgacctatctgtctcatcatctttttcttactggtttgtgtatgttcttggtaaactagcccttggtcttacacatcatttccaaggtactaaggactcttcaggggaaatacaacttgagcagagtggttccctcctcttgtggttcacaaggtgcaggtgcacacacacatagcccacagggcagtgtggacagggaccaggagactgcccctggggtccctggctgggggacactagtagggatgtcccttggcctctctgaggccttctgctgtctcttctgaggccggaaaggcgaagcactgccctcgccctgctagggaaggctcaggccaggctggccctatccggggaaggggctcaggtatctggaccttggtcatcgccaggttagggtttatgttgatgattatccaaaggcaaaattgatttccacagaaataacatctgctttgctgccgagctcagaggagaccccagacccctcccgcagccagagggctggagcctgctcagaggtgctttgaaggtgagttggccaacggaagccggggcagtgccagggtgggtacagattccggcccggtgcatgggcacaggtctgctgagcacatgtccactctgcctgtgtaaataggccacatggcctgaaatcccctagaagcctggtgtccgcatgacctccccctagggcggagcctctgcttccctgttctcttctgctctgtcctctggtgccctgaggctggcctccaggggtgtcccctctgtggccctaggcctgcctccttgcctgggtgtgcctttctaaaatggagcgtccagcagagagtgggatctcctatgccactgggagcccagggccccatcccagaaagacctctgagtgagcacaggggccctagaagaagtttccttgtgtccttcccgttttagggtctgtgacctgaacccctgggcttctgcctcaggcctcctgtgctctgctctctgcctgctgggtcccctcaccaggcttctgtctggttcccaggctacctgcctggagggtcacaccaggaggatttcaaacaggtttcaagtggggtcacttgccatcactgtgccccacgaggtacactgttgtgggcggcagggctggcctttctcatctgggacatgccacgttgctgttcccaaggggagtggtgagtgggtctgtcctggtgtgcctggcctggggactgccagtgtccttacttggacactcaatgaaaaggccacatgaatccctggggcgtccagagcatgggtgaccagcacgggctcaccacatgaggccaaggggctgcaccatacagcctctcctttggccacccgtgactacccccaactccgggccatggggcttccctacccctgggtgtcctctaagccagctgggagacaacagcctgagtccgtgtctgcttctgtattttgtgtggttttagaggatccctgggctgcctggggaagcacccagggccagggagtgtgaccctgcaggctccacacaggactgccagaggcacacacctgctctgtctacccgagggcaccagagggcacgagaaggctggctccctggcgctgacacgtcaggcaactgaggcacaaggctggcatttctgaaccttgcccctctgcaaacacaagggggcgatggtggcactccaagcaaaggggcgtgtgggtgctgcaggaggagcacagagcactggcgcccctcccctcccgccctgcagatgccggaggccccgcctctgctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccacgtgctgcagcatgcggagcccgggaacgcacagagcgtgctggaggccattgacacctactgcgagcagaaggagtgggccatgaacgtgggcgacaagaaaggtggggtccgggccagcaggtgctcagctctgggacagggacccaggaccaggcatcaaagcccttacaggagaagctgttatcaccccatttccagggggctgggaaccctgggatatgcccagatagggctggggggctcctctggagtcccagggtgccagggtccctgatgacccctgcaggccctgctgcctgctgccccaggacaacaggcccccacactcacagggtctgacggtggtgcagttccccttgaactctgttctggccaccatgggacctgcctggggaccagtcagacaggttctcctgggcccgcctcccgcttgaacttcagcctggggcacaggatgtgttaccgggctcacggagtgactcagggaactagtgccgccccagggccccaaggtgggcggttcggtgattcagagagggcagctctgtgttaggacacactggggccagccaggaagggtggaaaagatagggaccagcgtgagcatagaggctaagggaccatgggagctccaagcgcgctcacagtggggaccaggtcctgggggctggggacaccagggaggtgaaatacccctccagcgggtagggagggtgggcagaggagggccagcggccaggcatttgggaggggctcctgctctttgggagaggtggggggccgtgcctggggatccaagttcccctctctccacctgtgctcacctctcctccgtccccaaccctgcacaggcaagatcgtggacgccgtgattcaggagcaccagccctccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcgtgaaggacaaggtgtgcatgcctgacccgttgtcagacctggaaaaagggccggctgtgggcagggagggcatgcgcactttgtcctccccaccaggtgttcacaccacgttcactgaaaacccactatcaccaggcccctcagtgcttcccagcctggggctgaggaaagacccccccagcagctcagtgagggtctcacagctctgggtaaactgccaaggtggcaccaggaggggcagggacagagtggggccttgtcatcccagaaccctaaagaaaactgatgaatgcttgtatgggtgtgtaaagatggcctcctgtctgtgtgggcgtgggcactgacaggcgctgttgtataggtgtgtagggatggcctcctgtctgtgaggacgtgggcactgacaggcgctgttccaggtcacccttgtggttggagcgtcccaggacatcatcccccagctgaagaagaagtatgatgtggacacactggacatggtcttcctcgaccactggaaggaccggtacctgccggacacgcttctcttggaggtgagccccaaccaggatggcatccgtgccagctgctgcccagagcccattcagtcagcctcagcctctccaaagagccaggcattccagtagagccctgtgtggacacagctcgctctggaggcaccacctgaggtctgggagtgtgggggactgaggaggccctgtggtgggtggagatgggtggggagctgggccaggggcctggctgggtggcctgttgggaactggggagccagctgcctgtgcaggtgcaaaatgggtggcagaagtggggtgcacaccccagaccagacaccagggcagaaacggcacaggaccaaggagatggggtggggaagggccgctctgggcccagcctgctctcccccaagcaagccactgctcgtgcaaagaaagcatgtgtctcctgcagatcttcctcctgaggccccatcttgtgcattcccccaacccagccccactggcgaggaccctgagtgccccgagtgaggctagacagcgggtggggctgtcctcgcttccctggggggcgtggggcactggtggcccttcacagactgatgcttaaggagcctcacatcagtgacacactgccccatccctccctggtggtcagcgacactgagtggctctgtgatcctccactgggcttgggacacccaccctcacggcctccccacctggtgctcgctcacctgcagctctcccagaaactggacactgctgttagcagccggactaggagcacgaggggcacagcccccatgcctggctaggtagggccgctggaccctggacacggattggaaggaaccagcactagcagaagcctgaggtgtgaaagggcagagaatgttccaggaacaatgggagtcagggcacacaggactttgggcaggtgaggatgaggttagacctgtcttctggagctgggctcaggggctcatgcctgtaacccttgcactttgggaggctacggcaggaggagcgcttgaggccaggagagttcgagaccagcctgggcaacatggcaaaagaaaaaatatatatatatattttagatggagtcttgctctgtcaccaggctggagtgcagtggcacgatcacggctcactgcaacctccacctcttgggttcaagcgattaccctgccttagcctcctgagtagctgggactacaggcgcgcgctgccacacccggctagttttttgtagtttagtagagatggggtttcaccacattggccaggatggtctcaatatcctgacttcgtgatccgcccgcctcggcctcccaaagtgctgggattacaggcgtgagccactgcgtccggccgtattccagctttcaaaacaacaaaaaacaacaaaaacttttctggaaagatccctgtcagccttgtggagtgtggagagggctgtggggagggcatttcagatgccctgaactcacgaggaggcactgaaccctggccgtggagagggaggacctgtagtggccaagggggtgggcattgggagggtgggagggagacctacaggccaagacagggtagctggaggggggctcacccctgacaaaggagcatgatgctggcaattgggtattgatggcagagagctggcactcagccagatgggcttcacttgggcaggaaagacacccacagctgggcctgcgttactgcggccgagtttcagcagctgtgatgtgggtgctaattacaggggcctgccttcatagaaaagtagcaaacattgcagtttagtaactaggaaactaatagttttctcagtgctgcttgcgcaaagctggtaattatctcaaaagaagcaaagtcatgaagtgggaagtcatgaattgggaatgggtgtccttgttaaacgcacatctgcacactcagggctggggccctgtgcccccttgtggagggttaggggacaacctggctcttgtgagggtctagccatcccctcagtgggttctgtgagcatcggaggcacgaggggtgaggggctcaggagcaggttgcaattcaaaatcaagggctgctttgaggaggcctctccaccgggctgctgtagtcaccaagtccagcccatgcccaaaggaagaggaatgagttcccccttaaaaaaaaaaaaaaaaaaagaaaaagacagagtcttgctctgtgcccaggctggagtgcagtgatgacatcatagctcactgtagcctcaaactcctgagctccagtgatcctcccacctcagcctcctgagtagctaggactaaaggcatgcaccactacacctggctaatttaaaaattttttgtagaaatggggtctccctatgttgcccagactggtctcaaactcctggcctcaagcgatcctcttgcctcaacctcccaaagtgctgggagtacaggtgtgtgcttggtctgaggctccaactttttgttgttgtttctcgagacagtctctcgctctgtcgcccaggctggagtgcagtggcgcgatcttggctccctgcaacctctgtgaggctccaactcttgaagggaggagagtctaaggagggtgggccagatgaaaaccacctcagcatagtgtcacctgctcctctgacactgtcgcttctccacggcattagattttcagtcctgctcagacgctgatgcatgtttagccagttctccaggtggtctgagtagctggtaggaggcttgcagtgtcgggcgacaggcaggacaggtgctgccttctttcccctcttgaccagtttcgtaaaggagtgggcccctggcagcctccaaaggtgacccatgctcctttctgcccttccctccttctttcctgtttaactcgtgcaggtgcagtggtctggtgtctttcagtccgctgacgtcttctgtatccctgatgaccagattgggctcctgagtcccctggcgcaacccgagaagtccaggagcccaggcccctcactcatgcattccctggcccagactggaaggcagccgccctgctcaaggcctaggccattgtcctcctcccgggtggcgctttgttctacgtcttttcagctgacattgctaggacatttttttttttttctaaatgaaaacacatcatgattcatggtggtacttcctgctcaactccggaccttggggctgtcccctgacctcactgaccttgcagccgtgtggtgtccatactgtcacatgaaagccccctgctttctctgcagcatacaggctggaaacgaccgccacccaccaccaggacagctgcaagccctgtgggactctccaggcccatcccagaggcatgtggggtcggataccagtgtttcaaggcacctgcctgcaaattgattttattatactttagatgtttgagattgcttgttaacttttgtttggtgactaagtcaaatttccaagacaaggtgactggggtgtcccttgccctggtaggtccttcctccccataggcaaacacttcctctcaaggtttcttgtttatgtgatgtaagcaaacccttttctgatagcatagataggcaagcatcctatgaggtttctcccgatagtggaccccacgggccatgccctatggctgcgtgtccagtaacaactccttccttctgcacagaacccaggcagaggaactctgtgtcctcccagggcccaggcactggtgaagatggggggtctgcaaatgcaggagcttggggatgtccagaactgaccccaaggggcaggcttgttgatgggaggtctgccccacctcagccctgcagggtcaccctggtcaggccaatattgtctccagggaccataccagcaacccctctccttgggtgcctctccctcataggcctgagttcctggcactgggtgttgagggccccattgtttccactcacccagctagcatttattgagcacctactgtgtgccacatgctgttctaagggatggatactcctgagatggatacaggagttgatgagagaaaggtccctgtcctcacggggcccatgttctgaaggtggcacccaagtcttgtacagtcctttcctgcaggagtcacgctgggcagaaagtggaaacctggccccaggggctaggcacaggcgtggtgccgtggcctagtgaggagcacccatcctggtttggggcaggttctctgggcacctctgaccctcacctcccccaccccccggtctgtttgcaggaatgtggcctgctgcggaaggggacagtgctactggctgacaacgtgatctgcccaggtgcgccagacttcctagcacacgtgcgcgggagcagctgctttgagtgcacacactaccaatcgttcctggaatacagggaggtggtggacggcctggagaaggccatctacaagggcccaggcagcgaagcagggccctgactgcccccccggcccccctctcgggctctctcacccagcctggtactgaaggtgccagacgtgctcctgctgaccttctgcggctccgggctgtgtcctaaatgcaaagcacacctcggccgaggcctgcgccctgacatgctaacctctctgaactgcaacactggattgttcttttttaagactcaatcatgacttctttactaacactggctagctatattatcttatatactaatatcatgttttaaaaatataaaatagaaattaagaatctaaatatttagatataactcgacttagtacatccttctcaactgccattcccctgctgcccttgacttgggcaccaaacattcaaagctccccttgacggacgctaacgctaagggcggggcccctagctggctgggttctgggtggcacgcctggcccactggcctcccagccacagtggtgcagaggtcagccctcctgcagctaggccaggggcacctgttagccccatggggacgactgccggcctgggaaacgaagaggagtcagccagcattcacacctttctgaccaagcaggcgctggggacaggtggaccccgcagcagcaccagcccctctgggccccatgtggcacagagtggaagcatctccttccctactccccactgggccttgcttacagaagaggcaatggctcagaccagctcccgcatccctgtagttgcctccctggcccatgagtgaggatgcagtgctggtttctgcccacctacacctagagctgtccccatctcctccaaggggtcagactgctagccacctcagaggctccaagggcccagttcccaggcccaggacaggaatcaaccctgtgctagctgagttcacctgcaccgagaccagcccctagccaagattctactcctgggctcaaggcctggctagcccccagccagcccactcctatggatagacagaccagtgagcccaagtggacaagtttggggccacccagggaccagaaacagagcctctgcaggacacagcagatgggcacctgggaccacctccacccagggccctgccccagacgcgcagaggcccgacacaagggagaagccagccacttgtgccagacctgagtggcagaaagcaaaaagttcctttgctgctttaatttttaaattttcttacaaaaatttaggtgtttaccaatagtcttattttggcttatttttaatgctttttctcagtgtttttcttctgtttctgagtcacgaacagcaggcactgaaagcagtcccccagccactgccgaaggtcagtcccggaggtgctgcccaggctccaggcagatgcggcagccccggccccagccagcatgggctggagaaaggctctctactgcacaggggcctcacgtgactgcagggctctggggaggtggggcacctgtagcctgacccccaccttgctgcttccaaagcttccttgcccagggctgggccttgtggggcaccccccacaccgtggtctgcctgcctgcagggtgcccagggagaccctccgcctttagaagtccaagttctttcccagccccctccctgcctagctgcctgcccctggcgccagacctggcccgcaccactggggcactgtgttcccaggggcaccctcctatcccaccagccccaaagcccagccaggcacccttccctgccacctccctgggccctgccccagcagcccagtcggcctcctcgggccttctgtcactcgctcacacacagcaccatgtcagtaaacagctaactcaggcctagggagttaggtaggatggggggagtggggtgggggggcaggagggtgtccccaaagtcaggcttggctggggcgaggcgctgccaacccctgccgccagggggctccaagctccacggcacgatctgctcagggtggcccttcttccacgatccaagccctaagaacaagaggctgggcctgggccctgcagagggaaaggggatggtggacgctgcagccactgagtggcacaggaccacgtgtaacctcagggcagggcagccaactccacaggctacatggatggagatgtggatagaagcatctgccctgggtggtgtgggctgaccccaagggtcttggcaccagggctgatcctgacttgctggtccccgaagggcgttggagggtatggtgcccatccctactctggtcccatttcctcaggcccctgatcccacagtgcctgggacagggctgtgggcccagggagcaccctccctctctgacctctgcctggtctttccgggaatgggccactgggctgctggactggaggccaaagtcctgcggggaacgtgcgggaagagcagagcgtgcaggcagcggagactaacaagaagccctggcccagagggcaggaacaggtggacgaacaaccagatgagagaacgtaccaggcatgcaagctagacccaggaatcaacgggctgaggcttagcgtcccctacggcgtccaccagcctgaccgcgggcctgctgggcccggggggaggggccttcctgctggggtcgagctgcagcgcacgggtgggcattagaggcacaatagagcaggttagttagagctcctggggggacagggcaggggcagggccgaggctggcgatgtaagggttggcctgccaggacagcacaggtagcaccaagggcgcagggagccggaaacgtgtggctcacacgggcccagggcgggcacgtgcacacacacaggcctgcacaggaagccaggggattggcacacagcaggcagcaggtcctgccatcgctggtggaccctggtgggctctcacacgcacatgcacagaagggtgcacacacactagctcacaggctctggcccatgcagggtgtggccgggcagtgttgtccccagtgggtgggagctgcaaacttgtcagtacccacagactgactggcgtgaaggggctgcttcctgggcttggccccacaacccagctgtaccccagggcccagaccagacccagcatggcctaggctgctctccagcaacccctagacacggggcctcaccggggacctgcccacagccacatgaccacttactttcaagggttccttctcagaggcctctcctgcagagctggcgccccgtggcctccgctccctccggtccaccgtggagtatccgtctgtagatggggtaaggtggggcatgaggggcgctctgagggaggccctgtaggagcagatctccctctcagcccagacacaggggactcgtgggacaggggctttgggagacagcccccacccaccctgtcctggagatccaggctggtgccagctctcaccaacaccctgccaactctccagactcccctccacttgtgggtcagagcccctggctgagcactaatccctctctagctgccctgtacctcaccctctaagcacccctaaaccaaatatctctcctccacccagcaccatctacaccccataaaaccagcaggcccacttcaggccttggtcccctcccggcacagaaaaccaaccacactgcatctgcactcacctgggcccagcgcatccatggggatcacatcccggctgccagttttctcgccctctgcaaggcaggaggaggagacgggctgcatgtggcagccaggggggatcggggcagagaagcccacacagggctggcccaggtagccctagaggctctctgtcactaaggtgcccaacctctgccagctggcagcctcaccccagcttgacaacagcgcggatgctgtgggaagggagtagccaagaggcagagggcagggaaagtggcctatggaagccgtctcagtgggaggcctgactcctccttcaccttcacccaagggtcaggcaactggggcagctggggtcgccaccctctaggctccctaagctccaccactcaccaaggctcttgtccaccagtggcagcgtgctgtcatcgaagcccccaggactcagtgctcccttaggccccttggcagtagcagcagctgactgagacataaaacacagacacagggtgggtgaagcacatggagtgggaataaggcaaagtgagcagggaatggaaggaaggccagggaagccgcacctggaagcgcgccttggtccaaccatctttctgcaaggtaccacgcagctccttgtagctccacactgtctgcagcacgtgtgacgccgccttcgcttcgcgtaccgattggctgtggggccgggggcggggtcagtggtggcccctcccccacctccgcggctccccaagccaccgaccccgcccctccacacctggaggccacgagagccaccaacgctggcaccccgcgtgcctgcaggagcgagcgcgcgttatccaggctgtcggacacgatttcgtggatggtgttgagcaccgccaccacggtgtcttcctccaggcaggcccccggtcgcggcggagcctgtgcattgcgcacattccgcacaagctcagccatggcgtagctccctgaggggcaggactaggtgtcagaacacacctctgccccacctctccaggaaggagcagggatcccgcgagggcgaggggcactgccaggagagcccctggagaccgcctgtgtgcaggcggtcacaggagcccctgtgagcagggcgctgagcttcagagacagggccggggggactggagctacctccagttgggacagcgcccaagcgagagggccggggcctggactcccaaaccactcatcctccaagcccctccgatgggaccccaaagctgcaggcacagttcggtgcccaggcgtgggctttgcaggcgtcctcaccgatgaggtctttgttgcgccggtccagcgagaggttgcgcagagcgatggcgacggcgcgcaccaccttgtcggtctcagactgcagcagttccacaagcaccggcagcccgcgctctttgcgcactgtggcgcggatgtacgtggcccactgcggaggcggggagagggttgctcagacatacatgccaggcactctcccacctccagacgctgaccgctctctccagctggaccttcctgctcccgtgcccgacaaagccctaccccaaaagctcaacggcacctccaccgaggttttcccaccgtccagggtgcacgcattgcccgcagcccatacacctcttggatcctggggtggtggtgtggcccctcctttccccgccagccgaggcaggagctgcaccagtgaggtgcctgggattccctctctcaggacttgcccaccctgcccgacctggtccctcaccatccagttgccggcactgaggttctgcagagcgccggcggcagcctccagggtgttgaagttccggctctccgtgaggagggagaggtagagacgtaccacctcgggctggtacagcagctcaaagcctaggtgcagggcaaccgccacccacggtcacccagaatctgctctcatccatcatacccctcccgcttcccgcttcagagctcccagggcgtgggtgagctggggccagggatgggtgtggatgagtcacgtaatatttactatcaacatatagtcacccaaggggaaaagcgttcccatttcacagaggaacaaactgaggctcaaatcagttggacctgcctggcagcaggagcatccaggaggcctggggtggggagggaggtgtcaaccaggaacgctctcctagcaacaagacccgcatttcccggtaggtccctgaagctatgcatcctggccacgcccctggtaatagggcccaccctccctggcaacaagaccagcattggccagtaactgagagttgtataaccaaggccacacccctagcaagaggacctgctttcaccagtaactgaagctgtgcagagagctacgccccctagcaacagggcccaccctcccccactgacaatagagcccaccctctgtaagtcaactgatgcagtgcaaccagggcagctgccctagcaacaggaggcactcttcctggcaaccactccaagttcccgggcaactgaggcgccgtcctgctgctctgcccagtgctccagaaatgaggggtcaaaacagccttccaagcttgcctgtctccaaactggggcttcagcctggcttgggtactacctcgatctcccctgtacccacccagtgacatttcatcacaccctcgccagtcctcatgccccatgctccctctactcctgccctgctgggctttctgctccaacacactccaagcacactccccgctggggtatctgcatcagccctgctctgcctgtaatactcccccacagccctcctgcggctggagccctccaccctggtgacatgcaggctcttccaactggctaggccccaccaggacagacctctctctcaagccagatcccagcatacagcccaataggcactgccctgtccctgcaggtgttcgtctggcccagcctctgaacctggatgtgagcatgcccgcctggctcccagccccctcagataactcagctttgtggctaacacaggaggccctgcctccactggaggcgtccctccaaaccttcccacctcttacgcaccgtgaggccgagcaagccctcggcctctctgtgcctgtctcccccaaccttgcctgacatgacccatggcacttcctcccattctaaaccctcagcaggtgtcctggtgctgaatcaccctccaggaaatcctgcacctaggggcctgtttccccatctgttccctgaggccctccaggcctgcttgatggctcaaagcttcactaccagggcaatcctgagcccagacatcccccagtggagctggcttcatctcagcccactcacctttggcggcctcagttcgcttgggcaggtctagcgtgtcaaagttccggtccatctcaccatccttctttcctggaagggaaaggtggtgggaggtgaggcagaccccatatggggaatgggtgtatcaggagagttgggcacagttctctcctacccaggccccaaaaggcacccccatgtccaggcctgggcacctgtgggagtggagcaccgttgtcagagtttgggcagacagtttagcctaggggtaggagttggtggcagtggggcctggggatgtcccagccctgcccctaggactcatctcccaccaggtgctgggagctgtaccacagaccctcccggtggctcccttgcaactgccaggtatgtagactgagggaagccaggagccctggctggatggtaggtggatacaagccaagaaactgaaggctgaccaggacaagactcacttgggtcacacagtaaggcagaactagggggaaactcccccagctggggtcaggacattgtcccaggatctactagccaggagaaaccccacagcagcccacctaacatttgtgtagccctggcttgcacacgtctgtgacagtgagcccactgtcaaccactctccccatgtcagatgatgcttctaccccttcagaaggcagcagagtggagccagatgacctggggtccctgccctgctcaccctcatgggacccttgtatccctccgagccacatgatgccccattctatcagagaaacagactgctccttggtgcccctagagataagtacccccgggccctgcccactcttggctctgcccaactctgcccaggtaggcaagtctgaggttacagaatgagccccgtggccttcccacctgccactgtcataaagatggcagcccgagtgatgaagccaggggtggggcagggccctggggctggaacgtgctcgcctcttcccaggtacccactgcacacgccaggcctggagagcaggataaaaagggactcaccttggtggaaccactcctctgggaggccggaggaagcagaggagagaggagaggagcctgaacaggcagcactcatcacccccccatgccctcccggaagcctcaggttcccactgcacaccctggatcaagcaggcagcatgtggaacctcatcccatcacttctgggcactgagcacccaccaggggtacaagaagagggaggcctggggtcagtggggcaggggcaggtggcgtacaggtcccccacagctgctggggaggtcctgggaacctacaccctgctagtgcagtagagaaggtgtgcagggcatcttgcccaggcagatggggggctgccccacaggttggtggcagtctacagctattctgtgaacagtgagcaggcagcagccatggctccttcccaactcatgggcaagtggaactctccccggagtagaaagactgggtctgggcattggttggtttcccttgtgtactccctgggggtcccacagtgtagatggggaaggttggacctgggtcccatcaaccatgtgacccagggcagtccagcctccttgactcctggcttccctgcctgcctgttgggggctgaccaggtgtcctctagcctccatgatgggctgctgtgggtgtacagagagccttccgctggggcaggagttgagatggtagagatgataccccagtccgccccacccacctttggccttcttgcctccaaagcagctggcatcatcccgcctccggcgctgggagcctacagcactgcccaggggcccgggctcggcctcctggtacctgtcggccccgggcacctccttgtgcacgtggtaggacaggttccgcatgatgcacacgcagttctccaccgactgcagggagaggtgagtgggtggggcagggcaccctaggcacagggctggccctcaggaaagactggccacagctggtgtgcatgagggcaccgggagcaaaggaacagggagtcctcagtggaggggagcaaaagggcggtaaccgccaggaagggtccatgggaggaagcctctgccctcacggcacaccttctgcctgcaggacggtgcccacttcagtgtggtcactgcgaggcgggccacacccagaacgccaccccagacccacaagcccattcccctgtgctgctcccacagttccagcctcctgggacctgcatgatcgtctctccagcccttggtatgaggctgtgaccgtccctgcccaccttgttgtcagtgtccttccggcccacagccgactgcagggcatgcaggagcgcgtccaccagcccttcacactcccggagtcgccgccgggcctcagcaccatcggagctcacattcctgtgtggccaagagcaggccaggtgacccctggctaccagaaactccctggctccaccctggccttgtgggcttgtcttcatctgcaaaataggccctgctgctgccctcctagcactaatgggaaaggaccccacagtctggagctcagtgaagggggagaagctaactgcccccaggcctcaggaggggagccctggcagacaactatcttggctggggatagctgggcagggaaagacagggtttccctgcctcccagctgacctggaaagggacaggtgcactctcagagagacctgaacctgtgcaagggcaattctgggtccctcgccaccccaatggcagctctgggccccaccttaccccaaggtcaagagcctgcagggctgcgcgggaacaccctgatggacaagcaggactgtggggacccaggactctgtggggtcagcagggcctcccaggggtaggaggggaagggcagaggtcacaggtggctgggatgagcctcccaggcagatgaacaggaaggtcccagctccccctctggctgtcaagtgatgggaaggtaggtgagagctgggcagggctacggtaccacagagacccctccagagggtgcccctgggaagactgggacaccacttgggggtgaggacagctccatcaggccccacttctcatccacaggacttgtgccacagctctgaagctcctaagctctggcgctcctaagctcgccgccatcttccacactatctgggaccacgaggacggggcctggtgtgcatgtgggctttagcaccaggtctggtccacacctcaggcagcccgacgtgttcttgaagacagttgtccactcggcgtcccgtggcttggagtcctcgttgggctcacgctcccatcctgagtggggcacgatcacctcgtgggtcagcgtctgcaggccatggtcaatgatgaccatcttcaggggctcataggatgacaggttccacagggtgcctgtggggtgcgattggccaatctgtgctgaccatatgcaccgcctgcctacctccccaggtggccacgctcaggacctgtcccactctcctcatgtcccagctcatgcagaacagtaggaagtaacaaaagccgtgagtggttccgggggacacccagtactggtttccagctaggaaggagccccaaaggggaggaggtgcagaggagggtgtggcagtgctgtcccgtcccacccattccctgccatgtggcaggtggcactaacactcctgaggccacagggcctcacagagacacggtgaccctacctgtccctcagctctcacaaggcacaagccccaccactgcacggttggggtgggaaccaaggaggtgggtcccaggagagtttctgtgggggcaggaggtgtgaaggcaggaggtgaggggacatgcccgaggggcgcagcgtcagcctccctgctatggtagagactggggaacctgtcacagtgtctgggcctgatgcctggctcctggggcaagcgtctcagcagctgcactcctgcctaccgggtgctttcccaggcggtcgcaggccgagtggcctcgttcctcccgggttgagcctcacactcttctcttcccaggggatgtgagcatggccaggtcccactcaccagtgacaagctcacggacctcgttgtcccgggcagccctcagcaggcgcaccagggcaggcacaccaccgcagtcccggatggcggccttgttgtcagtgtcgcggccataggagaggttgcgcagtgccccacaggcccggcgccgcacctcagcccgcgggtggtccagcagtgccacaagcagcggcagcccccgcaactgccgtacacgccgcttgacaccctcgttctcaaagcacagatgctgcaggtaggcggccgcattggccttcacggggtccacggggtgccgcagcatggccagcacctcaggcagctcagggtcccgccagcgcggctccttgcgggcgctatccactgagggcgagcgccgcaccagccggtccaggctgcccatgctgccccgttcaggctgggccaggggcgccgtcaccattgggaacgcaggccgctcgtccgccagctcgccgccatcatctgctgtgtcctcgtaggccctgcacaggcaagtggggcgcgtggacatcgtcacagcagccgccagccctgcctctgagctgccccatcacaccttcttcaggactgcaaactcacccagcagcgctgggctgagagcacctgtatcttggcccggagcatggtggggacacagagagtcatgcaccagcccagtgagaaccaattcagagccaaatgccaaaccccagccagcggctaccaggacccaggcaaccctcccaggacagcaaactcactcactgctgtcaccgggcagtttcccaatcccgagcaaaacaagtttctgtgagacatctgctatggctgctggagagaccgtctcacctcccttccacaaaaccaccccatcttccatgaggcccatctctggctgtgccaggatgtagggggagtaaatggccctctccgcatgaagccatcccagtaggaccacctgaggagtattcaggccaccagccccttggggcacaagatctccttagctctcagtagccctgtgggttgctgtcatcaaaccgcctgccctgaggctaggagtgacggtcaggtgacttggccagggtcacacaacaaaatcctgacccgggctgtggtcacatccccactccagagatgcagaaactgagggcaatggggacagaaccaggggctgtgacaagggccagggctctgggttctggttacccagagtgtggctggagcaaggccagtggccggcactcttcccagctttcctgggccctgggcctgcaggacagtgcccagccgaactcctaccaccccagggtccacctttcttctgtccctgacgagagccaaggccaattcaaactaacatgcatgactaactcaactgcgccacttgacaagtggggcactctgtagttggggggtggagggcagacttcccagaggaggtagccacaggggacggggtgcagctcacctggtatgaaggccccgcccacactcaggcctcctccttgtggccgtgccatagtcaggctccagctcagggccaccctcgtcatcagcggccaggctgcgcgtgtcatcctccaagccatacggctctgcctggaagcgctcgggcagggagcggccacctggtggcccaggctcaggacccaccgggaaggcttcccggtggccaggcagtgtgaagcagccatcaccagggcctgggccaagggggccagcacgtgggggccgcatgcccagccctcgggacaggctgccatagctggggctgtcccggggctcggggccttcgggaaagccacccccactgctgaggtaggctcgagagagtgtggccactgggccaccaccacgcagcaggaaatgccggtccagggcaccatctgcaaaagggcctagtggggggccgccatccagcagggggagtccatctgggcccacgggcacctggcgtactgtccgagtggtcaccgtcttgacagtcttggtgacctggtggatggataggcaggtaggtggggtagcacgagaggcctagaaactgctttgctggggtctggctggccttaatttcccactcgagcaatgagaggccccacgtggcaagcttccatgtccactctgcaggtgggacagctgcagcagcctggccctgctcacccacccactgcctgggcctggccataccttggtctcggtgcgccgggttgtgccatcttcggatgtgacaatagacacatgggaagtgggtgtgccggggtcctcctccaccgtcacggtctcctccagcacatcaggtgcctccggcatcgtggccagtgaggcctggctgcctgggctctgctcctggggcaaggagggacattggtgggcaggcctgctgctcagtcacccctggagtgcaggtctccacacacagcagctctgcctcagctcatgctggccagcacaccagggtgccttcctcctggtcctgaacccacccaccccaaggcctgtttcggcccaagctgacaaggacagcaataagttcttgccctctgaacatcgaggtgctaaccctgccccggcaccccatcctggggggaccctggggctggacccccatctcaggtctcctcaggctgagttggcagataaggacatagaccctggggggtgaagtcttcagggccctccccaagctgcatggcctggctgccacaggctcctccaggccccaggaggtgccagtgagacctgcagcatgccttcctgatgtcaaccaccacccctagctgggacatcatggtgtcctggggcctcctccctcacctgccccagacaccttgagtatagaagccttgtgggggctgtttcagcactgcctactgactcctgtggccacactaaggttcccgccaccaacgccagccagacgccctcaagggacagaaatacgcagttcccagaacaccccatgcacctgcagcaccagtatgtccttattccttccagcccagacattcttgagtgttgtgtaggcacaggtttgccctacctcgggccagtggctggcgcccccagtgactgagactctgggcatcatatcagagaccagacacagtagatttgagcctatgggtgcccttgccaccattctgcatggggtgacgacactggaattctaggcaagacaactctggactgagacttttctatccacatgcctactgactggacttgccagtggggaaactgaggctcaaagaggataggctggcccacatcagagccaggcccaacccctgccgcgctgagtggcttgaggacctaagactcacagcctgccccgggcctctgactgcacaggtgcctggccccagggccacatggcaccaacatccggggatcggcatctagccaggatgggcaggagctgaaacccaagccctggtgggtgggtcaggcggagcacattcccaggcagccagggcagggtcagcaggaggacaggtcctgctttgtggcccaggcccctggtccctgcacaatgggtcccttgcctgggccccctggggcctgcacagacactaagctctgccaggctccagaggcagactctgcccattcttgggcctgggaggtgagccaggttagatgctcagcgctgccctcaggacctgcctgccaaggctcgtgggctgggaagcctccccaggtcagggtcctatcctgggggaatacttgacccccaaatgcatgcagtgcaggtgtccaggaaggggcctgcaccaacatgttaggacaggtgtatccctcaggctgacagaggaaagaagtggccacagaaggcacctccccctctcccacaggcagggtcttggaggatgacagataactttatagatggggaaactgaggcctggcagggggaagaggatttacctagaacttcacagtccaagtgggatttcaagcacccccagagaaggcaatctggcaaggaaggctttgggcctcatctcgccctcagtcttgagatgtaggtggaatgcctgctgtggacctggctaggaaaaggggacctgttccctgggaaaaagaaatagactgaggcctagagtggggacaactggcacgctgccaggcagggcaggctgggctcttctccaaaggcactggggagctgggactgctctgaagcaggagaaggcttgtgtggcccatcactgctggggctgggctgccccatctgtatctggcaaatgtgtgtcaggccctgagctctctctgctgggccctgggcggggctcatctgagttcaagcaggggcccaggcactgaggggctgcagttctggcgacagagtgaggagggtataaagcaagactgaggaaacgttacccaggactctgccagtgggatgtagcccctcatatatgtatatatttacatctattaaaaactcagagaaaaaccccctcttccctagctaggcagtgggggtaagcgggagaggaaaaggggaggacatctcaggaccccgatgccactctgtggcccagcttatccctcccaccaaggctgtggtgagggtctgacaggcagagctggggtggtccaggagagccacgcccccgcagcaagacctggcaaccctgcggcaccacccatcagccccggcctagcagccccgcagtaggatccagaggccccaagagtccctgctggcaaatgacctcagggagctaaaaacgagggatgacttcacccgggtggcaggtgcatgagtcagccagtgatcacaggaaagcccggcccctgctacacatgcccaggcacacacacatgcatatacatgacccctcagacagggacacatgcatgtacatacacgtgtgcaagtacccagcccggcacaggccgagcacatcaacccgtgtgctctaacagcaccccaagggcacggcgcccactgttcccagaggcacactcgtgagcacacatcctcccgtcctccaccgtgtatcggagacccttatccatgcagggcctcacagagtctcaacacacagggacaggggccaccaactctgccaatcatctgcccagcatccactctgggagtctcagagctggctggcagatggagaaactgaggtgtagagtagtgagaggcccatagccagctggtggctcagctctctgcaacatctttagggtggggctgtggaatggtgggctgactctcaacaggagttggctgcagtccctggatccctgtctggccccagtgtccatgtctgacgtgcacctgcccaggctggcccactctcagggaccctggccctgcagccccacacagcctctgcctcagacccaactctgggctgctcccctctgtaccctagacatgggctctaccctgaacaccccacctccagcccaatcccacatgctgcatcctgtcagtcgtctctcatcaccccctccccagctggggccccatccttgctcctcttgcaccccgcccggcctcccagcactcatccctcccttggctcttcaatctctggtgcaccaggtctggggcccccaggactggcccagaaacaggctgctgcccaggcctggggtttcccatgagctcccttgggcttgtgggaggggccagagtgaccagggaggtagaccacctacccctgctcacaagagggtcccgggaacacagggctgagcccagcataggggctctgggccccatcacgcaccttcggctcagcttcttcacaaggaggtgagaaggacagagggggctggggtcgtgggacgtgctgggtagcatcagtctcacttttgtggcaaaatgcaaggaacacagggagcagaaaagcaagattggaccaacacacagagggatgctggggcacaggtggctgggccctggtcccatattacttatctacccaaaccaccggacttcacagatgcaccacggtctgtgtcctgaagaacagactgcaggggcaggcccctcccctgtccaaggcctggctagcacacacagagaatgagttaaggtgagattgcacacctggatcccacacctgcaggccaggctcccagagggcaggaggtggctgctgtccgatggatgaatgaatgaatcttctccatccccattatggccctcccaggtagagtccaggacaagccaggctggcatctctcaccaggcagcaagcccttggccaccacaaaatgccctttcccttggtgccacagcctctgaccagtctccaagacctggagcttacttctccacacagcagtgcacctgccagggcgtggccccaggcagagatgccaaaaagccaagctgggggagcaaacttggggtgggagagcagggctgactgtcatccacctcagcttccccaagctcagcttggggtcatcagacacactgtgaccatggatttcccaaaaactggtccctccacctctgagggccagaccctgggggccacaccagggccgtaggacaggcaggggcctagttgcccaggtagcaggtgtgtgggagacctgcctcccaccacagagggtcttggctggtctctcctctgctcagtttccctgcctgttactgaacccagcactgctctgagcagaggacaaactgcctatgcctccccccacctcaatgctgagagggggaggatcccgttttccttagagatctcctccagcatccattagtgggcagggcctgtctctatccctcccatcacgtgcgcctcggaggcagagaagacttccattaaagctccggaagctcctttgcaggtcccgggagtcagagccggcgtagggggtgtggaggggagaggaggaaccctctcagggagcagaaggcctacccgggcttccctcttcagacttcagcctccttcctgcacagacagaagccgctcaggaaggccctggctctccacccgtgtccccaggcacctgtcctgggcgctggccaagaagcgtccatccggtccgggccggtgccaagaggagggtcaaactgccaggggtcccgacccccccaggccccgcggatgggctccagagaccctgcggcccgccctgcatacccgggggcaccgcgctcacaccgccacccgcccggccctggccccagcctgacgcagcccagccaggggcgcaagacaatagctgcctcgggccagcggctccgcggaacaaaagcgggtcctcccgggcaggccgacgccccgccctctgcctccgaccccgggccagggtccccccaagccaacttccctccaacctgtctgagttcggccggcatcgggccgggactcggggggcgctggccagcagcgggggaggcggtggctggaccaggctcggctccggcgcctcggccgctcgggctcaggctcggcggactcgctccccgcgggggcggatctggcggcggtcacggcgagcagccaatcgggcggggccgcgcccaggtggggcgtggcgggggccggggtgggcgtggcgggcggggggcgggcaatgtgaggtcccgccccccagagacagggggcggggccctgcagccccgggtcgccccctgtccccccacttcccaccacctccccccacccactgccggcctggacttctgctccctccccctccctgcggcaggggtgtcactttcccgccgaaagactttggccaagtccttcccaggcctcggtttggcctcggtttatgaccacacttcagtccgcctgcaaagggggaaacagttccggcagggcaggtgcccgtgctgcgatgcacagagcacaaggcctccctcactggcacaaacctggctgcgactcagtttcacctgccatgaaatgggggccgatgagacagtagtcacggctctgtgagatctctccagtctcccagatcccccctcaccctcctgcccagccgccactctgaatgggcctgcgaagaactgtccccacagagttcgatggggacctggaaaagggccctgcaggggacccccactttgtatcttgggttctccccatcgaggcacagaagccccgaatgcacccccactgctcccccaggccagcctcaatgtgggccacaccctagggaatctagttctgctgcagtgaaaaatgggaggggaagggccaggctggagccaccttcttatgtcaaaccccacaaaggccaagccaatggctccagcatcacgaacagggaaacaggttctgagattaaatgagctgagaccaacccagggagactcagtgggtctggcaagagaaagggctcgggcccaggcctcccactggcttctccgcagacccctcagaaaacagcctccgcagggaccactccctgctgccctgagcgccatatacagaggccactcggctagcatgctcaagattctaggtacccaccatgtgcccctctgagcctcagttcccccacctgcagaggggtgagctaccctaccactggctggacccctgtatcttgcatctagggccaacctgcctggaacccctggagcagagcgcagaagaccagacactgcgccaaaaacgcgcccgcatcttatctttaagctggctccatcttctcaactgcaccagcagctagtgccccagccacctatccacctaagacgagcccaaggcaagttccctgatggcacccctccccactgggtgggcgtcagccctgtttcagctggctgtctagaggaggggccccttcctgctggaagatgaagggcaggtagccaggaccctggagcagcccagtgagtgcagcagcactccccctagcctggttccccagcctcagcccccagctacctgccttgccattgccctggcttcccaaagcccgggctctgaccctgtggctcagcaggtagatcgctaggcacttcctactgaaaccaatctgggaaacctggccagcccaaggaggccctgcctcccctagtatcctcatcagcccagccagttgagctgcagccctggcaacacatgctctcttcaatcccagcctgagaaaatcaagggtagggggtcggggggagagttcaggggcaggggtggtaggtggaggggcagtagcctgaggtcttgaagtcttttgcctgaggaggtcagggtagctccaggctgtgggaacatcttcccaccagggcatcaaccctccggggtgccttgggtcctcccacactgcctgtccgaggacagttccggtctgggagggttggactgagcacactggcgcctgagaggcggcctcggggtcactggcttccactgtccctatatggcccagctgggcccagcgttctgcttccccgcctcaagtttgagggtagaggcctcacattttggagtatctcaagtctgagggctgtgagagtggccccagcaccgagacccaccagaggcctctgagcaccaggggccatgaaaaagggccccctagtgagtctcggaccctctggggacattaatttgactctcaccatgcactggtgctgggctgggccttctatgtgggtctcatgagcagacgtaggaagcatgacgcctgctggccgacaccaagtctggacaccaagactcaaggagtagtcaccaaccccaggtccctcggcctgacacaggctgctggttctgagccccacatgccccagccaggtgaggagagcccatggggctgcctcaacagagaccagcgtttgctccctttctctctagatgagaagggccaggctgccccaagctcctggcatgtgtgtgccaggcgcaggtccccagagtcagggcccagcaggaccaaagaagggcgggtggaggtgcaggtgctgggagtatgctggggggaggtctggctgctgggtttagcggggcagggagctgagccagggagacaggactctgcagggagagccctctagggtcactctgtgaagaacccagaggccgcagcaggaggcaacccccccagcctctaagctgggtggtgaggagagcccccttccccgtggctgctgggacagctccaccctgactccccactgtgctagccctcagtcagtaacaggaaccatgataatcacaccacatcccaagtctccctgcatgtacttgttccggcctcctaaccccaagccaggggctcttgctgtttcatctacaggttagagcactggggtgctgggaatggggtgtcccagtggtctaactgctcactgcataccccaactttagagttcttagggcctggccatggaacacagaaggctctatacctcctgaggctgagtaggggccggagcccagtctgaggataatggccagcagagaaaatgaggctcccaggtcagcctctaagctgcaggcagagctctgggcctcctcctggggctgacccaccagtgcatgcaatgaacactgtggcagggttaggcatggtgcaggcaaacccctaaagtgtctctaggcagaccaaagagctgcccagaacagaccccatccagctgcctgggccctgagggctcagtggagggtgctgttctgagtgttgggctgtgtcctgcccactcttcacatggtgcctagtacacccaagtgggacttccagcccaacctgggatcccattttcctttcctccccaggagccccagcaaatcttgcaataagcgagcgcatgctggcttgtggtccaccaggacccactgattgttttcccacttggcaattttcacccttcccaagtcactaggctgttacctggaggaccagctgttgccaggccattggcaggggctgcccactgcccatgccaccactgaccatgccaggctgctgggcacgctccagctgtagggcaacatggcgccgctcctgctccagtgcccgtgtcagcctctcgaagcgggcctcctgctccttcaccgaggccaggatgctggcggccgagtgcacattgcagtcctccatgaccagagcgcccgccagctgcaggcaaagcagagtaagctcagtggggtggggcacagcctggcaaggccatcatgggcccctgcccgccccactcacagaccatacaactcactcccagaccagagcatccagccctctagagggaagcacactgattaaattctaaattaaaagccattaatccgaggctggccggaagcagccggctcactccccatgggttttgggactctaacctggctcctctgcttcctgctagacctagcagaaacatgggccgtgggcggcttggagcccgctgggaagggcaggaagagctcattagagcttcttacctcccaggccctctgccactcataccacatgccagcccaccctccatttcacagggccaccccactcccatctcacagaggcagatgccagggccaagaaagggtgggggaccatttgtagccacacagctggtgtggcatggccagtgtggccagcaagcagggagtgagaagctgctccactgatgggtgcccaagaccccgaggcaggcgcaggtgaccatagcctgagagctcctggcaacactggtctgcagaccagcagtccagcctccactcatatccacattggccagaaacaagagtggtgctgctacacatgacagagtaaaaactgaggacaagcctggttgaggttctggctgggactgcatgaagttaagagaccataagcctgaagtggctggtgtgtgtgatgcctcatccagaaaagggcaggggccaggcatctgaggccaagcacagggtgggattgggcctgctgggcccagcccagtgttgcccctcagggccccagagccccaggggagcaggcgggggccatgagggcttggcagccgcagagacaaaccagcactttccctcccagcttgccccctggctgcccagaatgtttgtttttcatgggtaaaaagaagcaggacaagtatgcggagctccaatccaggctcaccacagtgggcagggcatagccacgaggccacactgcccggagcacagtgagcatggccgggtgcccagggctgctcaggcatcctcctgcccagtcccgccagcccactgaggccaactccgctggatcccttgcccttgcaccaatatagggccctccacggggaggacacgcactgcgggtgacatccccagagcgtcagcactgctgctcactggtctggatggagccagctgcaaggacagagagcccccaagaggaaaagcagcgctgggctcagctgcgccagcaacacggtgcggggacatgggtgcacctcataggtgaagagacactgtggagcccagccccaccgacagctgggaaaacaggcccagcaagagcgagagaccagtgcaggcccccaaagctgctctccatttccccagcacctgtcccacaaatgaaactgtcaacacaacctttcggggaagccagcatgagtggaggagctgttttaagccagccacagaatggaagaatgcagggagagctgggggccgccgcccgagactgaggtgcagactgggcgctccagcaaagggataaacagcactgcactccccaagcatggtcacacagctcttctctacacacctgatgctgtctacccacaggccccagacccaacacaggggagccttgtgcactaatggactgaacctagtgctaggcccgaggtgggaatggtagggtattccccctgggacggccagggcggatggcagggcccatatcactccagccctcagcccagtcctggctgcagcaccagcccatctcagccgaacctcagaagcaagggacagaaggaaatgggacgctgccttggatggcaacaatcaggaccacaggatagccactggcctcatggacctggggtggcttacttccctccctgtgcagagacatggaccctcgtctacaccacacaccccatcccccatctagcaggaccaggcttgggctgcagaccctgcggacagcttccctgacctaagcccctccagcacaccctggctctggggactaaagatgcccaccctaaagggggcccactggctctggctgagggctcagtactccaaggccacagtgggaaggtgaccaaaccccacgatgaccttctcattgccgaacttggcttgattggtgcaaaacaatcatgtatctccctggaaacatccagaaacactggccagtgttgtggggagagtctggcagccatgctcaggagagcagagaccttggtgctgggcctgtgccatctgccccagccgcagggtgcaccctgcatttgccctggggggaagtgccctaggcccgcaggtcatggcctcggcatctcaggtgtctcaagagcaacccgggatatgctccaggcagagcacagaaggcccaggcccactcccctgacatggtggactctggcctatgacaggagccagtctggatacaagggatcctggcccagaaccaaagagggctgcttttcagatggtaactcaaaatgctgtttttatattcaagtaataaatatatgatgtcaaggaaagcaaaatgtgcatggattcttaagatcgatggggcctgagtggatgctgggcagagtgggcaccggatttgcttttgctagagcccaggagggccctgggggaaggctaggaagggggacactgcagggaccttggctgtccagccaatgccaccttggcctcccctaacctggtaagggcccagcattgccttgtcgggtggacccctcatgaccccccacccaaaacacagcaaccagcttcatgcccaactctgaggaggccacttcttgccaaacatgctggccccagaagtttacttagccgcaaggcaggaatgacattgcacagcccacgagtgaccagacttcaggaccatgtggacaacaccatgttccaaccagaaaacatcaggaactgaaggggggctggaaaggtcggggctaaactgaaactctgaaaaataaactgcaaaacaaaagtgacgacccagcccccacccagccccagccacaatggacattggccacgtacccaagggaatccaggaccaggacgtgagcctccaggtgctctcacaggacaaactgctgggcaagcaggtggcccgaggagagaagcatggcaggagaagagggtggccccaggcacacagcccatggaagactagagggagggcaagcaaaggagagacagcgaaggatggacagacagatggatacaggggtggatgggggatggatgaatgaatggagggtggctggggcagtggtggaggatggacagagggacggacagattgatggacaggtcggaggatcgtgggagatggacagagatgaatggatggatgggggatggtggggaatggacagatggatgaatgaatgggtcggggggatgctgaaggatgaacttatagatgaatgaatggatgggtgggtggagggatggtgggagatagacatacagatgaatggatggatgggtgggtggggggatggtggaggatgaacaaataaatgaatggatggatgggtgggtcgggggatagtggaggaagaacatatagatgaatggatggatgggtgggtggggggatggtggaggatgaacatatagatgaatggatggatgggtgggtggggggatggtggaggatgaacaaacagatgaatggatggatgggtgggtggggggatggtggaggatgaacatatggatgaatggatggatgggtgggtggggggatggtggaggatgaacatatggatgaatggatggatgggtgggtgggggatggtggaggatgaacatatggatgaatggatggatgggtgggtaggtgggggggaatgatgggagatggacatatagatgaatggatggatgggtgggtcgggggatggtgggagatgaagatatagatgaatggatggatgggtgggtaggaggatggtaggcgatggacagagagaaaaacagacgcatagatgggatggtgggggatggatggatgaacgtatggatggatggggggggatggtggaggatggacagacggatggacagattggggaatgaggggtatggacagacagacgggtgaatggatagggaggtggatgaagtcatagaagggtagacagctagatggatgattggatgggtttacagatgaatggatggatgagtaatagatttgtgggtgggtggctggagggatgggagaagaggaggccagatagaagggggtgtaactgagtgagtgaacaagtgtgtggacaggagactaataggtggttatataagaaaatgaggggagatgagaggatgggtgaatggtggctagttggatgggaaggtggctggatggatacgggtggtggtagagggataaaatgatgatggaagaatgtgtaggagggtgggcagatgggatgctgaaggctgggtggatggaggagtggatgaaggagaaaacagagtgcgatgcatgaatggaagggggggtgggctgtgtaagggccggtgggcaggaaggaaatgctggaacctcactaagtggggaaagccccggcccgcaaaccctctggggcaaaccatggtcagcacacactgtcaggaacacgaaggcatggtgaggaacctgagggtagaagctaaatcctttccctgaaaccaaagctgacatttgacgacatcttgccaacccagacattcctcctcgggagtgcggccagagccttgtccggaaaatgaaattatggggcccgagtccagtgtgggttgaggaattagaggaatttccgaagggtcaggccagtgaagggtggcaggcggggcctggctcccatcctgaccccttgccagctgtctaccagaacacagccagggctgcgctggcccccccctcgaggggagagacgggacggatgaccatcgagcctcctcccataccccctttcccctccacccttccctacaaggaggaaatgatgccagaagtgccctggcaggagttggacccaggcccagcacccaccttctgcctgggaggacatcctgggagctgccagcacagagacttcctcgtccccctagctggccaggccttgtgggggccccatgtttaccctgttgcccctactgtggtcagatggtgcccaaagccttgtgggtagcttctggccaagcccactggccgggcactgtactcaagctgggacagggccagagccgggggcctggggttcacagggcggagtccacatccatctgtgccaaggccaggaccacagtcccttgcagactgtgttggatccggggtgcctgggctggggatgactgttctcagcctccaagcagcagaaagaacccccgaggaaagacgcacaagcgtgactttgtgagaatgaaactttctgtatatccaaaaaaaaaaaaaagggccacacagtgtggtcatgttttttaaagaactgacaccatttagagcaacacatgcagtgagcgttttgatgaaatgacgggtgctggcgttactcgcagaccatgactccagcatggtgaggctggtgtggggtgtgcaggacccatcacactaggctctccacttctgtgcttttgtaattttccataatggaagaagcagccacaaagaaaatgaaaagacaatcgacatgttgggatcaagtatttgtaacatacaacaacaaagtggcatcctcagcccattaggtgctctcataggctgctccagagccccacagtcctgcccctgccagtctaccactcctcgaagcacgcgccgctggcataatcagaacctcagtaggaaatagacaaaccagataccctccccaccaggcaggcgagtgaaagcagaggccagggaccaatctccccaggggccagggcggtgcccactgtcagagagccataatcagattcagcctggaaatttgatttccccagcagaggcaatgagccaggctggatgagacgccatcgggggttgggtagagggacagagatagctccccaggctgtccacatgctcactcagtggcacccgctgatcatgtgagggaccactcccatgtccagggagaatactcagaaagggcctcttcccacgctgctcctgccctgcactaatgcagtgcccaaggccaaaggtggccaagaccaaagctacactggccagccccagggggcatgctggatgggaggtccagggggactaggggctgtgtggggctgatacggaagctggggtccggtcaaggcagggtcactgctgggggccagggagctgggaagcctaaggttagggcaagggctggctctagtggccgaacgagcccagtgactgcaggcaggacgtgacaggtgagcaggcagggcaggcgagtgtcccagcaactgtccctcctctgtgggaggcatgagccacagggagccactgctggaggtccctaaagggtctgggcttaagattctcaatccagcaggtcacagacacctgctccctgtgccaacagcagcatcctttaagtctccttggtctcctgagacctgcctctccatgaggagacatgagatggggtggaaaggagtcctccaggtcccgattcaaaacagcccccaatgcccttcctgtgcctgacccagactctagctacagctgcagcagtgggtggtcctgcagactccaagccgtggagtagtggcagtgaggggccacattctctgggctccctgctgcatcctgcccagggcaccaccaagggctcaaaggctggggagctccagggagagggctgcagaggctgccagtgcagtgtcttctcccctgcacactcagcccacccactccgcccccaatgatgagcatgaagtttgtaggagtgtggagaggtgtagtgccctactaagtgggccggacattggtggcggtggctggcccattgcctccacggcttaccgggacgggcacccaccccgcaaggtgccgtgtggcccatgccctgccttagggagggcaggcgcagtggaggcggaggcggggtgtaaaaggcccagacatggagctgagccccgtcctctgtactctggggtgggcacagggaccaaagcatccctgaggagcgaactgacagggttcacagctaggctgggatcagaggcagacagccacagggcctgggagccctgccctaccatgccctacggccccactgaggcactgtaggagacagctgtccaccaggctgaggggcctcagcgggcaggtgcagcagtcaccacgctggccaccagcctgagtgcacagggccgtccgcctgcaacgccctttcccccctcattggaagacggggttagaccccttcttcccagcccctctatcaccatggaaacacccaggcttctcctgagggacagagcctctttgtggtgacacaaagcccctttgaggggaggtggggtgcagcccctgggagcctgtggccaaagggcccctggggggtaaagcagggcccgccggcccagcccccctcccaggtttcggagccaaggaagctgaggtaggagagccttcaggttaggccagcccgccccagctgcccacccagaagggtctccggatggatgagccggacagcccaggaggccaggctgaggctgggcagagacagcaccgagaagcctctctgcaggagctggggggttcctgctttcccctctgttgttttgacaaagaacacactctgcttagataagtggaaaacagcactggcaggggagctcccgccagtcaggaaatgcccaggatggctgcaggaacagtgcctggtgggagatggggacaggaagtcctccgtgggagggcaggcaggggccgtgagacggcaggtcagacagtgggaggtctggcaccaggtgtgccgagaggactggccctggcatctgggccccactcagtttactgtcctctcacttctcaagcctcagcctccgtcttcacctatccgcccagggggaaatgtcactggccttgctgcagccacaactctgggacaggccagagttggataaaacggaacctcaccatggcttggcttattccagggctggggaaatggaaccctgaggatgatgtgggtccctggcacagtgacagcatggctgtcccatccatgctacagccccacagccagggaggcagaggaggccaggccacatttccccagactcccagccctggagcccctcctgtactggcctgagagtccctgcccccacccactgactgctgctgaccaggcacctggcagctccctgcatgtgggcgccctgcctagaggccctcccgagttgacctcactctgacccacagcagctttgctaactaagcccctggggtggggttggggtggggatcactggccccctgcggcagcacgaggaggcactggcccagggagagatccatccttttgtaggcaaatctacctgactactagggagtggggccaagggctgcccccacagggcagtgcctgggtcagcaagcacttgctgcacccccaatggaggccctcaccacacccctcccaacctgccttccccactggcaccccactctctgctgacacctgcaggcacaggggtgggggttgggaccctccagctgccgtggcagggagtggccatagggtggttgctgtggtggacgtaggccatatggttcagaatggatcagaggatggtgtgggtgggagaattaagtctgggctgaccgcaagggatcaggcctgggtggctggagggaggggccgggaccctgagtgggagggtgcaaagggagtctctgaggctggagaggctgagggaccactagatgcatgaagttctggaagaaaggggttcaggctggagacagaaccaccggcaccttcagcctgtgaagccgagagataagacaggtgcaagccccactgcctcctccaaaggaccctcccctgaccttctagaacaaggggacaaagtcactttcccagccatcatcttccctgcactggaaggggcagaacgaggacccagcactgagaggtgagcctcaggaaggaggcagtgctgccagcccttggggacaacagcctgtcccctgaaagtcccaaaacccttgggaaaggtgctcctcactgtacccttctcccacccagcacatcagaggagccagtggtgtgagatcttgacccagcatgaagtagagcccaccctgtcatatgcagggaggttccatgtcccctttggtctgcccttgccccagggtcctgtgtggcctctggccagagctggctgctcccagggtgcctggggcaccgctcatcccttccagagcctgagctggatgctggccttgccgctcccaaccccctcctctgctgggagccagctccactccggagtgcccatggcaacaggcctagacaccaacctccagcaagtgcacaaagtcctgcctttcatatgcaagcaacacagagggccaggcagggggctgcaccaccccatccagggcagattccaggccctgcagcctcccatctggctcccaccgccacataccaggagagcctcgggacttgactgtgtgtccagtccccactacaaagaggtgggagaagtgctgacagtttggggccctcctcaaaggcacctactggcacatgtgtgcagccacccacactgctacggtgtgaatgctagtgttccccaaattcacattaaaacctaatctccaatgtgacagtattaagaggtagggcctttaggaggtgattagtgcccttatatgatcagtgtccttatcaaagcggctcttgagggctggtttaccccttccaccatgagaggacacacagcgccatctatcaatagccctcaccagacacggaatctgctggcgcctcgatcttggacttcccagcctccagcactgtgaacagtatgtttctgttgtttataaaggactccatctaaggtatttggtggcagagcgtgaatgaactaagacacacacagacacacacacaagcacacccaggcacagggacccacagctgccccacaggcacacgcaccagcaggcacactcgtccacacccatatggctgctgcttatcccacctagaagtcccgacaggccctttggggggtgggggacatcttggctcctggtgaagatcagcatgctaggcagactccattcctgtcttggacaccgggcaaggcagaccccctctgagacccctgaggccgggtcaagcctgcccctgacaccaagatctgcaggaccccctgcctctgatcccacatgaggttcctctgagacaggtgggagtggctgggcctgcagaccccgagcttgcacagacccacctgcagggacaagcacaacttacagcagcctagtgcccagggaagacccttccaccatgggaggactcaggaagccgcttcccgctgagtcacatttagcgcatttcttaggaaacagctggtatgtgccctagaaggttaaagacggtgttcaactccgctggccacagaccacaatgaaaaggagctgctggctgggcacgatggctcatacctataatcccagcactttggaaggccaaggtgggaggatcacctgaggttgggagttcgagacctgcctgaccaacatggagaaaccccatctctactaaagatacaaacaaaattagctgggtgtggtggtgcatgcctgtaatcccagctactcaggactgaggctgaggcaggaggcagaggttgtggtgagccaggatcacctcactgtactccagcctgggcaacaaaagcaaaacttcatctcaaaaaaagaaaagaaagaaagaaaaggagccgctataaataatgaggatcccatggagatttaaaggaaatcccagcagaggcagtaaacagcagactgtagaaaacacgcagtgtgaggctggagaaagtacactaagacggtcctcccaaccccaacagcaaacaggagagatgacaagaggatggtaggagccacagaagacagagcccagggccaaacttccacatgataggagtttccagagcgagaacgacagacagtgctcttccaaccacagaaaaacggccagaaaccacctcaacaggagtacgtccaacggggctatcagcgtcagggctggaatctgagttagggtgtgagccttctgtccagaaaagaagcccaggaagtcacggatgtgtctacctctggcttttacaattcagtctcatttcctctggctcctaaatgcgctgtgtccacttcgaggtgtagggaggagggtgcccagctctgacctgcgggctgtgctgaagcctgggcctctctctataccaggccgtctgcaggcctgcaggggctgcatactgtccctctgtaaatgtcagcctcaacacgctgctgcctgctgcctggctcccgtctctcacagctcagaagctgttttatgataaaaaagagctgacagctttgttaaaacaaacaaacgcctctcctctctacttgagatcttttacaaagttaacatcgctctgaaaccccataaggaaaaattatggtgaggtttctggattttcagaggcagcaaactcatcttacctagagccctggactacccagagaagtagttttaagaaccaaaagaagagaagaattcaggagtaaatgaggcctggataacccaagggatcctgtgcttgcactgctgggattcaaatttgggggctgccaccaccacaagtttgtgagaagcccacagcctgcgcatgaagattgtgtcaagggaatagcagctgctgatgtgtggaattgattttttcagcaagggcctgcgattctgaatgcattaaggcagctccagttgtctgtagcagtcctctgtcagctgcccattggaagcatttttactggctcaggaaattcatgggtttgtggactgatgactccaacagattaggtacaaatccaagaaccacaaaacaaaatctaaccaagccaaacaacaatcaaacaataaaacagaacaaaaaaaaacctcaatttgttttccttttctttgtataacattaaaataaaaagatggtaacagactaccataaagaattatacaccaacaaattagataacccagatgaaatggaaaaatttcctagaaacacacaacctaccaagactgaatcatgaagaaatagaaaacattgattagatttacaactagcaacaaaactgaatcagtaatcaaaaacctccagcaaagatggtttcactggtgtattctaccaaacattcaagtaattttaacaccaatcgtcctcaaacttttcccaaaaataaagaggaaggaacacttcctaattcattttatgaggtcagccttaccctaataccaaagccaggaaaagacactacaagaaaagaaaaccacaggccaataacccttatgaatactgaaacaaaaattctcaaaacaaacaaacaaacaaaaaaacactagcaaaccaaattcagctgcattttacaagaattataaacctaaccaagtgggattttactcctggaatgcaaggatggttccatgtacaaaaatcaatcaatgtaatacgccacagtaatagaataaaggacaaaaatcacaatcatgtcaaatgatgcaggaaaaacatttaacaaaattcaatagtctgtcatgataaaaacactcaaactaggaaaagaaggaaactttctcaacatgatgaaagctatatgtgaaaagcccataacatcatactcaatggtgaaagactgaaagcttttctcctaagatcataaacaagacaaagatggctgttttgaccacttccattcaacatagtactagaagttttagacagagtaattaggcaagaaaaagaaataaaagacatccaaattagaaagaaagaaaaaccatctctgttcatagacgacataaccttatataaaaccgtaaagattctacatgcattttttaaaaactctattagatgtaaaaaatgaaatcagcaaaggtgcaggataaaaaatgaatacccagaaatcagttgcatttctatatatgaacaatgaacaacctgaaagggaaatttaaaaaaactattccatttacaataccattaaaaagaatagaatacataatactaaacttaagaaacttaagatctgtacactgaaaactataaaacattaccaagaaaaatttaaaaagacctaaatcagtggaaagatatcccatgttcatggctgggaagatttaccactgtcacaatgacgatactactgaaagggatctacagattcagtgcaattcctattaaaatcccaatgacagccaggcatagtagcatgtatctgtaatcctagctagtcagaggctgaggctaaagaactgcttgaacccaggggttcaaggccgcagtaagctaggatcacaccattgcattccagcctagatgacagaacaagacctgtcaaaaaaaaaaaagaaaagaaaaaaaaaatcccaatgacattgtttgcagaaacagagaaatctatcataagatttatatcgatctttaaggagcccaaagagccaaaacaatctggaaaaagaacaacatttaaggactcacacttcctgatttcaaaacttactacaaagctacagtaatcaaaacagtgtggtattagcataaggacagacacaaagaccaatggaatagaatacagagcccagaaacaaaccctcatgaatacggtcaaatgaccttcaataaaggtgccaagaccattcattagggaaatgatggtattttcaacaaatgatggaactggatacacacacgtaaatgaatgaactcacacccttaccttattacatacacaaaaattaactcaaaatagatgaaagatctaaacataagacctcaaactataaaactcttagaagaaaatataggggaaagtcttcatgacactggatttggcaatgatatcttagataagataccaaaaacacaggcaacagaaggaaaaataaattgtactacatccaaatttaaaatgtatgttcatcaaaggacacaatcaatatagtgaaaaagcaaccaacagaatgggagaaaagatttgtaaatcatatatctgaaaaggaattcatatccagaatatgtaaagaactcccaaaacttaacaacagcaaaaaaacacaaataacccaatttaaaaatgagtggagttgaactgacatttctccaaagaagatatataaacggccaacaagcacgttaaaaaatttgctcaacatttctatcattagggaagagcaaatcaaggctgcaatgaaatatcaccttacacctattaggatggctagtctaaaaaaaaaaaaaaagttttggcagagatacagacaaattaagacccttgtgcactgctggtgggaatgtaagatcagtatggcaattcctcaaaaaattaaaaatagaattaccatatggtccagcaatcagaaaattctgcattatgtatctaaaagaattgaggccaggcgtggtggctcacgcctgtaatcccaacactttgggaggccgaggcgggtggatcacaaggtcaggagatcgagaccatcctggctagcacggtgaaaccccgtctctactaaaaacacaaaaaaattagccgggcgtggtgacaggcgcctgtagtcccagctacttgtgaacttgggaggcggagcttgcagtgagccaagatcgtgccactgcactccagcctgggcggcagagcgagactccgtctaaaaaaaaaaaaaaaaagaattgaaagcagagtctccaagagatatgtgcacaatcatattcacagcagcattattcacaatagccaaaaaggggaagcaacccaagtgtccaccagtggaaaaatggataaacaaaatgtggtatagatatacaatggaatatcaggcatcaaattctgacatatgatattctcatgatactaagtgaaataagccagtcacaaaaagacagatactgtgagattctatttatgtaaggcatctaaagtagtcaaacaataggaaaagtagaagcacttcaagaaaggggcaaacggggagttttctaatgggtacagagtttctattttgcaagaataaaaaaaagttctgaaattggttgcacagcaatgtgaacaaacaacactactgaattgtacacttgaaaatggttaagatagtaaattttgttatgtgtattctaccataattaaaaattaaaattaaaaaagaggctccctggccaggcgtggtggctcacgcctgtaatctcagcactttgggaggccaaggcgggcggatcacgaggtcaggagatcgagaccatcctggctaacatggtgaaaccccgtctctactaaaagtacaaaaaaaattagccgggtgtggcggtgagcgcctgtagttccagctacttgggaggctgaggcaggagaatggtgtgaacccaggaggcggagcttgcagtgagccgagatcgcgccactgcactccagcctgggcggtagagcgtgactctgtctcaaaaaaaaaaaagaggctccctcacataataagtaagaaattgcataatacccttttatttatttattttttgagacggagtcttgccctgtcgccaggctagagtgcagtggcgcgatctcggctcactgcaacttccgcctcctgggttcaagtgattctcctgcctcagcctcccgagtagctgggactacaggcgcgtgccaccatgcctagctaatttttgtatttttagtagagacggggtttcaccatgttgaccaggatggtcttgatctcttgacctcgtgatctgcctgcctcagcctcccaaagtgctgggattacaagcatgagccaccgcgcctggcctacccttttgaaataaatagtatatcaaaggtaaaaatttaaggctgggtgcagtggctcacacctgtaatcccagcactttgggaggccaaggcaagtggattgctggggcccagaagttcgagaccaacctgggcaacatggcacaaccctgtctgtacaaaaaatacaaaaattagccaggcatggccgggagcggtggctcacacctgtaatcccagcactttgggaggccgaggcgggaggatcacctgaggtcaggagttcgacaccagcctggacatggtgaaatcccatctctattaaaaaaaaaaatttaaaaattagctggtgatggtggcaggcacctgtaatcccagctactcgggaggttgaggcaggagaattgcttgaacgtgggaggtgaaggttgcagtgagccaagaatgcgccactgcaccccagtctgggtgacagagcgagactccgtctcaaaacaaacaaacaaaaaggaaacagttcagatgcagctgtaaaaacaaagttaaatccttgccgtccatttacatcagaataaatactagtttgtgctatgggctgaacgtgtcccccaaagttcacgtgttggaaacttaattcccaacgcaacagtgttgaaggtaggacctctaagaggtgtttaggtcacaagggctctgctacatgaatggattaattccgttacagtgggagtggatttgttatctcgggagcaggttactgataaaaggatgggttccgcctccttcagcgctctctcacgtgtgctcctgcccttctgccacctcctgggggatgtagcgacaaagaaggccctcgccagatgtggcccctcaatcctggacttccccatctccaaaattgttagaaataagtctttgtttttcaggaattagccagtctcaggtattctgatacagcagcccaaaatggactaagacagacagattaaatgctgtgtacaaaactaaagtaaaaataccttctagaagaaaagacaggtgcatctttatctggctgcatgctagggagagttgactacacagagagacggaatatctaaaaatggggaaaaatccaacacacttcaccacaaaatatgaaacatttttgacatcaaaatgatcataaacaaaaactaaaagggtgagaaaaatgtgcagtaggcagaaagaggagtgaagaattaatatctttaatatacaaagactcatacaatggctgagaaacacatcaaaacccaagagaaggcctgtcataggggccaggcggccgcaggagacgaagccgcaaccccctgcaggcacacggcggctgatggaggaggccaggctggtgctggtctctgagaggacaccactgctggccagctatgggaaacggcagggcatctgtgtccccgccagcccttctcactcaggcctggtctcagcacgcaccaccccatcacaccctcccagctccccctcctaagggagccatgctactcatcaccatcttgtaaccccacagttggccactggttcctctgtgtgttgtggatctcctcaaccaggctgggagctcctcaggggcagggctgggcctgatgtgcctgtgatgcccaggacccagcatgaggctgggtgagtgggtgctgagtgtggtgacacatgggtgtttacatcagcccctgtcccagctgagccctgaggctccctccccagctgcctcccgctgtggacaggaccacaccccagggcccagcagagcaggcagccgcaagccagagcccaggttgcccaagccagagcagagatggcacaaatgccatcacccatcgcaccagtgcccagggcagacatgaaaaaccaatcaccacagcagacaggaataagcaatcaccacattccagatgggcaggataggagatggggaaaggcagagaaagaggcacagagagggccacagagaaacatagagaagaccaagaactggaggggggagggaaaagaagggacaagaaaggagcaagcaacaggagggagagtgagcaagtgtgcctgggcagcctcggacctgcccagccaaccaccctcctgcggaccctgttaccagggctgtcgtttggtgtctggctgacctggcctccctgaagtgtggtgacctacgaggagttaagggcagtgggacagcccctcctgccaccctgagatgccctgtcacctgtgccacaagcaagccaagtaccctgcctgagcttctttgtcccaacccagaagaccctgcatggccaaatggcctgagcagtgacattctcggccagacgctggtcctcccacacagccaggcggcagcagacccagctcccactaggctggcccggccggcagctttccatgcccaaggacttgggaacaggcaaggagtcagtcatcctgtccctcccatctgccctagatccctcagcctaggtcactcaggcatccggaggccatggccttctccctaccacttaggcacagcactggctgggccatgcctccacaatgggcactaattgtcactgagaaaccacagggctgtcagccatgcctcccacagagactgctttttggggggacaggcagatggccagggtggggactggaggaacaagaatggccaggagccattctcttaagccatcacccactctgctgaacagcacccatcgtggcaaaactctggcagcgtggatgtgagcagggtatgccttaccatccttcagagggtcctgggggacatggaccactcagcctccaaccctgccatgcttcccaggcgctatgcctcagtcccactggagctagcagccatgataagcagaggaaccccaaacacagataacacctgaggccacgggccagtacacatggcctacggctgtgatcagagtacattcagactattcagttatgggctgtctgcagccattttcatcctacaatggcagagaactgcagctgtgacagagaccataaggcctgcaaaattgaattacttactatcagaccttttcaaacaaagttttgtgtgcctggcctccaggactatcctctgtccctgtggctccagtctctggggggcaagcgaatggcctggcccagcaggctgtgccaatactggatgccactgcggctggcatcctagctcaggcaggtgaagagcagacccagtgaatgtccaaaccaacactgaccagcaacctcgtcagccagccccaaacaggcttgtccctaaagccagacatcaaaccagtggctgctgcccatattcaggccagtaacaaacccaagctggtggcaggaggccctcacatccaccctgtccagcccaggggctgtgcctacccagggtgagaaggaccaggagcacacagtgtccagggccagtccatccctgtcacccccacccgccaggcccaccagaacactctgctgtcctatgtgggagaggatgtccccaagctaaacccaggccactcacctgtcttgagggaagatcagcatgtcccgacacccaccctgcaggctctggctcctgcagggaaaccagagggcatgagtgaggtcaatccagctgggtaggtccctgccggataaaggtacacaagcccagaccgtcctctaagcaggaccttgtcatgcctgatctgaaggtcatcccgtggtgctcctgactcataaccacacactcatgtgtaccttcttgcccccacatgtccaggactgtaggtgacactgggctgccacggttccttgtcagcatgtctaatgctgttgaccatccttcagaaacgtgatccttcagagatgtggactgataatgacgtcttccccatcacacacagcacagcagtattcccaccccagggtagccaggctcagggtcctgttgccccacgcaggtgctcacagccccataagacatctgctccacctccctagagtccgctcccgccttgtgggcgaggccacgtgcctctcctgaggttccctgaggccaacatagatcctgggccctcccaggcaggcagctgcccccaacagtctccagtacagggagggcggggaagcaggcaggttcctggccctggagctgtggccaggtgtgaataaccatttgtctgggatgggggacctggcactcaagcctggggagctgaggcttatgggctggagcaggagacaagggggtgcctgtactcacacagctttcagccttcctcaggggaggaccctgcggcttcctgtctcagctaatggccccggggacacattccctctccttatatctaggcccggggatattgccagagtgttcatgtcataaaaatgaaaaacaggacactgcagacagacagggaagggctgggcctcggatgggaggctgtctctgggggacatcggtaatgagagctctctcccccgcctctacggtgttttctagattgttctgaggccccgcccaatagtcctttgtggtcatggtccattctggtgccccaacggtgtgtttccccgtctcacgacagcctcttcatcatgggaaggggtccaagtgagggtgggcgactggctacgcctcagggtgggatcatggggggtgggatgcagggcctgaggcagggaagaactggggaccaagccaggcacatgtgcatatgcatgtgcgtgcatgtgaatatgagtgtgtgtgtgcacctgagatgggcaggcccggttgggagcccatccaccagcactgcgccccgaggaagaggagatgctgctcctactccaaggtctgaggcttaggaaccagcttttgctctgagtgtgacatttctaggaaacctctggttttagcttaagtgttcacataggttttgtaccacagagaaccatgtgactttttttttttatccctgataagcaccagcctctcccccggagtcaccatgtgccacagaaccgagacacactggctgtgagccgtcatctcactgactctaccaggtgtctcaggttggctatataccccattttacacatggagaaactgggtcccagccagacaagggctgggccaggatttaactcaggtcttcctgcctccaggcctcccaaagtcccccccccccacccagttggggaagtgtgaccaaaggagaacatgggtccttcctcatgggcctcctacctcatggggtccagccaggccaagaacctgcaaccatatggtagagccaatagcagaccctgggaaggggtccaagtgaggcattggagagggcttcccccaggagatgggtgggagcagaggatagcagcaccacaggaggctgagtggtaggagcagccagagctgtgggtatccttcctaagggtgcactaggcacatcagcatcgtacaggcaggggcagagcagagcatctgtggacaacctaagggagctctgggcagtggacggacagagggacgacagacaggacagtgatgtgaaggcagaactagtgataggatcatatgggaaggtggggaggtgctcaccttggggagcccccctgagtgctctgcaagctctggggtcacctgcctggccaaggacccagtaccagccgcctcaaagcgggggaatgaccacgccctttattgggcccttttcccagtgaggatggcctgggcctacccatgccatgggacccccacactgggtctccccaccaaactgtccagacccgatggctggccatggggctctgtcagcccctggctacaccccactgatgccctagtaagccctgtggttctggcacggtatccatggtccaaccagagggctgagaggtctcacactggggcataagcctggcccaggccacacagccagattggcaagctacagtcctttggatagctgacggcacagggcagctcccatgggtacacactgggcccagaactgggatggaggatgcagcctgggctgggtaggcaatgaggggcccaggtgagctcgctctgcactccctgcagtgtggcctcagcaggccaccccctccccaagtctcctcgcttcctgctctatgagcgcgaggtgacactgactgtaggtagctgagaacatgccctggcaacagccaatgcaggcaggtgaatggagtgccccgtggccagtggacagggaaggtccatgctgctcaatgacaatgctgtccactacagcaaaaccgagtgttctcctaggcctgctgccaccctgggcacatagtgagaacacgcccacttctgctgtggacattgaggcacagaccacacctgggaaggcttgggaggcccctgggcacacacttgaaggacactgcacttttggggctacgcaggcacagggctagtccttcactgtccctgctgagcctgtgtgtggtcacccaccagctggccttcaggcttccttctgcctgcaccaagcatgttgggggtaccgaggggccttgcttggctcctttccaactccacgccctcaataggcggcttggaggccgagctccggtcatccaagccaggtgtctggggaagggtcctggtctgccgcaggaagctgggtggagccggtcttgcctgctgtggcggtcccagctgccctctggtggccatgctcagctccccgttgctctgccagaggcggcagcccctcaatcagcaggggcagtgggaagggcctgtgcataactggttatggagtggggggaactctgtggccccaggcacccaccagctctgggtcatcttcccgacctgaaacaggccaagatatgaaggccctgagccaggaaaacctactaagggatccctgatcccaagtcccctcagagtgacccaagacttcatcttgggtttttctgtttgtttttttgtgggtatttttttttctttttttgagacggagtctcaccctgtcacccaggctggagtgcgatggcacaatcttggctcactgcaacctctgcctcccaggttcaggcaaccctcctgcctcagtctccccagcagctgggattacaggcatatgccaccaggtccagctaatttgttttgtatttttagtagaaacagggtttcaccatgttggccaggctggtctcaaactcctgacctcaggtgatctgtctgcctgcctcggcctcccaaagtgctgggattacaggtacgagccaccgtgaccagcccatcctggttgttttgtttgtttttgttttttggagatagagtctcgctctatcacccaggctggagtgcagtggtgtgatcttggctcactgcaaccctcacctccccggttcaagcgattctcctgcctcagcctcttgagtagctgggactacaggcgcatgccaccatgcccgactaatttttgtatttttagtagagacagggtttcaccatgttggccaggctagtgtcaaactcctgacctcaggtgatccacctgccttggcctcccaaagtgttgggattacaggcatgagccactgcgcccggcctcattctggtcttaattgaagctgctgacaaaagaacagacacctccccatgactaagccaccatcagggaagtccccaggacccccaaggcccagctggtgctctgcagtgctgtccctggacccccaccctccattcctggccctgtctacagaatgggccctgactccctatcccagctctaccctgtcactccctctgccagggccaggcggggagcacgacagatgggctggacagagggtggtgcctggcatccgtgtgcagagctccctgctccacccagagaccggggatcctgctgctcctgcaccttctgtccttactcaggacagcctcatgctcccccaggccagactcctggggtgaaggagcacagggaactcaccctgaatccctgtgtagcacaaacagaaggaggggtgctaccctaccctcacagagccacagagatgcagagggccccgggactggggggagactacagggccacctctggagggagtgccagagcaaacatgggagccaagcagcccagatgtggtgggtggggagactcaaatttagcaggattgagggtcagaacttgttctcccaggaggaaccttggtcagaaggtccttgtgtttatgctgaaaagcctgacagggcagctcagccaagagctgggcaggggctggcttggctgtgctcaactaccctctcagctgggacttgagtcccttagcgaatgttctgtgcccagtcctctgctgggcgctggtggaccccagaatgggggtagggtggggacaggggacagctgggagcagacattgcggataggatggggcaagactgggggaaatgccttcccagacacgctgcggctcacactgtcgcctgatctaaggcctggatcacctgcttaggagctgaccggccactggcatggcacaccgggcaagagagcgctgactgcccccctgcattcagcaccatcccagctccaatagagtgagtacaagataggtaacacctgccttgtttggaccagacctctaaacaccgcccagatcccagagtaaaggcagataaggcagtagttaagaagtaggaagaagtaaaggcagctaccccagagaagctaaggtcgggagaggtggaggctcccactgcacccccctggcccataccataggggaggtttcccccacagcagcctgggtactcacctgaggttattagacagcagcattaagagcctactctaaaaaatacccacggggcacctttcttttccttatttctaaatatgcctggatgtagggaaagggagctgaagtcctttagttccattttaagtatgttacattacacatagctaagaaacggtgaaatattgtaagcagccaatatttaattatttaaaaattaaaataggctggagctctcaggccacctgcccagggcgactccccagcaaaccgagcagtctccctcagagtggagatgacatgtctccgcaccggcaccgagggggcgcagggcggcgtggggagggggacccaggccgggggtccgggtggcgcgccctctctcacccccgaggcggcaggagcagcgcggcgcgaggacacctccgggccgtcggtgcccctgagcttcccggcggcgcgctgccccaggaaagttcccggcctgccgcccctcgggctgttggaaagtttcggcggctgcagggccctggcagctaggcgccaagcgtcgcgcggggcgggcacggctgcggggtcgggccgcgctcggctggagtgctcagtgcaagacgcccggacgggtagggtagggccccaaggccacgcacaaagagacccgcccccgccggcccggggtctcggacgccgcagagcgcgcggacaagacgcgggtggggcggagattggctccgacgtccggcccagaccctcgcccggatctcgactccagggataggaccctgtccggaccgctgcccggaatgcgtcccatatctgcagccccgcccccagtcccggctccgacccgaggccccagccccgggtcccacaccccgcccactggctcaggcttacctggagcgcagcgtgggcggccccgcagcgcggcctcggaccccagaagggcttccccgggtccgttggcgcgcggggagcggcgttcccagggcgcggcgcggtgcggcgcggcgcgggtcgcagtccacgcggccgcaactcggaccggtgcgggggccgccccctccctccaggcccagcgcgcaacccgagaccccgggccagccctcccgccctcacgcggcccgtgcgcaaagcggaccgggccggcgacgcgaatctccgccccgccccatctgacagcaaattttcccattggtcgagagacccggcgcggcacggcaaccggcgccgattgggcggatgcgcggagatgacggcttgccattgggcctccgggatgtcagtcccggcggatgaccggccccctcgcggaggggccgcggccccgcacctgcccgaacctctgcggcggcggtggcagggtacgcgggaccgctccctcccagccgacttacgagaacatcccccgaccatccagccccgagcagggactggcagagccggcgccccttccccggactctggccgcgtagcctccgccaccactcccagttcacaggtatccttcttcagcgcctgctactcgctgcgcgctgcgcgccgctccctcctgtcgacatcgaattgtattcttcacgcaagccgcgagagagagttctgctgctatccccattttacagttgggaaacagcctcagagaggttctcacttgcttgaacacagtcgtctgaccctggggcctgggggctctctcatcctcacgcccctgggtccccgcagcggggagacgatggaggtaggagctgcagtatttccgagggcaggaagggaccccctcggtaaaccaggggctcacctcccccaccaggcctggatgtagagacctcttgggcttgtcccaccctgcaggccccccatggggccgccctttcttacctcctcctggcattctcacagccccacagctctgcgtctggggaggcagagttgtgcgtttatgcccgcaccccgtactactgtcccattttcttcaccctacctggagtcaggaagaaacggtgcttcactgcctgttgagattcacgtaggttacatttccttgccagattaagagcacctgacatgagtgggaccatgaccctccgccagctctgcgtaaccttgtggtgtaggggggaaccagcagggatgctgcccagtgggcttttctagggggaggtcctgagatgacttcttagccagtgaccctggctcacgcatgctgtcatcctttcctgccctggatgcacctggagatgaccagttcctcggctcattgcattctccaaggccgcctggggaaccaaactgcccacaaccatgcttatgagtggtggaggggtgtgaccagacactcttgtcttatccacccatattgggagtccagtgtgttcatccaatcattccttggccaggacaaagaaaatgaaatggcccaaggcaagaactcactgctgggaccaccgctgggtccatctgtgtgctggcagcatggtgaatcgatcccagctgcctttcagagccaggcagctactatcaatcgattggagctggcacttgacgtgccaattggcctcctggcatagggttgttgcttgctgctctgggagggcagaatgaagtagctgtccctagaataggggccctcacaaaccaggtagctgtcatcctgtggagcagcaccatggtgacattctggctcaggtgctgtgtagctgaggggtcgtttcctccatttaggagtagacgtaatgagtccagctgtccccagccatctcttcaaggccattggaccctggttctgctggagcccctcttctcacagttacctcatagtcctgcaccaccccctccccacacttgcaagagggactggacagacctctgttgaaagagtgcaaaagacagaaccatacaccaaaatctgtgcaagtgagactacctctcctctcatcaccacccctaccacccatagggttgcagagacctgtctgccctcggcaggcaggatcattagctgaggtcagaggatgtcggggcagcaccaattcaaacaggactcaggaccgctgtccagcagtcggcccattaggctgcagccaggggtcagaaacacaacaagggaggctgggcgcagtggctcatgcctgtaatcccagcactttgggaggccaaggcaggcaaatcaccagaggtcaggagttcgagaccagcctggccaacatagcaaaaccccatctctactaaaagaatacaaaaaaaagtagcggggcatggtggtagacgcccatagtcccagctacttgggaggctgaggcaggagatcgcttgaacctgggaggcggaggttgcagtgagctgaaattgcaccaccgcacggcagcctaggagacagagcgagactccatctcaaaaaaaaggaaaaaagaaaaagataagaaaaacacagcaagggagaccacagggaccagtagcccagtgttctccctctctcatcctctcacctagctccatgcggacagctgtgaggcccccggagaaagccacagagagaaaatgctttcagctgggtgtcaagaacttttcaagagtggcagctgttgaaatcaaaagagtggccacagaaggtagtgagcttcctatctgagtttgtgtgcaattagaggttggatgccagtgagcctgttgcagccccaagatcccagggcttaggtgcccatcctagacccatttcatctgccgtcacctgcttcctggcatcgcatgtcatccagactggagtgtcagtggtgacaaagaagatcagagtgtctgctctggctctgtctagctgggaaaagtatggctgggggtggggatggcccaaggccacaaggtatgacagaacaggatgcaaaccaccatctgacatgttactgcatccctctttgtgggcaaagggaaaccttggtcaactcatgtccagctttgaggtgcatggcctggtgctttggggaagcccattctccaggtgctgccatgaaccccagggcacagtccatcacccccaagccccagatcccacttgtccaccaccaccacctcttggccctatagattgcataggtttggctgctcagagggaaatcactggtaccagccccacatgatcccactgctggatggtgggagagacaaccatgtctggctgggtctgcggcccgctggccatgagtccctgggcatctggagtccttgtaaaaggttctgttgggttccaggggaaacacagataagatagcaaaagtgtggagcacaacgggcccgcatgtaggtccaggttagactcttgccgttgctgattaccagccaggctcttcccatccctgagccccagttttctgcagggcatcagggcacctaggtcttcaacacaggttgaagctaatgtggcctctcttgcttgccacctttttcaacttcaactgaatgacataactgctccaagtctcagtgtttacatctataaagtgggatgaaagaactgctgacccagacattgggtttagagtgctttacacattatcattatccctaatgtctttgtcatccatgtcatagttttttgaatgctcactttgaggcagggcctgagcctctgggctttgactctccacctttctgccacataggcccaggcacagcccagaggctacaggagcagcggtcccagctaatgcctctgtcctgttgggagggccccagtcagtgcccacctgctcaccctgcacaagtcaagctgggccagcccctcgtcgctggggcctggacctggatgtgagctcaaaggctacactggggggtggaagtgggggaggtggtgggtgtgcagggtatagtgctcaaatgcctagtccagggtctgggggtacatactgggaatggcagggacatcagggaggaaagagccgacctggaggccataaagtgaaggaagggatgaccaagaggaagatggccaggtccagaggtggggttgagtgaacaggatggggagaccaggacgcagtctgagggggccagtccggaagtgagcattcctgtacctcttccgagagaggccgcagggtgagcaggtgacagatggtgtccatgagggcatggactcaggggcggctgcgacctcccatggcgtccctgcaggcagggagccgcggagtccccgaaggccgctggatcaggaagcgctcagacgcccgcgcagcccgaagctttggcgcagccccgggggcggggcgccaggaggtggcagcctccgagcgacagcgcgcccagccaacgggacgccggcatgcggcgcgccgccccgcccctcgctgcgcggcccaatggtgaacgcgccggcttcgggctgggcggtactgggctggctgcggtggcgcgcgggcgcggcacccggaagtcggcggcggtggcggaggcggtgagtgcgcggctccggggctggccgactccgctagtggcccggccggcctgggctcgggggctccgggctctgggctctgggtgcgcggaccgggccaggctgcttgaaggtgggtgggctggccgcacttcctcaccctgcctcagtttcccctttctgaggtatggtatagaatcaggcggctgggtcaggggcaaccacgtcgatcccggccgacgaaaatgccccgcgcgttactggaaggtgtttttgataatccccgctggcacgggatgcgagggactctggcaggtgggaccagactcgctgcggggaggctgagatcggcagggttgggagctgcgtggtccctgcagggtgtgtgggctgctcggccttggccagcatcagggacagctctggcgcccggtcactctgccccctacccgcggcctgctgcgggccagcagggtgacagctaatgtgggtgtgagtagatagtaagtgctgggtcatccctgcgcctggatgcggccttcctggggaggtttgggtagttagatcccccacccccaactccagagcgtcagaggtaggggctggcagggctgcactcagggcagtccttgccccaccgctgggctttgtagcagcctgggctttgcccgttttcctctaggaagtgggcacagagggctgtttgctgagacccccaccttccctgcccctagcacctctcctgtgctcccttggcttcctgctggaccacaagctttagagtgaaccgtctgcccttggacaagtccctgggcctcaggcccccttcctcttcaggaatgtcacatgccctgccctggccaggcctgtttgcactgtcgtgtggctctagacctgctgaccactgttttgctgccactctgggcacagtgccctcttccatgaggcagatgtgacggcagctataagggggtagctgagtagctctttggaaggctttctcacgctagctcatttgcctctgggcagccttttggggcaagcattcattgatccagtcctgctcatacaaggaaaactcaggctaaggtggcagatcgtgttcccaaggtcattcagagccagggcctgctcccagtgcctctactactcctgggccactctcttaggagtgtccctgtgtctgtgtcctgcgtctgtgttgggtgggctgggagcagctggagagggtgaccatgttgttagatggacacagcagagcctctgttcccacaggatcctagtgctctggtggtccagggtagggtgccctggtgcccccaccccctttgacccctacacagctttgtgttacttgcatgtcctcagactgcaggcccctcagaccaagcccctgcctgctgtgatgtgtggtggccatagcccttccctgagctaaggtgaccagctgtcagctcttcctgggctgcccagcctcttgtgcttccttggtcttcacttgtgggctgtcattctgattacgttttgcagtgtgtggaatcacgtgcagtgtcctgggaacttgatcctgtgcccggcttctgcgccagacggcgaacttggagggcaccccggtgcccacccaagggtgctgcttctgaaaacacccacagggatatgaggggcttctcagggaccccagaaggggtctggagagaaatggcccgggatagggaggctgggaagacttctcgaagtagggccatgcttgtcattgacactccagatgcatgagaagcagggcccatcctttggtgacgtgtcagtcagcacatggcagcagcatggcagagcctggcctttgttggcccctaccatagggcttgggctgtcttgaaaacaagcctatccctaccatgaggatgggctccgtgaaaacaaggtcaccccagaaagactgagctgctttttgaggttatcacagctttttcccctttttctctcaacttcccttttagactgcaaaaatagtttatgcatgcttaaagataaaaaaggctggcctccttctcccagcggctgctcccctggtgcacttgctgacatttgggggtacatccattgagatcttcagtgccatgctaacttgaaacttgaagtgcttgccttcatcctctttgcgggcatggtaggagtgcccccctttttttttgtttttactaaccactcaggccgcaggggccgctgcgaggctggcctgtccctggcttgtgaggaagctgagtgttcctcccaggagggcctgaggatggggccaccctgtgtccagagcttgctgtctgctcacgatgcctcttgtttgtgctattccttggaactgggaagagacagtgatcctctggtgtgaggctgaagaaatgccccggaagcattgtgaagatctgaggagagagtaccactgtagaaaatgtgtcatgataggccaagcacggtggctcacgcctgtaatcccagcagtttgggaggccgaggcgggtggatcacgaggccaggagatcgagaccatcctggctaacacggtgaaaccccgtctctactaaaaatacaaaaaaattagccggacgtggtggtggcaggcacctgtagtcccagctactcgggaggctgaggcaggagaatggcgtgaacccaggaggcagagcttgcagtgagccgggatcgtgccactgcactccagcctgggcaacagagcgaaactccatctcaaaaaaaaaaaaagaaaatgtgtcataataaaatgccatttaggcccggcacggtggctcacacctataatcccagcactttgggaggccgagacaggtggatcacctgaggtcaggagttcgagatcagcctggccaacatagtgaaaccccgtccctactaaaaacaaaatacaaaaatttgctgggcatggtggcaggtgcctgtaatcccaactactcgaaaggctgaggcaggagaattgcttgaacccaggaggcgaacgttgcagtgagagaggtcaccctctccagctgcccccagcccacccaacaggaccattgcactccagcctgggcgacaagagcaaaactccatctaaaaataaaaataaaaaatgccatttaatagccagagagtgtaaactggtgagctcttgctgcggagataggagggagcagggcattgcagtggactggagactcagagggtttcctgacgtcaggactttcttcgcccaggccccgtgaacagcgacactgtgttcccacgtgtgtttacctcctctgctgacagccaccgggagcccgcgtcacatgtctgtgtctgcctttgaaaagagcaactcgtgctttcaagctctgcccctgggggctgccaccgctgatggagtggggattacaagggatggggattgggcgcccggctgctcagccctgcagcaccagcccttgtggccattgaggccattaaatgggggcagcagactgtagggcttagtcaccctctgttcagggactcaccatgtgcagccccaataggagcccgacttgatggctaccctcccaagtgtctaggtccccttgaccctgtggtactaatagcttgccattcctctgtcaccactgctttctgcttagcacacatcccctctgcccatgtgctatgcttgccttttcgcttgccaaagggaagtggttccgccaaaagcgtgtgtcccatcccctctggcccccagggtctccaggtgtggtgttgctgcgacagcccagctacaccccgtcctatgcagagctgtcttgcaccagggctgattgggtcttctcttgctttctgtgaacaagtgactcttgggttcttgcccttccttccctctcttccctgcccatagaaatgtcccagccctggcagggaaggagggcaggatctgtacattttctttttttttgcgttttgagacagagtcttgctttgtcacctcaaaaggctgaggcaggagaatcgcttgaataccggaggcagaggttgcagtgacctgagatcgtgccactgcaacctctgcctctcaggttcaatgcgattctcctgcctcagcctcctgagtagctgggattacaggcgtgcatcaccacgccctgctaatttttgtgtttttagtagagacggggtttcaccattttagccaggctggtcttgaactcctgacctcaggtgatccacccacctcggcctcccaaagtgttgggattacaggtgtgagccactgtgcctggccagtgcactttcttttgagggtagacattactgttccccgccgggaagcatgcttactgggtgtgcacgctttcagtgtctggcgtgacagattgtacaaagtgaacccagccacacagctaccgtccatatcacaccaccaccagcacccagatatctccctcgtgtcccccagtggctgcctagaccaggtggccctgccctgcctcctgtccccatgggcagatgttgcttatctctggcctctgcatgaaagaccaagcagagtgctatcttctggctgagacctccctgctgcctcatcaccatggaaaggcacaggctggcttcttttccaggttatggactttcttactgtgtcactttgtggacttgggcacctgcagagtgcctggcatggtgagcaggagttggggcatggcgtgatctaggcagggtttggaaggttctttgaatagccaagggggacagtctggagggtgccctccagacacctgagaatgcattgaagctagggtgactactgcagcatcagaggcctggtgacacatttaaggcctcaaggggcccatgtgactagaagtccaggatgtggctgaggtgggccagactggatggccagcggccacctaaggacaattggctgtgcgtttgggaagcatgggtggtccccacctcacagcagtcgcacaggcagacagtgggcagatccaagagcttcaccaaggctgggcggggtggctcacgcctataatcccagcattttgggaggctgaggcggggggatcatgaggtcaggagttcaagaccagcctgaccaacatggtgaaaacctgtctttactaaaaatacaaaaattagccaggcatggtggcacgcacctgtaatgacagttacttgggaggctgaggcaggagaattgcttgaacccagcaggtggaggttgtagtgagctgagatcgcgccgttgaactccagcctgggcgacatagcgagacttcgtctcaaaaaaaaaaaaaaagagcttcaccactgtgcaaccatacaaggtagataagaaaaaggagttctcattttgggacagggagggcctttagcaggacgggacatgactgctgtacagtaatgatgggaaaatcccatgtaatataaggctatttctactagacagcatcacaggcagagctgaaaggcaggggatggctagggagaaaacagttgcaggcctgggacaggcacatggttgcccacatcacaccagctgcactacgggtcagtgagacaaaggcctagcagtcagtacccatgttggtgaattgttggcaagaacatacaggaggtcacaagttgcccagccagtgggggatgcccataaaaccctggcgggaacatttcccacactgcatacaccctggaggcaggtgagtggcaacaggttctggtgctagacgttagcggggacttggccaagtctgtttatctgaaagcgtcacccatggatggagcaattccacctcttgcgtctatcctaggaatgtcctcagctgctctcccactgttgtaaagaaatacctgggactgggtcatttattaaaaaaagaggtttaattggctctcggttctgcaaggtgcacaggaagcatgatcctggcatttgctcagcttctggggaggcctcaggaaacttacaatcatggcagaaggaaaagcaggagccagcacttcacacggctggagcaggaggaagagagagatgggggaggtgccacacacttaaaaccagatctcgtgagaactctatcactgtacagcaccgggggggatggtgttaaactttcatgagaattctgcccccatgatccaatcgcctcccaccaggtcctgcctccaacactgggaattaaattcaacgtgagatttggtggggacacagatccaagccaaatcagcccatgtgcagagcatgtgctagggatggtcgcttgatgggacgaagacaccagccacagctgagaggcagagcagcgggaaagctgggcagtggtgaaccagtggggacatggctctggtggagacagacctcatggccaatcagggagaacggagcaatgggaccctagcgtgttaaccccacagcatacatgtgtctgctcacatgtgtgtgcaagcaggttaagaacactctggcgccacaggcagcccttggctgaggctttttttccttttttttttgagactcagagtcttgccttgtcacccaggctggagtgcagtggtgctatcatagctcactgcagcctcaaactcctgggctcgagcaatccttctgcctcagcctcctgagtagctgggactacagatgcatgtcaccatgctcggctaattttattttattattatttattttattttactttacttttttgaaacggagtctcgcgctgtcacccaggctggagtgaagtggcacaatctcggttcacggcgccctccggctcctgggttcaagtgatcctcctgcctcagcctcctgagtagctgggattacaggcctgcactaccatgcctggctaatttttgtatttttagtagagaccgggtttcaccgtgttggccaggctggtcttgaattcctgacctcaaatgatctgcccgcctcagcctcccaaagtgcagggattacagccatgagccactgcaccctaccttattttattatattattagtattatattgagacagagtctccctctgttgctgtgttgcggaagtgcagtgacatgatcataattcactgcagccttgatcttctaggctcaagccatcctcctacctcagcctcccaagtagttgggaccacaggcatatgccactgcacctggctaattgtttttatttgctttttgtagacagggacttgctgtgtttcacaggctggacttaaactcctggcctcaaacaatcctcctgctttagcctcccaaagtgctgggatgacagacatgagccctgaagggatggggctttggcccgttaaatgtcactggaaatgtttccctccagaatgtgctcctgggtgacctgagcgatggtattaacaactatgggtcccaccagcctccagagctgccagtcgtggctacaggagactcagccttaggctggggcacagagaggctgaatagagggtgaatgaacaggcagcgtatgggagggaccagcgtttcttggtattatacaaaagctagtggaggtggtgctggttggtgtggggtgggcgactggcacggtcagatgcctgatgcctgttggcctcctcagaaggggaggctggcagtagtgggttctgggacatgcaggagggtggcctggatttgccctgcagcactgaggtctgcctgttccccactgggtcctccatttgaggccctgtcagcatggccctcgtcccccttgcttcttttccccatgggcctctgcaaggttactgcccaccctccaccccacctacctgcctgtggtgggcactgagagccagggaagcagatcctcactgccaggcagcaggccatgtgcgcatccatcagggtgccagaccttgtccccacgcagccctggctggggtcactgctgctgctgctctctgcctgtggctctggcccatctttgcccaggcgttctgtctgaatggttttcttgtcgtgccttttttagacaccgcatggagtgaggtttggggcttgcctcaactggagtctcattcttcttagagagggagtttagcccgtttccatttggccttaggacagaaggccctgttggtttctctgagaagccaggggaggagccctaggctggagaggggattctagagcggggtggctctcagaagcagaaggtgggcagagaggacggtgcacgctgggagagttctcgaaagcatcagcagatgggcccagagtgcctggaaagcttccgtccttcacagacagcgccatgctctaagaataacccatgccaagtccaggctttcttcctgttttgcagaattaccaggttgttaggctaggggaacgtatgctgggattctgggaagaattccacccgcactggtattcttagaggacgggaagcccttggctgcggtgtgaagagggctctctctttccattcatatctcatagatcctctggccaggcttgggggtgttgagggactccaggagtgtggggggaacttcctccctggaagaggcctgtgctctgtccctgctgaggctggtggcatttgcagtcacatggtgagctcacagtgactgtccccctcttacctccctggcagggttggcaaagaccacaccaaagtcccaagtgattagttccccggcctccctgcacagaggctgtgcatgtcccctgggcattcactctagctgtctgggctgcagggaggcagggtgcctggcccaactggagatggcactctactgggggtggttaagtgttgaccatcacaaaggcgacctcttttgtcacatctgtgtgagaggagctggactttctcagatatggatgagcctcacgacgcacatcctttcgtcccttgcttgtctaccaagtccctatgtgctccaggaggcagtggtacaggccagccgctccgtatgaccagagaaccagtgcctcacactccagcgcatttccttcccagggtgcaccaggactcttgtaaagagggcattctcgtgtaagcagttgctttttttttttttttttttaatttttatttttttgagatggagtttccctcttgtctcttaggctggagtgcaatggcacgatctcggttcactgcaacctccacctcgtgggttcaagtgattctcctgcctcagcctcctcagtagctaggattataggcacgcaccaccacacctggctaatttgtttgtttgtttgtttgtttgttttttgagatggagtcttgctctgttgcccaggctggaggacagtggtacgatcttggctcactacaacctctgcctcctgggttcaagcaagtcttctgtctcagcctcccaagtagctgggactacaggcgcccgccaccacgcccggctaatttttgtatttttagtagagacagggtttcaccatattggccaggctggtctcgaactcttgacctcgtgatccacccaccttggcctcccaaagtgctggaattacaggcgtgataatttttgtatttttagtaaagatggggtttcaccatgttggccaggctggcctcaaactcctgacctcaggtgatccacccgccttggcttcccaaagtgttgggattacaggcgtgagccacctcgcccaaccagcagttgctgtaaaattttttaaaaggatgtcacttatactacccagtcattaagacttcctgaggtggaaagatcacttcagcccatgagtttgagaatagcctgggcaacataatgagaccccacctctccaaaaaaatttaaaaattagggccaggcgtggtggctcatgtctgtaataccagcactttgggaggccaaggtgggtgggtcacaaggtcaggagatcgagaccatcctggccaacatggtgaaaccccatctctactaaaaatacaaaaattagctgggtgtgatggcacgcacctctagtcccagctatttgagaggctgaggcaggagaatcgcttgaaccagggaggaggaggctgcagtgagctgagatcgcgccgctgcactccagcctaggtgacagatcgagactctgtctcaaaaaaaaaaaattagccgggtgtggtggtatgcagctgtaatcttagctacttgggaggctgaggtgggaggatggcttgagcccaggagttcgaggctgcagtgagctatgatcacacgactgcacctgggcgacagagtggaggtgatgtgcttcctcaaatagccatgagaacaacgcttcttttcttgtcctggctcaggaacctcaccaccatgccacgttgccctgctgcgctgtgctggtgtcgtaggtcggtggcaggacatttgcccacctcacaggctctgctttcagtcttgaagtatggctcctctcgactgctgcccacacggcctcctgttgtcagcctgggctacatatctgggctcttccatccctgtgggcctggtgaggcctggccatgtgcctgtgtcatgccagttgctttcaagatgatgtttctagtaggaccacatgtgaacacagtgaccaccatggccaggaggaagctggctgcccatcaccagcttgcccagggacctcttgcaccctggcggggatcagcagatcctgctatgagagagcagaaggcagcatgctgacttccaggagtgtccacagcgtggctgggcagagcagagctacaaatgaacagatccagtgccgaggccatcctgactctctcaggggctgccaggccgtgggtgcagggtccagcaggcccacttgatcccagcatcccacgtgtgcctgctcggggtggccagctcactgcttcttcacctctagcccaaccagcaggtgccccaccatgagcccctccaggctcaccttgcccatccctgccatgtgacctgggactcttgagatgagatcacagctgcagagcacacagcacagggaggagctcatcagcatcttcccacctgtggtgccctggcccagcctccttccggttggggttggacccgccctggcagccaggttttgcgtcacctgccccacccgccctgtaacctacttgcccaactgctatcccggtggccgtgaggccagttgacagaatggagaggggtaagcattttccgcctggagaggatgggcgtgtggccatctgactgcttctgcaagcctggtggttgtgtgcaggctgccctggtggtcttagccccttggggcaggcggggtcctgtgcaggatgcagagactgggcgtggcttcctgcagatgttcagatgcttctgggctgtggcctctgagacccagggcaaggctgctgactggaccccagaccctcctgcctgcctcttcctccagctgctctttgtggtctggttctggccgcctgggcctcagggccaaccctgcatggctttgaccactctggccttcttggactgccaaggacatgctgagagttggttgggcttggcccaagtgctgagcccagggcaggggtggggacaggcagggcggagcctcacctggaaagccaggcacgattctccctgggacaccaaccctcctgtagagttggccaattcgggcaaccttgagggcgagctctgtgtggcacaagagatgccctgaggagcccagcctcacctggtgtgatgggacctgtggaagttgtgggaagtggtcctggccacccgtgtgcccacatgccctgcgcccagatcaagatatggtgaccaaaaggacaaggactatatccatggctccctcccagagcctggcaagtcagcaggcatgagagggtgttggaatgctgtggtgggcctgtgtggggaccttgtaggacctagggaacctgcagggcttggcttagggagcacacaggggcccaggcaaaggcaaggtcacaggtcgggggaggtgaagctggcagggggagggggagacctgctggctagagctgggttgggggccggtgggcagtgggcctggctcgagcagggggcgagggattggagagaaaggcagttcctgatggtcccctccccaggggctggctttcctctggtccttccctcccaatgaccgcgtcttcgtcgaggccacagcccttggctctgcgcccacacctccagtgccaggctgtccggagatctgtttatggccttcccttggaccatggagccctccctgccactggtgcctggagggctggtctgctgcccctgcaccctggccagctaggatggtggggtcctgcagctgaactgggggtgcctttctgcctgtctgtcctacgtgtatcagtggccagaactgccctcatccatggccttgccagcagctgggcgtgcagcccagggagggctgaggtcggctgaagttgattgagaccaacggccttctctaacaccccagaggagcatgtccctggtgagcaggccttgggcagccctgggctccaggccagtgggattccagtagagaccagctggcagggcttctccagtgactgcagccaggggttctcatgtgcaggaaagaccagctcctccagagtaaagggacttgtgtcttctggccacatggtgagtgctgggcccaccccatcagtggcaccttgggtgcactcccaaagcccagcgtgttccccatcttcctgcactgcattcgggatggttctgcatcatcagctgcacctgattgctcttaaacccacagctgagctttaatgtgcagtcactgaagctttcatttctaaaatagcttcctaagagttcttttggccaggcatggtggctcatgcctgtaatcctaacactttgggaggccgaggtgggtggatcacctgaggtcaggagttggagaccagcctgaccaacatggagaaaccccgtctccactaaaaatacaaaattagctgggcgtggtggcgcatgcctgtaatcccagctactcgggaggctgaggcaggagaattgcttgaactcggggggcggaggttgcggtgagccgagattatgccagccagcctgggcaacaggagcaaaaacaaaacaacaacaacaaaaaaaaaccgagttccttttgctgctttgtaaacccagtttgctcttcatcacttcctttgccctgcagatgtttctgagctgtctgttttctttctgccatcagagcatggttggttgatgatgcatgtacggttatctttctgctggttcttgctcatggtgcttctttcattatgtggttctttctgactatgtactgcttctggtctttgaaaaatgattttgagacttctttgaagtataggatgaaggtatctttctccagagagaacttcaggcacaggggcactacgagtgctggaaccccttaaaactgtgcttggcttgtgggtccttgtacccccagtgtggacctggacggctggctgtgccacagcttctcagaaacttcccttcacttatgtgcaatgtccccataacccctgggggtggctgcggctgtagttcatctctccctaagcatcgctctttggagtcccagcctaacttagaggagagtcttctgttaggttcttcatcctgtgggggtgactggaccttgtcttctgtctccttcgcccccgaggccaccagagtatgagccccagtgtgttcagtgggcaaacgctctcaggcaggattggccactgtgttctgctgtcctctgtgggccacgctctccgaactgttggccaaatgctgcatgagctcatcagctcctggcaatttttaagatgttttcatatttcatccagcatcttgagttgtttttaccaaaaggattgcccctagtagcctgcccaccctcggatgatggccccctgtgggcgcttccagggcacccggcaaggggacccaacccacttccagccccacagtctgcttcccacagggcccccttgcaacaacacaccctttagcttcccatcctatgcagagtggtggccagcagaccatctcaaatggctgcccatccccctgacccagtgcgtctgcacgtggcgcttattgctatcccaatacttcaactgcacagccaccagctcctcactggagcagatggtccccaatggccatccctaatgcccgtgcctatggaggcacatacactgagccctcttcacctccgtccccactcattagacttttctcagaggaatctttttgggtctcttcagtatttgaacagcttcttggctgtcccatgtcccagctgtgagcactggctctgccctggagccgtgtcactaaatcattgcacatgtgcacatttcagggaacttgggtgtcacccttgggtggcctcggaatctaatctccgttctgcactcgtttgcattgtggaaaactgcctgctctgggccccagaggtccctgggtggggacgaggtgtatgctaagtgtgcagtcacccagcgtgtccccggcacgtgtccatgccagctgctgtgggtgtgtggggccttcgggtcctgtgggatggcgagtgtgtgtgctgagcaggacctgtagggcctgcatcccaggtgagtgggccatgctgttggaggcggaggcagggctgcccccactggtggcgtgtggggtgggtttggtgctgttgcaggggaggagatgtgcatgtgggggacagtcttgaaggaagaatgtatacagtggtctatttccaagacaaagtgtcttaaattggcttagctcagcaaactacagaagaaacaggatatactaggccaccctgcttggatagctgatgtgtgcttgtcggcctccactttccccgcacttagttgccttcacccgaaccaaagaagttcagtctaagctgaaagtttactagcctgcaaaatagctcattttgtctgttcttatcagcctgcctgctacttaggtcgtaagttaaatacttaaaaagtccctgagctaactaggactgcaatgcattgtgggctgcaacaaaatacagcaagacaagcccccaaaaaaacacctgaagcccctacccaacaattaataggcgacgtccgggaaaattgtgaccccacagtactcggcctatgaggaactgggggagggacctgcgtactaggggataaattgcttgtcgaaactgtgctgggtgtgcctgtctgacacctgatcttgcaagactgtcattaaaagtctcactttcgctgttctctgggtctgagttcattctttagatttggatgggtaagtttgtttctcacagtgtggctcctgccctcacttctgctgccccccggggaccccctcggcaccccagctcggtgtgtccaggccttaagactaccatggtgctgatgggatgcttctgttcagggctggtgttgcaggtggtggagagacagtctggccagtgccaatgagtgcatgggtttgggagttgtttgtgtggcaccggccaagagtgtggtgtccagttcccccacacccagcaagtagtacagacaccacagaggtggttctctctgttctggcctgttgcaggttcggagggcagccctgagtgtctgccatccgctcaactcagtgttttccttttcccgcagacctcgcgacctgtgtcagcagagccgccctgcaccaccatgtgcatcatcttctttaagtttgatcctcgccctgtttccaaaaacgcgtacaggtaaccccctcgctctgcatctgctgcgccctgcagggtcctgggtgcccagccagttctcatgccacccaagctgctgtgtgcaggaaggtgtgtgggccaggacggggctgcacaggcctggcactgccctccaggacagggtcactcagtgtgggatgctgtcagaatgcctctcggggcggggactccagtcaatgtacaaagacgtgaagactcagccacagaaggcagccacaggtaggacagaggagtgacatgggtccaggtgggctgcagttctatgggctttgaggagggtcgggcggcagaactgggacaacggcgtcagtgagtgagagccagcttgggctggcgggtcacagctgctggtgagaagtcaaagtggcggccaggctaggggtctgtgggtgggtcctgagctgaggaaaaagaacctggggaagaggggacgctgaggaccagccagaggagtcaggaaatcgaggccagaagccacccctgaccctggactcaggacggccacacctccattccccaggacaccccagcatttatccacacagagaacgaggcagagatataacccacatctaaaatgaaacgtgtaaccactctctaatgcaactgctcgggaagttttcatcattttaaaatctgtaccagaaatgatttgaaccatttcaagagggtctcagatttgagtcactgcaaagttgcatagacaccatgctgcttgacttcaaggctgagtgaagtcatttcaggccaaggaatcaggaaggaagggtgtctggtgttttccctttttgcagttgggtgagtggcaggtcccagcagcagacagcatgctgcagggaaggtggaagaaatgttaggaaagaactattgactgctacagggactggagtagtgttgggctggctagtgagtgaacagaactctaaagaatgtaggggctggccgagcacggtggctcacgcctgtaatcccagcactttgggaggccaaggtgggcggatcacaaggtcaggagatccagaccatcctggataacacatctctactaaaaacacacaaaaaaattagctgggcatgggggtgggcgcctgtagtcccagccacttgggaggctgagacaagagaatggcgtgaacctgggaggcagagcttgcagtgagccgagattgcgccactgcactccagcatgggcaacagagcgagactgcatctcaaaaaaaagatgaaggtaaaataaggtcatgtgggtaggccctaatcaatgtgatgggtgactcagatacgcacaggggaagctggtgtgtatacagagatagaagcagtcgtctgcataccgagaagaccctcaaaaggagccagccctgctgacgccttgatcttggatctccagcatccaatgctgcgagacaatagtgtctgttgttgcagccgcctggtctgtggtgcttagttacggcagccccaggaaactagcacgctgaggagagccagccagctctgtatgcgtttcagggctgcctcctgcaggctgctgaagagactcaacccaccccgagtgctcccatctctggaaaggaagcttgatggctggcctgcgggtgctggtcagtgccacccagccccttgggtggagaggaggagggttgacatgggcccctcttgctttcactcagaacccgtgtgttgctgccaggacctgtcctgcgggtcctgccattccagttggcctcgggatttctctggactattttccgaagccctaagccaaagacgaaatgtgccacctctgggtgactgagcaaatgtgcgctgtgttttcctgacttcatgggagggtgtgagacacttctggtggctgcttctgctctgcctgtggggtgtccagccaggggaagggcacgctgcaggctgggagcacagacacttctatggagcccctgacagcacctctgcagcactttgggaggcctcgtacaggtacccagctaggctgggctggactcctcacctgtggactggagtaaaaagtagggtgctttaggccactatgttttttttttttattattattattattattttagagacaggatcttgctctgttgcccaggctggagtacagtggtatgatcatagcttactgcagcctcaaactcgccggctcaagcgatcctcccacttcagcatgcctaagtaactgggactacaacaccatgcccggctaatttttttttttttggtagagacaagttctcactatgttgtccagggtggtctcgaactcctgggcccaagtgatcctcctgcctcagcctcccaaaatgctgggattacatgcgtgagccaccatgcccggcctcggccactgtatttggtaatttgatacccatcacggaaaaccaagaccctgcagcaagataacacaatcacttcatgatgtcaccctatctctttcaaaactgcctgtttacagccgggtgcggtggctcacgcctgtaatcccagcactttgggaggctgaggtgggtggatcacttgaggtcaggagttcgagaccagcctggccaacatggtgaaaccccatctctactaaaaatacaaaaattagcctggcatggtggcgcacacctgtaatcccagctattagggaggctaaggcaggagaattgcttgagcctgggaggcagaggttacagggaactgagatagcgccactgcactccagcctggatgacagagtgagactccatcttaaaaaaaagaaaaaacgaaaaaaaacctgcctgtttacagccccacgtgatgccacttgctggcttcagcctagagtggctgcaggacaagctgttactccatgggacagcttccatggggtcaccactgagggtttgatcactggatctcaggccagagtacctcctatctgtcaccaaactgtcccccagacagtgcacacactcaccccccggcagaacacactcaccccccgagatgatgcacataccccccggacagtacacgcactcaccctgcctagcagcgtgggtgtcaggtggtgatggataattagtggtttcagttattggaacaaaataaagccgaggtgacttgccatcctcagggacctcaccgtggtgggtgcatccctgtctctctggacgtggggcgcagataggcttctacccatgtgcagccccaccagtgatgactgagagagctacttcctcctccctttggggcttgatctgggtgctcagcatgctggcttgtccctgaattatgtattcaatgaaatccctggcaaaccaccagcaattcagctaaacatgactgctggaacaaaaataacctggcaattaatgttcctgagttattaggcaaacatatataattgctccttgtttaaaaacagacagctgaacatcttaggacaaaagtccatgctcagtcagcttttcttcctacttttctcccctttattttccctttgtaagagcattatgtcagaatcagcacccgaagccaacagccccagcctggtttggggctggactgggatgaggtgtccctggctcccccgacccctgttcacctgcagggctgtgggacgtggaagcagaggaggaaggtatttaagagagaatgctgagcagaaccacatggagcttgaccccacccatagggtggaggagctgtcatcccagaccctggcacatccccaccatagcactcagggactgcggtgttcccccttctcctgcccgctggccaggacacaaccaatgggcacctacaggactggcccatccaggtctggggcaagtgcactgccttctactagcactgtccagcccagggaaggtgggctctcctgccatccctgctgcagaggttggggggcacttctgcccagaagggacatggagacttgggctgggtctgggttgaaacatggcagttagaggtacaaaggctgaggctcatcagggacagagaccacctccccctaccccaggcagcacatccctgagacctggtgcagccctggggccagctgggtgtcagaccaggctgaatggggcaccctggaggtggtaaggcttccatagcagaccccaagggctctagggcatggcacagtccctggcaatgaccaaaagcatttccccagttctgctggcaagaagcttcaggggcaggcactgagtggggggcacacatgtgcacacaggtgtgaatgcctccaagggcatgaatggtgggtgctagcaccatgtacttttttgtttgaaatggagtttcgttctgtcgcccaggctagagtgcagtggcacgatctcagctccctgcaacctccgcctcccgggttcaagcaattctctgcctcaacctctcgagcagctgggattacaggcgcccgccaccacacccggctaattttttttttttttttttgagacggagtcttgctctgtcactcaggctggagtacagtagcatgatctcggctcactgcaaactctgcctcccgggttcacaccattgtcctgcctcagcctcccgagtagctgggactacaggcgcccgccaccacacctggctaattttttgtatttttagtagagacggggttttaccgtgttagccaggatggtctcgatctcttgacctcgtgatcctcccaccttggcctctcaaagtgctgggattacaggcgtgagccaccgggcccggcctaatttttgtatttttaatagagatggggtttcaccatcttggccaggctggtcttgaactcctgacctcatgatccacccacctcggcctcgcaaaatgctgggattacaggcatgagccaccgtacccagctgtgagcaccactttcactcccaattttatgaatgtctgttatttcacatttaatcaggagcaaatgttgttttatgaaattgatgtgcaatgatcaatatggaaattatttttaaacacttgtcgggctctcaccactgcaacttggtttcagactcagattgtgatggcaggacagctgagctctgctccttggagctgcctctccggcacaagtgctcagggggtcttcagccatcactttttttttttttttagagacagggcttctctgttccccaggttggagtgcaatggtgcagtcacagttcactgcagcctcaaactcctgggctcaaatgatcctgctgcctcagcctccccagtagttgggaatacaggcatgcaccaccacacctgactaatttttgtattttttttttgtagatatggggtcttactttcttgcccaagctggtctcaaaactcctagcctcaagtgatcctcccactttggcctcccaaactgctgggattacaggtgtcatccactgtgcctggcccagccatcgcttcttagaccctcaggtctaatggacattgcaggaactgaccccttccactcagtcactgctgtgtccttatttgttttcttctaatgtccaagctgggacttgaaagtcagttttctttcctcaagaccagggctcttaaagtttagatgtctctcctaattccaaaagaaatatttgtttgattaggctggatgtggtggctcacacctgtaatcctccgcctcggaggccgaggcgggtagatcatttgaggtcaggagttcaagaccagcttggccaacatggtgaaaccccatctctactaaaaatacaaaaaattagctgggtgtggtggcgggtgcctgtaatcccagctactcaggaggctgaggcgggagaatagcttgaacccgggaggcgggagttgcagtgagccgatgtcacgccactgcactctagcctgggtgacacagagagactccatctcaaaaaataaaaataaataaaaatggaaatatttgtttgattcataatgcaaaaaaactagtaaaacagtgaagttcccatccactcccaaccaacccgagaaattaactccaaaacacacagaatggagcagccctcagaggcccacatgctgtgccattcaatctgtatccttgagctcacgcttccaagagcccacgggtttgttgtgggtgttcccagggctggggacagatggacagaaggaggaacagccccccaccctccagcctgggctcccggcatggagcccaggctccatggtgcccctaagggcctggcagacccgtctcccgccattgaatggtgtggatgtgtgtccctgcctagcatcctcctgtttcccgtgcggtcccagctgcaggctcccgagagctcacctggagccacggtgctccttcctccagtgtgggtgcagcaggactgccggcttcctgccctctctgagactggcccttgttgccactgaggccagttttgtgtgtgaaaagagaaaaagacttggctcgctcgtttccatctgaagccatcagtgatgctttcctcttgcaggctcatcttggcagccaacagggatgaattctacagccgaccctccaagttagctgacttctgggggaacaacaacgagatcctcagtggtgagtcttcctgcgtgctcagcggtggctgcgccttgttgcttccctagcccctgcgtggcccgagtgaccctaactgagtggtgctgcttccaagtgtgatggcggggtgtagaggtggaactgatggggctcgtggtcggggccagccccagcaccgggcattgccagagctgcccacccagcactgtctgcgtggcttcctgtgccatgcgtctgcatgggggccccatcatgtgaaagcatcagttggttttatatggatccctcctttttgctgagggcatgtgggtggatttgtgtgatgtacagatccacactcagtcactttgtgaagcaacccagtcatatgagtgtgtgcatgcgtgtgtatgcgtgcgtgtgtgtgcctgtgtttgtgtttctgtttgtatatgagcacccttgcttcagggatggtggggctgagtttgggaagctggtggtgctgaagccccgtcacctgcaccatgcctgtgttgcattaggtgtacttatagggcagaagtaggggtgagaaccaggtcctccccaccaaagataccagcctcattgaagtcctgttggacaggaaccagttcctgcccatggggtggtgggagtctacctggaaggtgcgcatagatggctggtgaggccacgggttactctgcctgcgtaccaggcgccaagtgggcccgaggcatcctggcatgctccagggtgcccactcaggccagatgtgtgacctcgtgggcccatggaggctgtgtgtgccctgtgctgcctcccaggccgggagggcaggtgttgggattataggtgtgaacccaacacttaaggaggctgaggcaggaggattacttgagcccaggagttcaagaccagtctgggcaacatggtaaaaccctgtctctacaaaaaaaaatacaaaaattagccaggcgtggtggcatgtgcctgtggccccagctactcaggaggctgaggctagagaattgcctgagcccggaaagcagaggtttcagtgagctgagattgtgccactgcactccagcatgggtgacagagcgagaccctgtctcattcaatcagtcaatcaatcaatcaaataaaagctcagctgtggggttttgtgaggactcctgtgtaggcctgtggcctggcagtagtgtgagaatgctgctgaggctgggtggtcccggcaccgtgtgggaggaggacgggtgcatggagactgaggcagggtggtcctaggcctgctggtataggaggatgcagtgggtgcagggctggtcaggacgggtgggtgaaggcacaagactgatgtccttggaaggtggaaggttttcatagatgaagatgtggcggctcagagggttaccctcttctggttccttgactattgtgccctcctgggctccatcccaccctggcacccaggtctgtcagctgcctctgaactagtgccaaccccagcagctccagtcttgtggaattgttcacccctgtggtgttttgatggtggcagctggtgcatggatgtacacgggcttctgccaagtgtcggggtgaccatatcactaaggcccacatcctctcactctctggcgtcaccggattgtatgcaaaagtttaggacagtggttctccaggtgtggtccttgggcctgtagcaccagctttacttgagaacttgttagaaatgaaatcaccctgggccggtggctcacacctgtaatctcagcactttgggagtccaaggcaggaggatcccttgaggccaggagcttgagaccggcctgggcaacgtagtgagtccctgtctttacaaaaaaaaaaaaaaaaattagccagctgtggtggcatatgcctgttgtcccagttactcaggaggctgaggtgggaggatcgcctgagcctggaaggtagaagctgcagtgaaccgagactgagccactgcagttagcctaggcaacagagtgagaccctgtctgaaaaaaaagaaaagaaatgcaaatcaaaatcattaaattcataaaaatttggccatcacttctttttttttttttttttttttgagatggaattttgctcttgttgcccaggctggagtgcaatggtgccatctcagctcaccgcaacctccatctcccgggttcaagctgttctcctgcttcagccttcctaatagctgggattacaggcatgcaccaccacaccaggctaattttgtatttttagtagagatggggtttctccatgttggtcaggctggccttgaactcccgacctcaggtgatccgcccgccttgtcctcccaaagtgctgggattagaagcatgagccattgcacccagcggccattactttttcaagtagtttttctgtcttctctctcactctctccttctctccagttacacacatatattagttcacttgcccttgtcccacacctctgcgatgctctctgcgtacttttctcggtgcccctagatcttgaggttttccagcctggtgtctgggagccagccctactccctgccctgtgtgagcactggtggttcttgccccagtgtcatatagtctcctccctgagatgctgatcagacattctctgtgtagctccttcctctctggacttttgtgccactgtcttagttcgtttgtgttgctctaaaggaaaaagctgagtctgggtaatttttttctttttttttgagatagggtctcactctgttgcccaggctggagtgcagtggcacaatcctgtctcactgcagcctctaactcctggcctcaagtgatcctcccacctcagcctccctagtagctgggactacaagtgcacatcaccatgcccagctaatttttaaaaataatttgtagcgacaaagccttgctgtgttgcacaagctggtttcaaagtcctggcctgaagtgaccctcctttcttggcctccgaaagtgctgggattacagataataagccatggtgcccagccaaggctgggtaattttttttttttttttttttttgagacagagtcttgctctgtcgcttaggctggagtgcaatggtgcgaccttggctcactgcaacctccacctcccaggttcaagtgattctcctgcctcagcctcctgagtagctgggattacaggcacctgccaccacaccctgctaatttttgtatttttgtatttttttattattattctttaagttctagggtacatgtgcagaacgtgcaggtttgttacataggtatacatacatgtgccatgttggtttgctgcacccatcaactcatcatttacattgggtatttctcctaacgctatccttcccccagcccaatttttgtatttttagtagagatggggtttcaccaggttggctgggctggtctcaaactcctgacctcaagtgatccacaaggctgggtaatttataaagaaaagaggtttatttggcttagagttctacaggggacctgaagcacagtgtcagcatctgcttctgatgcaggcctcaggaagcttctactgatggtggaaggggaaggggaggtggtatgtgcagatcacacacggagggaggaagccagagagagggaggaggcgccacgctcttttaaacaaccagttctcaaaggaactaatagagctagaactcatcactgtgaggacaacaccaagccgttcatgaaggatctgccattaggtagatctgtctcccattagaccccacctccaacactggggatcagttttttggtttgtttgttttttttttttttttttgagacagagtttcactcttgttgcccaggctggagtgcaatggcacgatctcggctcaccacaagctccgcctccaaggttcaagcaattctcctgcctcagcctcctgagtagctgggattacaggcgcctgccaccatgcccagctaattttttgtgtttttagtagagacggggtttcaccatgttggtcaggctggtctcgaactcttgacctcaggcaatccacccgcctcagcctcccaaaatgctgagattagaggcgtgagccacctcacccagcccggggatcagattttaacatgaggtctgggggacaaacatccaaactatggcagccatgaactctggttgtcttagtttccccaaacactaagcccctcttctcagctcagggagtctgctgaattcggcctggtccccccactccctgggctgggtcctggagcctctctaatcatgggctcactttgtttcctgtctgtcatatccttttttgtaaaacccatttgatatggtttggctgtgtctccacccaaatctcatcttgaattatagttccccaaatccccacatgtcctgggagagacccagtgggaggtaattgaatcatggggcattacccccatgctgctattctcatgatagtgagttctcatgagatctgatagtgttttgtttttttttttttgagactgagtttcgctcttgttacccaggctggagtgcaatggtgcgatctcggctcactgcaacctccacctcccaggttcaagcaattctcctgcctcagcctcctgagtagctggaattacagccgcttgccaccacgcccagctaatttttgtatttttagtagagatggggtttcaccatgttggccaggctggtctcgaactcctgacctcaggtgatccgcctgcctcggccttccgaagtgctgacattacaggcatgagctgccgctcccagccaagatctgatggttttataaggggcttttcctgctttgcttggaacttctccttcctgccaccatgtgaagaaggacatgtttgcttccccttctgccatgattgtaagtttcctgaggcctccccagccatgctgaactatgagtcacatatctttcctttataaattacccagtctcgggtatgtccttgtagcagcatgagaatggactaataaatacaccattgtttcttgagttttatttatttatttattttttggttgttttatgcaggagggtaaatctggtccttgttgcttgggcaatttggaagttttgttcttgttttaattattgatttgtaagagttatttacccattctggatatgagtcctttgtgcctactcatttccttaatgatagcttatggtgagcagaattttttttttttcttttgagtgggtggagtcttactctgttgccaggctggagtacagtggtgcgatctcagctcactgcaacctccgcctcccaggttcaagtgattcttctgcctcagcctcctgagtagctgggactacaagcatgcaccaccatgcccagctaatttttgtatttttagtagagatggggtttcaccatgttggccaggatgggctcaatctcttgacctcttgatctgcctgccttggcctcccaaagtggtaggattacaggcgtgagccactgcgcccggccagaatatttcattttaacaaagtacagtttatcttatcttttatgagttgttctttttgtgccttatccaaaaagtctttgcctacccagaggaaaatatataacaatattttcctccatttgcttctagaagcctaatttttgtttttatgtttggtctatgatttatctcaaggttttgtacatggtgtgaggtaggggttgagatttactgcctccaacccccaaatctctctagttgttccagcatcatttattaaatggattatcttttgcctagttcattactatggcaacttggttgtacatcagttgaacatatatgtgtgggtctattcctgactctgttgtatcccattgatctatgtatctgtcttgatgccaacaccatgcagtctatgagtgctgctgctttttagtaagtcttgaaatcaggctgagcactgtggctcacacctgtaatcccagcactttgggagaccgaggtgggcagatcacctgaggttgggagttcaagaccagcctgaccaacatggagaaaccccgtctctactaaaaatacaaaattagctgggtgtggtggtccatgcctgtaatcccagctactcgggaggctgaggcaggagaatcacttgaacccgggaggcggaggttgcggtgagctgagatcacgccattgcactccagcctgggtaacaagagcgaaactctgtctcaaaaaaaaaaaaaaaaagaaaaaagaaatcaggcaatgtgggtctgccttctttttcgggactattttggccatcccagttcctttgcatatgcatagatatttcagccagtctgttaattgctataaaacgaaaagccccctgggattttgactgggcaggttttgaatctatgggtcatgtggggagaagtgtcaccttaacaatactgagttgtctaagaagtacccagtgaaacaaataataacaagaagaaacactgttgaggctgggcacggtggctcacgcctgtaattccagcactttggaaggccgaggcgggccgatcatgagatcaggagaccgagaccatcttggctaacacggtgaaaccctgtctctactaaaaaaatatgaaaaaattagctaggtgtggtggtgggcacctgtagtcccagctacttgggaggctgaggcaggagaatggcctgaacccgggaggcggagcttgcagtgaactgagatcacaccactgcactccagcctaggcgacagagcaagactctaaaaaacaaaaacaaacaaaaaaacactattgaatctttcagtgaatatgcatgtctctccttaaatcaggtcagctcaacttgagaccctcaacagtgccctggagttttcagtctttgtcactcatttttcattaaatattttcctggtggtttttttttttttttttttttttgagacggagtcttggtctgttgcccaggctagagtgcaatggcgccatctctgctcattgcaacctccacctcccgggttccagcaattctcctgtctcagcctcccgagtagctggaactacaggtgcctgccaccatgcccagctaatttttgtatttttagtagagatggggtttcatcatattggccaggctggtctcgaactcctgacctcgtgatccgcccgccttggcctcccaaagtgctgggattacaggcgtgagccactgcacccggcttttttttttttttttaatcacactaaggattttaaaaatgctgttataaatggtatatttaaatgctcactttccagttcttgctagcatttacttattagttctaatacatcggttttggtattccttttgggttttcttcatatatgatcctgctggttgcaaatacagttttgttgggttttttttttttttttgagacagagtttcgctgagagtgcaatggtgtgatctcggctcactgcaacctccacctcccgggttcaagcaattcccctgcctcagccccccgagtagctgggattataggctgcctcagcctcctaagtagttgggattacaggcatgcaccaccacgcctggctaattttgtatctttaatagaaatggtgtttctccatgttggtcaggctggtcttgaactcccaacctcaggtgatctgcccgcctcggcctcccaaagggctgggattacaggtgtgagtcaccgcacggggccacaaatacagttttatttctttatttttgatctttacatcttttctttttctgttataattaattattgttataaaaataatatcttagggccaggcacggtggctcacacctgtaatcccagcactttgggacgccaaggcggacggatcacctgaggttgggaattcgagaccagcctggccaacatggagaaactccgtttctactaaaaatacaaaattagccaggtgtgatggcacatgcctgtaattccagctactcaggaggctgaggcaggagaatcgcttgaacccaggagggagaggttgcagtgagccgagagcacaccattgcactccagcctgggcaacaagagcgaaactctgtctcaaaaagtaataataacaataataaataaaataacatcctagccagtgcagtggctcactcctgtaatcccagcactttgggaggctgagtcgggaggatcgcttgagcccaggagttcgagacaagcctgggcaacacagcaaaactttgtctgtacaaaaaaatgcaaaaatcagccgagtgtgatggtacctgcctgtggtcccagctacttgggctgaggtgggaggatcgcttgagcctgggaggtggaggttgcagtgaactgtgtgattgccactgaactccagcttgggtgacagagtgagactctgtctcaaaaaaataaaaaatgaaataaaataataaaaataacatcttaatgacagccttttttgccccaatctttgggtaaaatgaccccctggtctaagaaggagccctcctgtggctttcagagccctccaaccttgtggcattagcagtggcccatgccctgcagatttggcgggggtgaaggtcctggttgtgtgctgggctcctagtgaagggcctgccctttgggcctggtgcatcctgctgggtgaggacagccagcgtccctgcaccccattcatgcgattggagcctagtgctgcccctcagccttgacgctggcccaagtggaaggatgtgttctgcagggcatctgttgggataggtgtggttggtgtcatagttgtcctgcaggacagggatctcacttgcacgacccatgaaccccaggggctgcctggccttgaagagttccagccacgattccatagctggggctgctgggccaagccgcatgtcgaacgtcctcgaggagcttgaggcaggagctgggccgagtatgcgtctcccagggctgggaaccaggtgggggactggaatgggtggcatcaatggtggtaacactgtcatctgccacagggctggacatggaggaaggcaaggaaggaggcacatggctgggcatcagcacacgtggcaagctggcagcactcaccaactacctgcagccgcagctggactggcaggcccgagggcgaggtaaggcgagtggggtggggccaaggtgagacagggtggggtggggcaggcctaggtgagacaaggtggggccaagggactacaggactggccaatgtatggtggagtggggcgggccaaggtaggaagtgccaaggtgcttgtgcttgggagtgggatggggcagggctgaggtaccgtggggcagggccaggttacagagtgggcggtgacaaagcgtggcagggcagggcccaggtaagggtggggacaagaagggggaagctgggccccgtggcaggtgggtggcttccgtgggcatatcactgccgccactgaggtgtgctgcaggggtatgcggcagagacaggaagagtgaggaggggagcatcccatttcccacaccctggccctctggcgtcgcagccaggagcccactcccacctgacccacgcagcactgtttactcctctcagggcgcactctccccttgtcctcatgcatggcactcctgactgctgtgtcactgtcccctgcctggaatgtttgtagagtagatgccttccccgagacgacagctctgtggacacacattgtccccactgaaaggtgttgtttacttcatgctggatttccataggaagacatagtggggaaattttttttttaataaaatgagcagttttcagtgccgacctgagtggcagccaggctaatgaggtgtggctgactcttgcggcagtcatgacaggccagggctccagtgggacccctcatcttcctgcatcctccccagggggccccatatcagtgttcctgggagaagagcacatgcctgcagctgtggacacagcatctgtcccctgcctacaggtgaacttgtcacccactttctgaccactgacgtggacagcttgtcctacctgaagaaggtctctatggagggccatctgtacaatggcttcaacctcatagcagccgacctgaggtgggtctgccagagggggatggcggctctgcccagcactgcctcgggggcaggcctcaggctcatcaggaagtggggttccactgggggctgtggcagcctctccagggacgttgctcctcgtgacttggcaaacattctgaggactgagcctgtcacagatgtaccaactcgggtatttgggggtgaagcccaaggcttcctgtgatggcatgagggctgccggatccctggagaaagctgaggctgtgaagaacagtcacatagagtggctctggccgggtgtcctccctcccacgggcaggctgtgcagagcagccctccgcagccctggcttggagtgactgggatgctgtgctcccagggaagctcctgttggagatgaggccgcaggaactgcggaggttttggtgttttgcccttccgtgaagtgagcattcctccctcctgccctcctccccctccaaagccccagaacttggccaatgctgttagtccggggccttctgccaggacaggcaaacgggaagtggtcggcacattgtggcgggccctgaagctgcctccttccacaagggcaggtccatgggcctctctcctggctcccgagctccaggcctgctgttcgttgagcatcccttgtgtgtggcatgcccagccctgccccacatgggtctgcacacttgctatggaggctgggagagttgcagtgtcccctaggtggaaggccgagggctggtgcggggcacttgctgtccggagccgttcttcctgcccatgccttcgtgactccaggtggcagagcccctgtgctctctgcatgcccccatgctcaggaaccacttttcccggtcagtagttccatgtgggtctgattagtctcaggagagttcctctgcggccgtggcaccagcaggacttggcactcagcagctgtgtggaggtggggtgccaagggtgccatgccttgagcagatacacgggctcctgtggttgggggttgggggtttgggctcctcagagcctgtgcaactctcccggctccaaaggctgcagagtgagggtcagcctcctggacctagcctgaggatacaggcagtggccaggagagcataccacaggtcaggcaaaagctggtgccagggccgaggctggagggcgggggcatcggaggtcagtgagcagccctgctggtaggtgcagatgaggaagccaaggcctggaagggagagaggcttgtcatggccacagctatccctgggtgaggcctgccctccgcctggcctgtggtatagtgctggcagcatgggtgtccagttctgtaggtccttacacagaaagcccagaggagatttttgcctgcaaacagtctctgaaattatgaaccaagtatcttaggaaagttgccaaagaccatggtgaggaagaacgggagtggaatgtgaacatagacgggggggcccttgaagcctaccaggggtggggaaggtgggtcccacctgggggcagcacttcggggaggaaggcaccatgcctggctctttctctgcatctgttccatcttgaaggcccagggctccatgcccagcatctggcctgggagggcatctcacaggccacaaagagatcctcttcactttgcaaaaaaggcactccaagttctagaagacttactgtggtattgaggattggaatattttcagctggggagcattttgaactattttctttttaaaaaatgatttatttattttgtagagatggggtcttgctatgttgcccagtctggtttcaaactcctggcctcaagcagtcctccctccttagtctccagattagctgggactataggcatgagtcactatgcccagctctactgtcccttaactattttaaagtgtacacttaacacttgagagtaggaaaatgtggtctttggcgctttctttggaagcctcgatcaccctggggccacactggggccacctgtccagaaaccctcatagatgagctgtggtaaggggcctgatggagaggttggtgatgtggggatggggctcagccctgcagttgtccccatgggcagcctctgtgtgtccatgccatggggcattcggcatggcaggagggcattttagatcctgtgcctcctgggctggtgggccccgaggtgagctgggaacatacccgtgatgctggacaagagctggggcctccatgaccccgcctgccaggcacctgaggggctgggtcctgcaagctcctgacctggccgcagcgggctactgcgcacatcgctagcctccagaaacagggctgtgagatcaccgggcagtgtcggggaggacgccctatggctgtagtctgacattctctccccttggcctgcagcacagcaaagggagacgtcatttgctactatgggaaccgaggggagcctgatcctatcgttttgacgccaggtgagcctgccctggcagcctgatggggtgggggactgtttctatgcagaggtcacccttgtgctttttagagaccaggcacttgtcatattactcttctgagatgactttgtggccatttaagtgccttatggtctgtgggcaccttgccctgcacctggacacttcagagagccctggctccctgctcaccccctccccatgggcttttcctgctgagcaaggtgcgcccctgttctgggcttcccaccgcagccctgcagcccagccggccacccccagcctcacttcctgtgccgtcccagtgtgccctgtgcctgttccttctcagaacctctggagccatcaccacctggggttcttgcctggtctgctccctgacgcacaagtacacaccccactcaagccccacacagatgcacgcctcctgcacccagtccccagtctgatccccggtccccatcctcagggcctcgagcccctctgcgccaggtcacactccacggctgggcccttcctgccctggctctgcaccactgcccaggctgtgcctcctgctacatgcccttcctttccccctcctcgggtgctgcgatttcctggaagcttcctctgccagtgccccaacctggagagaatgtgtcacattgcccccctctgcagccatgttctgggagggaggtctgcatcttgtcccaggtctggtgccaggacaaagcagcactcctgggaaatggcatttcccctgggtgcacaaaactgtagggaccatagcctaggttccggggactgctggctcactcactcccacactcgctgcccacagacactcctcgctggtggcatcgtggaactctgtgccttaaacgcccgctctggtccctctactcaagctgctggctcacacagggtgttccggcgcctggggagtgtgtcagtgcccttagcgccacccacacccctctgtgagggggctccctcacacccctggctcctctgaagctccatgcccacgtcacacagactttcttttgcatttggcacaaatcaccaagtgaggttgcaggtcacaggtgcacaccttcccactgggtgtacacggtggaactgaagccccaggcgtccctggaggggcccgagggagatgataagcagtccccaggacagctgagtggccccatcccacctgcatcttagggggctggtggtgctgacgggctcatcatgagtcctgtggtccttgcctggcccacactggagctggcttccagcttcccacgtctgcccagtgatgtttcatccacagataggcccagcccccatttgctagggtggtgcccagacccgaacccctgggctagttgggatctccagaggaggcatctgcctggagggtggcttccagtgtgtcccacccactgcccccacgcctaccagctggtgccctctcctccacctggggcttatccttccggccaccctctgtgaccctggtcttcccctccctaccttggatacaactgtgggcagcccacctgagctcccaagagctgggcagtggcacagacacagagactaccagcgaggcagggatgtggccccagaaggtcctgagcttgcaaaggattgttctggctgtctcagccagctcttgctgttccacctgccccagaacctccgcatcagttgagggtcgtggggttggaatgtgtggcgaagtaggtctgtggcagtggagttgggccatgctgagcctgtgactgcccaggagagaattggaaactaaaaggtgcaaaagcagtcagagactccctaccaccccctcactgtgaacattggcccagcggcctctggggcagtcgctgtaaccatccacgtggcatcctcggttctcagaggctgagacctccgtggctggagatgcttattttctgctcagttgttgttctgtagaacttatttctgtctacatcctgcctcatccctgagcctgccccacctggtccacattgcctttttttttttgataaagttttattgagatatgactgactagcggcacagttcacccatttaaagtgtatcattcagtaggtttcgtttcattcacagagttgagcaactgtcatcactacctaattccaggacatttcttgatccccaaagaaagccatacctgtcagcagccactccccattccccgtctcttcagcgcctgcaacctttaatctgctttctgtctctggatttgcctattctggacactttgtataaagggaatcctataatatgtagtttaggggactgacttttttcacttagtgttgtcgtctaaaaactcaccagtggcgaggcacggtggctgacgcctgtaatcctagcactttaggaggccaaggcgggcagatcacgaggtcaggagatcgagaccatcctggctaacacggtgagaccccatctctactaaaaatacaaaaaattagccgggcgtgttggcaggtgcctatagtcccagctacttgggaggctgaggcgggagaatggcgtgaacacaggaggcggagcttgcagtgagctgagatcgcgccactgtactccagcctgggcgacagagtgagattgcatctcaaaaaaaaaaaaaacaaagaaaaactcaccagcatggctaaatgatagaaaggagagttttatttgccatatcagtttgcagacccggaagagagagtctctagcatggactgaggtgctctctttgaagaggggaagggcagtttgagttttatgcctcccaaggtccatatcacacaatagagtcatacatattcagcaggtttggggaaaagccatacatatttatgaggggacccgagaacatatgcaatagataaacatacatgtaacatacatcccatgttcactttggggcagggttttagcattaaaatgaggtagaatctggatctttccatcagaaggtgagctctaggacacagttggagtgcagcctctatgaactgctgaaactggcttatggtctgtagttgcttatcagaaaagagtgtttgaaggctggttctctgtccagtcagggttgtggtggtctgggctgtcaagagttaggagggtctgataacgtgtgtgatctctactgttgtgagggagtttatcaagactgtggtttttcttgtagctgtaggaatttagggagttgctgagacagctgccctgaaccctcgagccagttggtactttttgtttcttccctttatccattaatggacacttgagttttttccaccttttggctgttggaaacagtgctgctcacagtgtgacctcacagcatttgtgtggtcatatgtttttatggctctcatgtgaatacgtaggaatggagttgttaagtcgtatggtaaccctgtttaaccttttgaggaacatccaaactgtttgccaaagcagccgcagcattatacattcccaccagcagtgtatgcgggttgcagcttctctgaatcctcaccaaaacttgctatgttctgtgtttttgatgatagccacgatagtgggtgtgaagttgtgtggactcgtggtttggtttgcgtttctctgatggctatgatgttgagcagctattctcatgctcgttggccatttgtatgtcttctttggagaaatggttattcagactgggttgtctttttgagttataggagtgacttatacattcattctagctacaagtctcttatttaaagcacaaagcttaaaatttttaagtcctatgtctctctctttttttttcttttgttgctcatgcttttggtttcttatctaagaaaccattgcctaatctaaggtcatgaagctttccccaatactttcttcttagagttttatagcttttgctctttcacttaggtctttggtttgacttaagttaactatttttttttttttgagacagggtctggctctgtcacccaggctggagtgcagtggtgcagtcatggcccactgcactgtcaacctcctgggcttaagagatcctcccagccgggcgcggtggctcacgcctgtaatcccagcactttgggaggccaaggcgggtggatcacaaggtcaggagatcgagaccatcctggctaaaccggtgaaaccccgtctctactaaaaatacaaaaaattatccaggcgtggtggcgggtgcctgtagtcccagctacgtgggaggctgagacaggagaatggcgtgaacccgggaggtggagcttgcagtgagccgagattgcgccaccgcactccagcctgggcgacagagtaagactccgtctcaaaaaaaaaaaaaaaaaaaagagatcctccctcccaagtagctgggactgcagatgtgtgccaccatgttcagctaacttttatgttttgtagagataaggcctcactattttgctattttgccgaggctggtcttgaactcctgggctccagtgatcctcctgccccagcctcccgatgtgctgggattataggagtgagccacctctcttgacctgagttaacttttgtgtatggtgtcaggtagagtccaactcccttctttgcccatgactatgcagttcaatggtcttccatgttgttcatgatggaaaaagcactgtgacacctggggctggcggcttggctctgggggccccagcagagccaggctgtctccctgggaaatgcctcggccaagatattctcctggaagtctgacagggagagggtggtgtcttggtctccctggtgcatcatttggggtgcttggctcccatcaagcccacccctgctgccctggcctctagagaagagcctctgaggtgaggtgcttctccacctcaagtccctgcccttcactttctgtgacatgagaaacccttttcctgttggccatgccttctgccaacactctgggagcttgttcagagtctgtgcagagccccccggctctcctaacctggggcctggctggtacgcagaggtgggccatgctctgctgaggcccagcctacacctgtgcccactgtgtggcgctgttgggggttccccaaacagggacatgattgtggtgggtgcctcctggcctctggtggctaattctcccactcttgaacttctcaggtggccccccaacctggcgtgaggtgaagaggttccctcttggctgtcccctttgcctgtgagatctcaggttgctcatttcttattcatccatccatcgaggctgctgggcatctgtgccttgtggtctcctgtgggtgcccgcttccgcctactgctgagttctcctctccttgccatgccatcaggtcaggaatgagcatggggaaggagctggagcatggagcggcttggcctcagtctggcctgatttcatggtccccagctgtaccccgtgttaggtgggtggcaggtggcaatttgccctgacatggcacagcagggcctctgcatggcccgctgattgctcctcacaggcacctacgggctgagcaacgcgctgctggagactccctggaggaagctgtgctttgggaagcagctcttcctggaggctgtggaacggagccaggcgctgcccaaggatgtgctcatcgccagcctcctggatgtgctcaacaatgaagaggcgtgagtgggcgggtcctgctggggtgagccccagtgtcccgccaccagggcagagggaaaggcaggccctgctgccccgggaggcccatggaagtggccaggctgggtccccagctgcagggaagctgatggatatcctgtcctccctgcctgtccccttgagccagctgaggtttccaacaccagggacttttgatgacagaagatgggcccaggcccaggcccaggcccaggggaggctcagtgcacccagaggcttgatgcagccacgtggggcccagagcagatggatgctcccctctgcatgccgagagcttgtgggaagttccagaagattctagacactcagcaaacccaggcggaagagacacatcatggaaatgagtggctagggtcagcacgctcagggttgatgggcttcccgcaagcggtctgtccccagcgaccctgggctgagtgctgggcagggacttgcagttccgggaactgcctgggtgtaggagctcccacccacttccttgcccgtaggcctcaaggcccctcaggggccaggcactggggtcttcgttgccccagccgggggtcctggtgcttgccatgccagcctttctcccactgggcgagatgccccacccatccctcgctccccacccaggtcagaccactgccctgcccaggtgatccagcgtccactcccaccctgtccagcttgcccccttcagagaagcacccatggaccatctcccactcctccccctggggcccctttctgccccctgcctaccctccttctcctctgggcctctgataggcggcctcgtccttcagcctcagcatcgctgcctcactggaagagccccacctgggcatgcccagcagcccctcccagctgtaagtccacacagcccccatcaatgtgccatctggggcaggccgaggaccggccctggctgccctcactgatggctggagccccgatgctagctacaatggctggcttgagtggacttctgtcacagaggcaaatgcccacagggcacctcttggggcaggcagggagcttgtatgtgccatctggggccaaagctccacgattgagtcataagttaagggtagatggagattttccgccttgagcagaaacgtggaggaaacacgcctggtgtgtgactcacgcctgtaatcccagcactttgggaagccgaggtgggcggatcacctgaggtcaggaggtcaaaaccaacttggtcaacatggtgaaactctgtctctactaaaaacacaaaattagatggctgggtggtgcacgcctgtaatcccagctgacggctggagccccgatgctagctacaatggctggcttgagtggacttctgtcaggagaattgcttgaactcgggaggtggaagttgcagtgagccaagatcgtaccattgcgctctagtctgggcgacaagagtgaaactcctcctcaaaaaaagaaaataagagaaaagagaagagaagaggaaaaagaaaagaagaaaagaaacaacccttgcagttccccggccactccccagagccagttaggccaccaggtgggctggggctagacccggctgcgggcgggccacagagggactaatggccaccacttctctccatcctgcaggcagctgccagacccggccatcgaggaccagggtggggagtacgtgcagcccatgctgagcaagtacgcggctgtgtgcgtgcgctgccctggctacggcaccaggtattgcagcaccgtgggtgcgccacctcctatcccatgtcccacctcccacgctagagggccggcaaagaagccaagtgcccatagccagagccaggcttcttcctcgcctgagtggattccagagcttctgccctgtccagacgcagctgcagggtgagcagataccacaggctcccggggccccacaggctgggcttaaggagccagtacacagccacacagggccaggatggcttcagggctgcctgcacattggtggatccctgcgggcaaacgccccggcaccatggcactaggcctgcaggctgtacccttgggtggtggctgctggccagcctttcctgcctggggctggctggcccattggcaggtgcagggtgtcatttccttcagcccctcctctgtcataggctcatcttcctgtgtgtgaggggaaggcaagtgccaactccactccctggcaggccgcatagccgctgggtcccaccccacggggtgcactgcgtatgtgtctgccctgggaaccagcctgtgctggggctgttgggggatccagggccaccctccgtctgcaaagcccacggcagagagggttggaggagaggagagtgtgctgaatgtttgcttcaggtgggctggcatggcctgggcagtggaagagagggcacaggagggaagccttccagacagaggaggcctgggccccaagtggtcaacagcttgacctcttggaagaaccaagcatggctgtgtctgggaacctgggcctccaaaggggaagtgtgtggtcagcccgcaggctgccctatgccttggctcatgctacacggggagagcagggcagggtggggtggttcccagtgaaggtggcaggactcagcaagtgtgggcctgtggagccagccaagagctcacacgccactgatggcccctcatcatccccaagactgaggctgctgctctctgtgacttggcacagcctccaggcatggggttcctaactctacctgcctgcattcttgccctatttgtggctgtgacaggcagggcagggctgagggacaccaggtgaacgagggcccctgctctctttcagaaccaacactatcatcctggtagatgcggacggccacgtgaccttcactgagcgtagcatgatggacaaggacctctcccactgggagaccagaacctatgagttcacactgcagagctaaccccacctctgggcctggccagtgggctcctggggggccctgccttgaggggcactgtggacaggaaaccttcctttgccatactgcattgcactgcccgtggcttggccagcatcccccggatcagggccctgtggtttgcgtgttacccatctgtgtccccatgcccagttcagggtctgcctttatgccagtgaggagcagcagagtctgatactaggtctaggaccggccgaggtataccatgaacatgtggatacacctgagcccactcttgcacatgtacacaggcactcacatggcacacacatacactcctgcgtgtgcacaagcacacacatgcaagccatatacatggacaccgacacaggcacatgtacgtgcacaggtgtgctacacatgtgcacacatgcacagttgcacagacacacacacacaggtgcacacacacgatgccgaacaaggcagaagggcgactctcacctctcatgtgcttctggccagtaggtctttgttctggtccaacgacaggagtaggcttgtatttaaaagcggcccctcctctcctgtggccacagaacacaggcgtgcttggactcttgacaagcagacctgctcctgcagaggagacagccacatttggaattgggcaccgagaagacctgagaaaaacccactctctcttttttttttttttgagacggagtcttgctctgtcacccaggctggagtgcagtggcacgatctcggctcactgcaacctccgcctcccaagttcaagcaattctcctgccccagcctcctgattagctgggattacaggcgtgtgccaccatgcccagctaatttttgtgtttttagtagagacggggtttcaccatgttggtcaggctggtcttgaactcctgacgtggtgatccacctgcctcggcctcccaaagtgctgggattacaggcgtgagccaccacgcctggccgaaaaacccactctcataacagaagtgcagactcattgctagattcagtgcccttgagtgtgccagaggtcctctgtgtttgagacaatcctgtgtgtgccaggaggctccgtgtgcaccaggggctctcagaatcccgcttacccagctggagaccatgcctctggcagccccatctcagccagccctgctctctccctcttccctccaggtgaggcaaacttcataggaatctgtacctgaatgtgagctcctgataataaaactctgaggctttggtgagcgcatttcgaggcctttcccttgtatgcagggtgccagtgggagctgctatgtctcctgtgcagccagacaccctggacgaggcccttcccacctccccctttcctcacggcttcttcagcaccacatgtggatgcctgtgggtcagtccatctgtccatgggcaggggccgctgtgagagaccccatgcgcgtgggatgtggtagatgctgattatggggccagccacccatacaggtctatcaggtcgcaatggaggccccactggagcgggaggcaggctggcctggacttctgttggatgatgggggccaggggatggtaggaggggcaggagagcaggtctgcatctgtctcagccccaggagctcctggtttggggccagctctaaggagcttcatccctgagcctggccgagtataagggggtcccggatatccaatgctgagacctagacttttctaagcctctgcacccaacccctaacttggccttttcagacccatgagagtgcagggtgggtgtggacctgcgccagggcttcccagcctgattgtgacatgatgtgagtccacctagggaggagcaggggcctccccgtctcttccccttcttgcccagaccactttgctgggctcagagccttccatggctcactttgaactcagaagagtttcccagctgcgacccaggctgcacccccaggcctgaggagaaactgaggccccacatcccatacgtgtcctctgagtcaggacaacaggctcccggctgggggcactgcccttgctgccaacacattcacctgccccagtggctaccatgtcctgtgccggtgaccagtgccagtccccaacctggatggtgccctgccctcatgaagagccccccggatgttcacctctgcccagagacccggcctgcccaggaagagcagtctctgctcttgtgtgggtccctctgcccccaccctgcccagggctccccagcagcctgaggcccctaaggaagaacagccctcaatggtgattctattggtgttatgagttgtgtccccaaagagatatatcagtgtcctgacccacagtacctcagaatgtgactgcatttggagatagggttcttccaggggtaaccaaggtagaatgaggtcgttagtgtgggccctaatccaatatgacggctatccttataaaaagaggaacatttaggctggatacagtggctcatgcctataatcccagcaccttgggaggctgaggcaggaggactgcttgagctcaggagttcaagaccagcctggggcaacatgtcgaaacgctgtgtctaccaaaaaaaaaaaaaaaaaatacaaaaattagctggccattgtgactcacacctgtagtgcgaggctgaggtgggagaatcgcttgaacccaggaggcagaggttgcagtgagccaagattgcactactgcactctgcctgggcaacagagggagactctgtctcaaaaaaacaaaaaaggaagatttgggctgggcgcagcggctcacattgtaatcccagccctttgggaggccaaagctggaggactgcttgagcccagattagcctgggcaacatagcaagaccccatctctaaagaaaaatgaaaattaaaaaattagcagggcatggtggtacacacctgtagtcccagctacttgggaggctgaggtaggaggatcacttgagctcaggaggtggaggctgcagtgagccgtgattgcaccactgcacttcagcctggatgatggagaaaaaccctgtctcttaaaaaaaaaaaaaaaggaaaaagaaagatttggacacggacggatacgcgcacaggaagaacaccgtgtaaagactggaattctgctccacgagccaaggcatcaccagaagctgggagaggggcctgcttcagagcctctcttagagccttcagagggagcagacctgctgtcactctgatcatggacttccagcatccagagctgtgtgacaataaatgtctgttatcttaagtggttcaatttgtgatgcttttttttttttttttttggagacagggtctcactccattgcccagactggagtgcagtggcaagatcacagctcactgcagcctccacctcctgaggtcaggcaatcttcccacctagtcccctgagtagataggactacaggtgcatacgaccacgtccagctaattttttgtattttttgtagagacggggttttaccatgttgcctgaactggtcccaaactcctgggctcacatgatcctcccaccttggcctcccatagtgctgggattacaggtgtgagctactgagcccagactgtggtgctttttttttttttttttttttttgagacggagtctcactctgtcacccaggctggagtatggtggcacagtcttggctcactgcaacctccacctcccgggttcaagcaattctcctgcctcagcctcctgagtagctgggactacaggcacctgccaccacgtccagctaattttttgtatttttagtagagacggggtttcactgtgttagccaggatggtcttgatctcctgaccttgtgatccgcccgcctcggcctcccaaagtgctgggattacaggcgtgagccaccgctcccggccgactgtggtgcttttttaaggcggccctaacagactaacacagtagtgatcttcactttacagatgaaggaactgcggcttggggagataccataacggccccccggttccgagacaggtggagaggcagaaccatgggccaggacagaataggatgagtacaaggtggcatctctgggggtgcctgccccacagatccatggtcttcccatgctggtgtccccacaatgtctggcactgctccccgcttcaccttacttgcccaggcctacccccataccctcagctcacagctacacactctgcacagctcccaccccagggtctttgtgctcacagttcccctgcagatacccaaaccacactcttcccccagttcctgcaggtctttactgaagtctcgggcaggcaactcatttaaagtttcagtttagcccagcacggtggcacacacctgtaatcccagctacttaggaggctgaggtgtgagcgtcgcttgagcccaggagtttgaggctgtagtaagccatgattgcacgactgcactccagcgtgtgcgacacagcgagcccccatcttgaaagaaagaaaaaagaaattaaaaaggaggctgggcactttggctcacacctgtaatcccagcactttgagaggccaaggtgggcagatcacttgagttcgagaccagcctgaccagcatggtgaaaccccatctctactaaatatacaaaaattagctggacatggtggcggatgcctgtaatcccagctattcgggaggctaaggcaggagaattgcttgaacctgggatgcggaggttgcagtgagctgagatcgtaccactgcaccccagcctgggtaacagagctagattgtatctcaaaaaaaaaaaaaaaaaaaaaaaaaggaaggaaggaggaaggaaagaaggagggaggaagaaggaaggaaggaactctctttttctctatggcaatgagcacgtaccatctggcatgctgtgtgctaggattggttcttgcctgtctccatcagaatgggagcttcaggaaggcagggaccttccttctcttgcccactactgtactctgatgcccaggccaggcaggcatttgagccaagaatgacagtgctggtgcttcccaagcccccatctatttgggccaaccccttgatgcaaggcccttgtgctaatagagggtataggggtccaaagccagtgccttctagaagagctttggacgtgacaccaggaatggctgggcctggacaatggccttcctggcactgcccagccagtcctctgtgcttgttgccagatgcacctgatccctgagtccccagcatgggtctctttctcccaggcagatggggaactcaccttcttctcagatgccccttcccaacataagctgcttctgccctctggccccgagatggccaaggtgagctgtgtagacatagagtctggaggcatggggctggctaacgtggaggcaattctatgaacagacatggccaggccaggaatgcggcatggcctcaggtctcatccttgaaggcctgggctcctggtctgcctgcagacttcctgagaccacgtcttgttctcatctgccagcagatgcctggctcatgggtgagccgggcttaggtggaaacacaggagcccagaggggaaaggatcctcccccagcttgggctggagtcccaacttccaatcatcaatctttgcaaccctggggctggacctggctagttccatggtaaggatccttctccgtcacccagtcagtcccaggctgtgtgggaaactggctgtggtgggcaggtctgaggtctcaagtctgacaggggccactggagcctccaactcaccaatcaaccaagtgtgagaggttgctttggttgaatggccatgtgctggggtctgactggcccagccacagggaggctggcatcccctagctgagtcctggacccagaccctccagggcatggagcccattgtgaggtgtctggtgctgaagtggtgggggaggcccgtgcaggcctacagctttgtcatctgcaacattcctctccccactttctttaaactttttcatttagaaatgatttcaatggccaggcgtggtggctcatgcctgtaatcccagcactttgggaggctgaggcgggtggataacctgaggtcaggagttcgcgaccagcctgaccaaaatggagaaaccttgtctctacgaaaaatacaaaattagctgggcatggtggcacatgcatgtaatcccagcactttgggaggctgaggcaggtagataacctgaggtcaggagttcgcgaccagcctgaccaaaatggagaaaccttgtctctacaaaaaatacaaaattagctgagcatggtggcacctgcctgtaatcccagcgacttgggaggccgaggcaggagaatcacttgaacccgggaggcagaggttgcagtgagccgagatcatgccattgtcctccagcctgggtgacgagagtgagactccgtctcaaaaaaaaaaaaaaaaaaatgaaacctcgtctctacaaaatatacaaaaattagctgggcatggtggcaggtgcctgtaatcccagctacttgggaggctaaggcaggagactcgcttgaacccaggaggcagaggttgcggtgagccaagatggcaccactgcactctagcctggtgacacggcaagactccatctcaaaaaaaaaaatttttttttcaatttactaaaggatttaaaaagtagaacaaaaaattctagtgtctttcacccagttaccccaaatgtgaatgccgcacccaatcacagaaaaatgattacaaccaggaaattaacactgataatgttaaagaaagaattactgaatgacatttgctaaagcactgtagggaagactttattcaggaccgtcttgctaggtctagggaccacaggaatgagattctgcagtgggggagagagattaagctcaagtccgaatgggcaagtgggaactgatgatagctgaggagcagggcggtgggagctgggtcagcacatggaaaatgactaagaagaaacaccccgggtgagggagattctggctacaccaattaacaggatttttgctgaagacaggccacagtgaccggacatcttcacctgggggacagtgtaggaacggattagataaggagggtgatcagatgtcgagggtcaggggatgcttcttgctaaagtgactttgcagggttcttgctctaagtgaaatttacaaggaagtgcacagatgggcctagaagaaggttcagaagcctggtttggccaagcaaagaatctttgtcggtccctcctcttgttcaaggaaagaagaggttatctttccttgaatagtacgagtccatttccttgctgggctgccttttgttcattaaaggccagctgaatcatctgctgggaccggcagtagaggagatatcctccatggtgtgagccatcaggcgttgcatgttgaagataaaagaaaaagatattagttggaaccaactataaactcagtttctgagttcagagggcagctactcaagatttccaggtgctgtgcttgaagcatcttcagatggagtaggggctaacagactatcatggacggcagtttgcgtgtcatgaagtctgcccacaaattatctgttgtggtgccatcttaaagtttctttctttttttttttagacagagtcttgctgttgttgcccaggctggagtgcagtggcgcaatctcagctcactgcaacctctgcctcccaggttcaagcgattctcttgcctcagcctccagagtagctgggactacaggcacacaccaccatgcccagctaatttttgtaatttttgtagagacggagtttcaccatgttggccaggatgatctcaatctcttgacctcgtgacctgcccacgttggcctcccaaagtgttgggattacaggcgtgagccaccgtgcctggcctaaagtttctatcaagttgtccgggttcagcttaaagggcttcaggaaatgggaagttttaatttttagcggttccaggccagaagggtgggaaaaaaactggaaacatcagtttagagaaaatcaaatattggaggaaactagaagaattcaggatccaatccagtttgtaggtaaatatcaaaacctcaaaaacaatgaacagggctagaatctgataatgggtgcactatagttttcttctgaaactaatttttctctatatagtcaccccacttctatcaaagatgttgaagtaagactaatttgtttgtagctaagtttaggttgattaaacttggcctaattacttacataagtgccgcaacaatagtgattgaacacataggctttctttaagtttcctttgctaggacttttttttttttttttttttttttgtcacggagtctcgctctgtcgcccaggctggagtgcagtggcgtgatctccgctcactgcaagctccgcctcccaggttcactccattcccctgcctcagcctcccaagtagctgggactacaggcacccgtcactatgcccggctaatttttttttgtattttttttaatagagatggggtttcaccgtgttagccaggatggtcttgatctcctgacttcgtgatccgcccgcctcggcctcccaaagtgctggcattacaggcgtgagccaccgtgcccagcctgctaggacttttaataaggcatctcagattgggcttttaaaagccttgccaggctaggaagccaagccgaagcttcaccatcatacttcatttgcaatcattataggtttgggtgaattcctctctttttgaggtcccccaaaatatcctgacatccttgggcctgtcaggaagtgactttccttactcacctacaaggcaaccacatgacccatgtattcaaggtttaaaacccatttttccccaagggctttattggttccataaagtcatcttagttacttaaagttgtctggccatagctaaaaatatggcattctagtcaaagctttggtaatataaacagcatttccaattgtgtcctgttacaaagagaacaggttcttactgaacttatgtaaataaccatattgccattaaaataaaaatactcatgaatagtttccgaattatggaaggataaggtacagagaaaaagtaattgtttcacttttgtttacaaaggcatactttaccaaactgctgtaagctatggataacttaaaagagaaaaaaaagtttccttaaatctggaaaacaaaacattaaagaaccagcaatgtttcaaacaaaacataaaaaaattatcctggctgggtacagtggctcacacctgtaatgcttagggaggctgagatgggaggatcatttgaggccaagagtttgaaaccagcctggtcaacatagtgagaccctatctctacaataaaattaaataaataaataattgtaattggtttattcattgccatgtaatttattcttgttctgtttgatcttgatcagcagtttcacgaacccctcagtgtcttcattcaagttctggaaattctggccaggtgtggtggctcacgcctgtaatcccagcactttgggaggccaaggcaggcagatcagttgaggccaggaatttgagaccagcctggccaatatggtgaaaccctgtctctactaaaaatataaaaattaacagggcgtggtggtgggcgcctgtaatcccagttacttgggtggctgaggcaggagaatcgctggaacccggcaggcagaggttgcagggagccaagattgcaccactgcatgctggcctgggtgacagagtaagactatgtctcaaaaaaaaaaaaaaaaaaagagttctggaaattttttttttttttttttgagacggagtgtcagtcacccaggctggagtgcaatggcacgatcttggcttactgcaagcttcgcctcctgagttcaagtaattctcctgtctcagcctccagagtagctgggactaaaggcacacaccaccacacccagctaatttttgtgtttttagtagagatggggtttcaccatattggccaggatggtctcaatctcttgacctcgtgatccgcccgcctcggcctcccaaagtgctgggattataggtgtgagccactgcgcctggccccagccacatttcttaagtaatcaaaaacctaataaaagacaatatgaagaacaaggaactatcttgatataacacaaaaatctttgtttccaaggtcaattatttaaaaggtaaacagaggccaggcgaggtggctcacgcctgtaatgccagcactttgggaggccgaggcgggcggattacgaggtcaggagatcgagaccatcctggctaacacagtgaaatcccgtctctactaaaaaaatacaaaaaattagccgggcatggtggtgggcgcctgtagtcccagctactcgggaggctgaggcaggagaatggcgtgaacccaggaggcggagcttgcagtgagccgagatcgtgccattgcactccatcctgggcgacagagtgagactccgtctcaaaaataaaaagtaaaataataataataataataaaaggtaaacagaaatcttcataatctcaaatactgtaagaaaactttgtcatttcaacagagaagatcaagttaaagttctgcatcatagcactactaataaagctaattttaacaaaaccttataaatgaatccatccaatctcatgcaagataatatttcttttccaagatttcttttctatagatcttttacaacttaaaaaaaatatctggccgggcacggtggctcatgcctgtaatcccagcactttgggaggccgaggcgggtggatcatgaggtgaggagatcgagaccagcctggctaacacggtgaaaccctgtctctactaaaaatataaaaaattagccaggtatggtggcgggcagctgtagttccagctactcgggaggctgaggcaggagcatggcgtgaacccgggaggcagaggtttcagtgagtcgagatcttgccactgcactccagcctgggtgacacagagagatgccatctcaaaaaaaaaaaatctatcagtactttttttcccctacattttttttctttctcattctggaacaaccagttgctatatatattagcacagagtcagttattcctttaagggattttataaattaatttggtgctactatctggaggtagaaaaatatcatgtatatataacatacaaacatacatatgtagttgctctgcaactgaagttggcagaggccagacccagtggctcacgcctgtaatcccagcactttgggaggccaaggcaggcagatcacttaaggccaggagtttgagaccagtcttgccaacatggtgaaacctggtctctacaaaaatacaaaaaaatcagctgggcgtagtggcgtgcgcttatagtcccagctaccttggagactgaggcaggagaatagcttgaacccaggaggtggaggctgcagtgagccgagactgcgccactgcactccagcctgggtgacccagtgagtctctgtcttaaataaatacataaataaataaacaaacaaataaataaagttggcagagtatatagtctgaaggggtttgaggaaaggggattcaggtgactgagaagttccgatgggagaagtaggatccaatagagagaacagagaggcctcacagtgggaagaaaagactgccagcccaggagtcagggagtgaatccccattcagaatgaagagccacaaggaagaccttccaacccaggaagtattatacctttcaaaagaaggctgggaccttaaaaatcaaaatctgtccttaccagctaaaataaaagtttttctacagtcatggctcaggagtttgactcaccagtagatccccaatcagccagtcagaagacaaaggctgcaaagttgcacattgagagtcctgggtcagaggcctgtggcaccacaaccattaaagaaaaaaattattcagcccttgtcaaagcacggtcgggaaggccttattcaggagcattgccactggcatatggaccacaggcaatggggttttgctgcaggggagagattgggctgaactctgaatacagcatggacaagtgtgaactgatagccaaggagcagggcgggggtcagtggatgaaaaattactaagaagaaacataagtgataagggggatactggctaagctgacctaagaggattcttgctgaagacaggctggggtgatcagacatcacctagaggatggtggagggatgaggaatttcatcagtattgagggcgatcagatatcaaaagcagggtggttcttgctaaactggaattctcagacgggcctagaagatttaggagcctgactaaagtttggccaagcaaataatcttttgtcaatacaacaacacgatactttttactgtttgttttttttttttttttttttttttttttttttgagacagagtctcctgctgtctcccaggctggagtgcagtggcgcgatctcagctcactgcaacctttgcatcccgggttcaagcaattctcctgcctcagcctcccaagtagctgcaactacaggtgcgtgccaccatgcccggctaatgtttttgtatttttagtagagacggggtttcaccctgttagccaggatggtctcgatctcctgacctcgtgatctgcctgcctcagcctcccaaagtgctgggattacaggcgtgagccaccgcgccaggccaatacaatagtattaactaatctacagaccttgtttgaattatatcaattgtcccattaatgtcccttttctgagccaggatcccatctatcgtctggattccacactgcattttgttatctcttttaattgaagatggctcctcagtccatctttgacttgaatgatctcgatacttgaaaagcactggctggtaattttgcagaatgcccctaatttggggtttgtctgctcttcattcagattctgccttttgggcaaaaatacccacaagtgaacttgtgttcttctcaggaggtccacagtatgtcctcttactggaactaacttttttcatttctattgaggcagaatttatatacaatgcaatacacatgtttaaatggtacaatttgctaagtttgctggtgaccttgatggcttggttaaaggtggtgtcgcccaagttttcttccactctaaaactactattttccctaggcaattagtatcctgggggagaaactttgcaacactgaaaacaaaacaaaacctgtttgtcatgtttttgcccactatttttttttttttttgagatggagtctcactctgtcacccaggctggagtgcagtggcgtgatcccggctcaccacaacctctgcctcccaggttcaagtgattctcctgccttggcctcccgagtagctgggactacaggcacgtgccaccatgcccagctaattttttttgtagttttagtagagacgaggtttcaccatcttggccaggatggtcttgatctcttgacctcgtgacccacccgcctcggcctcccaaagtgctgggattacaggcgtaagccactgtgcctggcctaatttttttgtagggggttgggggccggggaccgagtctcgttctgttgcccatgctggagtgcagtggctggatcttggctcactgcaactcctgcctcccaggttcaagcaattctccagcttcagcctccgtagctgggacaacaggcacctgccaccaagccctgctatttttttttgtatttatagtagagacagggtttcaccatgttggtcaggctggtctcgaactcctaacctcaagtgatccgcccgcctcggcctcccaaagtgctgggattacacgcatgagccactgtgcctggccttgctcactattttttctggagacggtctcgttctgtcacccaggttggagtgcagtggcccgatctcagatcattgcaacctccacctcccgggttcaagcgattctcctgcctcagcctcccgagtagctgggattacaggtgcctgctaccacgcctggctactttttgtattttcagtagagataaggtttcgccacgttgcccaagctggtgtggaactcttgagctcaggtgatccgcctgcttcggcctcccaaagtactggggttacaggcgtgagccacagggcccggcccactatttttatcactcaagattttcgtctacagcagctattattggggtggctacccagtggaaaatttttctatttccactattccttccacatttattgacaggaaagctagtctaaggaagagctgtaccctcacttactcagaccctcgttttccttttttttttttttttttttgagacggagtctcactctgccgcccaggctagagtgaaagtggtgctatctcggatcactgcagcctggaactcctggactcaggtgatccttccacctcagcctcccgagtagctcggaccacaggcgcccgccaccacgcggctaattaaaaataattttgggcccggcgcggtggctcatgcctgtaatcccagcactttgggaggccgaggcgggcagatcaattgaggccaggagtttgataccagcctggccaacatggtgaaaccccgtctctaccaaaaatataaaaattagccgggcgtggtggtgggcgcctgtaatcccagttactcgggtgggtgagccaggagaatcgcttgaatccgggaggcaaaggttgcagtgagctgagatcgcgccactgcaccccagcctgggagacaaagcgagacaccgcctcaaaaaaaaaaaaaaaaagaaagaaaatttgtagatactgggctctcactatgttagccaggctggtctcgaactcctgggctcaagtaatcctcctgactcgacctcccaaaactctgggattacaggcgcaagccaccgtgcccggccgaaccaccgtgcccggccgaaccctccctgttttggaaatcctgtattagcaaaggggacagcgccagacagttgagcacacgcgttctttataaatgatgatgtctgatacagtgatgcttttaacagggttgtgtaacgcctgtgtgtgcacggtctcttctgcagtgtccaccgaaggtggcccgtctgcgtgtccgctcccggcgtactccgcgctccctgttcccggcattccccgcgctccccgagcttcccgcgctcccctgctcccggcattcccggtgcttcccgttcccggcgctcctcgcggccgccgccctcagtccagcgagccccgcctgggcagcgactgttagcgcgaccgcggcctgggcgcctggtccctcccgcgcggccgcgctattgggccgcgcgcggcggacacacgcgctacgcgccgccgattggcggcctccgcagcgcgctctgcggctcccccaatgcggggcggccgcgcgcggggattggccgcacgccgcgaaggcccgccctccgctcgcccggcgcggcaggcgggtgccggcgaccggagagcctggacaggctttccagatggctgcggcggtcggtcggtgaggctttcccggctgtggtttggctgcgggcggcttgggcagcccgcgggcgcctcaggtaggtgcggggcgcgaggggcgcccgcgggcggttgggcgggcgccgcggcctgcgcgagggcgcgcccttccctcccgcctccctccgggaccgaggccgcgggcggggcgggggcgcggagcccggcctttgtgaggcaacatggccgcgggcggtggagagcgcggggtggggacgcctccggggctggggggcgggccccgggcccaggcgttgccgactctcgtcgctgtccgcccgggtaaagaggctcctctcccggagggcccgaagcctagcatcgccttcaggcgggaaaggtgtggacagggccagtgctcgcctgggaccctgccggctttaacacagtttgggaaatccaagaagtcgcctaagtctttttgtccacagaatgctcacgggttgagtgtcacgtagataattgggatacggttttattgtaacaatgagcatggcggaaataaatggaaggtggcaacctgttgacagtgatgcctgtctggtgtcaaccgatggacttgggtttcttgtggcaggagtctgatttgcctttttgcatgcttgcatgtaccttgttcctgcacggcagtcctgtctttggctgtcgactgttcgaggccaaccaccaggcgaggatccactgtttcctggccagactagactcccagctgtgggagtggcccaaaccctgctgcaggccttcactcacaaaagggagtgaatggccagcccggggtacccagtgttgcctctaagtgcgggatatgaggcctgttggaggatgacaaaaggaacggatgaggtcatactgccgctgggttgggcgggaggctgcagcgggagagacttgaccaaaaggcagcctccatggcgctggcactggtgctggcccgtcacagccagtgcctctgttagccaacacagcaagtgggctaggaggaagggtgctgtccaagtgtacgggttttctccccgtgccaagggtccaggggagcttgccgtgagcccgttcctgtccgatagtcctgttggcaaggcagggtttgcatgcggtgtttggtcagctggagcagtggggaggcctacgggcagagagctcccctttgagccctttgcggccaggcgctgtgtggagcacttcccaggggttgttttgtagtctcaccgtgaccttggggtaggaaatgtgcttctggctggcttgcccagtcttagactctcttgttgtagccctctcctttgtgatgtcacccagcctcctgactttaatgccagctttccttgacatcttcacagctccagccctggcctctcttctgatttccagcctggtgtttctggccacctcttccatatctccatgtgttactttggcgccaagtagccatatccaaaccaaactcaaatcttcacccatgccaaaacattccttggcctatctaaagtccctttgattcctctctttcttacaccttcatgcagtcctaaggaggccccgtcagctcacctatttctaagcacagaccatttctcaccaccttcaagttaacatcctggcccagcctacctggtgagcctctaattctctttactgtcaccttaggtcctcactccccatccaccatctatagtttttctggacacagagtgattcttctttctttctttttttttttttttgtttttttgagacagaatctcgctctgtcgcccagactggagtgcagtggcgtgatctcagctcactgcaacttctgcctcccgggttcaagcgattctcctgcctcagcctcccaagtagctgggactgcaggcgtccaccaccaccacgcccggctgatttttgtatttttagtagagacggggtttcaccatgttggccaggctggtctcgaactcctggcctcaaatgatctgcctgcctcagccttccagagcgctgggattacaggcgtgagccactgtgcctggccacagagtgattctttttatttttttgagacagagtctcgctttgttgctcaggctggagtgcagtggtgcgatctcccgctcactgtaagcttcgcctcctgggttcaagccattctcctgcctcagcctcccgagtagctgggactataggcgcccaccaccacactcggctaattttttgtatttttaatagagacggggtttcaatgtgttagccagggtggtgtcgatctcctgaccttgtggtccgcctgcctcagcctcccaaagtgctgggattacagtcgtgcaccaccgcgcccggcccagagtggttcttttaaaccataagatggtataaaacagaggcggtgtagatgcaagccagcttgcctgcttgtaaagcagctccatcacttcctggctgtatgaccttgagcatgtgggtgaacctttcttccataatgctatgtgagacctgggtgagttaaaatgcttaaagtgcttagaacagggcctggctgaggtttggttgccactgctatcctggaatcagctgatgccactgtgtgggccttcctatccggtggcccatctctctcactaagagccaaagtcctggcagcagcctgggaggaccagccctgatccatctgccctcatggacttggcccactgtcacgtcccctcagcacactgccccagctggccacaccacattcctgaccccagccctctgcttttcctctcagtgtcacctggaacatcccctcctcccagccctgtaacccacctggctcactcctgccttcacgtggatgcaggccatgaggccttcttggatcccccttcctaaaactgcctccccttcttcaggcgctttccttgttttgtttttgcttgaatacttcttggcatgtgacagggtgcatgcttttcttagttgttagcggtccatctcccccactaaaatgtgagctctgtagggcagggttttgtccaccttgtgtctgtagcatctaggatggtgtgtgtgtgtgtgatgaatggagaaagcttatagaggggaggaaggaacttgcccaggactgcccaccactgaggtctggggctgggcaggtttcctgctttcctaaggagctcactcacttgtaaggcaccaggctttcctgctgtgcatttcttcagtgccgccgcttggccccattagcacctttgcttggaacgtctactctagctgcttcttcgccttctgtggtagcaggcttccccattccgtcccactgttggtctctaatcccctgctccttgtggcttcttcatgtagctttttgtgtcccagaatcatggattgactcaccagggtctctatgggactgccaggttctgaggtgtgtggccctggtcttccttgtaatctgtggcactgggcgcattgacccctcggtctgttttctctaatggtctttcttggttgccaggagactgacctcaccccgcttagtgttcctcatgcctgcctggttgctgcccacagcctcttgagcgtcttcagcactttatagtcagttgttagctctgtgctgtgtttcctggatcctcagcacctttgatggacacatctttgggaacatacggtgtgaaattcccattagattcagaaatgttaggacatcttagaatccaggaaatggggtgacagtgcagtggtcattgacctgccagtgtgtccaggccctgtgaccttgtctcttgtccatatagtgcgttcctcggagtagatggccagtggatagttgttaaatgtattgattaaacctaaactagtctctggttttcatgttgtgtccccttcgaagtacatccaccatgccttgtcccttgttaaatgtgtgatgtctgcatctcctgttctttccgggaatcttgggaggatgttaggtcatgcagtgcggtttgcatgtgtgcatctttactggtatgcacgcatgtgcatgcatgcgtgttcctgtgcacgttgtgggagtgtgcatgtgcgtgtgtctgcatgtgttccttctgctctgatgcagggttttctggctgccccctcagacccatcttccctgcttcatgttgtccctttcttcatgcttcctctgtagtaaggcttcctagagttgcatccttaaccctcatctctgggtggccttcctcctgtgggtttggcgactacctcctcagtgcgtcctggccttccgtatctggaccagtcatggctccagagttgtggcctcggcaccttcagagcctgcctggaggtcccctctgttctcctcgccaggctcctgcctgcatgctggaatttgggtgtccttccttgtctttagttccctcttttctctgctatccacctccgttgggtcaacaagtgcggtcagttctgtgacactgttcttggcccattgccagggcctctttcacacctttgtcctctggcctggaggactgtccccgtgccttggatgcagttgcttctgcctggcacagctgtgggtctcccctctcaagtaggaacctacttgtggcatgagagtcgcttcaccttcagtggctccttattgtccccagggcggaacgggctgcaggtggcacccaggcctctctgtgcctcggctccagctgtctcttgtggctccccaccccaaatcctggcaggtcccttccccacagccacccacccctctcctccatcgggaacagaactatgctgccacctctggtgacctcagcacgctgcatcactgtccccgtccacgtgctaccctgtgggcccaggagagccctggggtccctgggtagcagagcgcctggccatgcctctgaggcccctagtgccgcagagttgagctgagggtctcgcgctcgccctctgactgacccagcccttgcaggtgagtggattgctgtgctctggtggcctgagggaggccacgcgccttctgtgtgttccagaaagggtgcctcccactgcatgcttgcttatctgagttagaagaatgctgtggtggagtttagtgtaaatttttaaaatattttttgagccttatgattatatagtttttgtgtttctgaagtaggaattaaagtgggcattaacaaaatatttaactttggacttaagttataattcaggttctgaagaataaaagtaaggttagtttgttttgatgcctaaaaagtcctcttagggaatattattttgaagccctttactatgctgttaatagtgcttggcttttaacttggtaccagggaattggaaggtttctgtcattttgtgacgatatttttaaatttctttgcaggtagaagaagaaaggtgccactccggcatgaagacagactcgcttagtcgccagtcacttaagctgagtgcattgtgatttccaataattgaggcagtggttctaaaagctgtctacattaatgaaaagagcaatgtggccagcttgactaagccgccagcgcacagcgcggcaggacgcgcccgggtctcagcggacttgtgcatgttagctgtgtagatttatgtgagggcttgtaaaactctggtcttgtaaactagtcttaagcgcttttaatatggagacagatgagagcccctctccgctcccgtgtgggcccgcaggagaagcggtgatggagagccgagctcgccccttccaagcgctgccccgtgagcagtctccaccacctcccctgcaaacgtccagtggtgcagaggtaatggacgttggctctggtggtgatggacagtccgaactccctgctgaggaccccttcaacttctacggagcttctcttctctccaaaggatccttctctaagggccgcctcctcatagacccgaactgtagtggccacagcccgcgcaccgcccggcacgcacctgcggtccggaagttctcccctgaccttaagttgcttaaggatgtaaagattagcgtgagctttaccgagagctgcaggagtaaggacaggaaggtgctgtacacaggagcagagcgcgacgtgcgggcggagtgcggtctgctccttagccctgtcagtggggacgtgcatgcttgtccctttggcgggagtgttggtgacggggtaggcatagggggtgagagtgctgataagaaggatgaggagaatgagctggatcaggaaaagagagtggagtatgcagtgctcgatgagttagaagattttactgacaatttggagctagatgaagaaggagcaggcgggttcacggctaaagcaatcgttcagagagacagagtggatgaagaggccttgaatttcccctacgaggtatgttggcagcccctcctctagagggctcttagcaaaacccaaagagagatttgggaattgcagcatcttttgaaagcagggaaattaaaaaaaaaaaaaacaaaaaccaaaatcccctctgaggtggaataatgttaatgtggagaagagaaagatgtaaggagtccagatttttaaagtttcctaatgaaaagtttggcccatgggtaggccctgcatccctgatctagcgcgtggggcagcaggtgctgctgagttacgctccttggcagtgtgtgcccctggaccaggtgtgttggtgtcagctggtagcttcatcctgtttgtttttcagatgatcatgcaccctaagggcacatctaggccccctgagagcacctcctttctgtgtctgttctcaggaatgctgttgagctctcctgttgcaggagcatgagcgccaggggctctggtgtctgaacagcgtgttttgcaggatgactttgacaacgatgtggatgctctgctggaagaaggcctttgtgcccccaaaaagaggcgaacagaggaaaaatatggcggagacagcgaccatccgtccgatggagagacaagtgtgcagccgatgatgaccaagattaaaacagtgctcaaaagtacgtgtgtgggtcagaagcagtgggtgttccagggcagtggaggggtggttgcttccttagcagaaatgctttgagagagctctggtgccaggtagtgggctgggtggaggcatgtttgaggacaggacagaaatatctgaggagggaaacacaggatgggaggacgtcctgatgcatgacccagatgcggatcctggtgtgtgctatggaaaccacagagcagcaggcactgtgcagaggaatgggaggggacttctgagggggtcaggaggggatgttggtatatgccaggagccagcatgaccatcagctggagggtgtggagaccaagggcaaggtgggtacacagtgagatggcaggtgatagttgtgatccaggttctagtcctggaccaagtgtcacaggaagccaccagaagcaagtggtgttacctgatttttgtttaacaacatggcttctgggccacagcatggtgtgtgcacttcagctgggcagggtggaagtgccctggtcgacgtggcacttcctcaactttgagttgagggtagtggggagagcacttgagaggcgcccagagttgcactgtgaggctctgtcatcgatgtggtgcaggtgttgggggagtcggagttggtggcttggaggcacctatgagggtcctggtggagatgtggggctcggtagagggactgaagagatgcacggggactcaggctcacaggtgagaccccaggctgagggctggggtgcacaaggtggcagggtgcgactgggagcaaagcaaggggcgggtggcacatggccatcctccttgggccattgaggggacaagttagctatgccaggtgccacatgttgctgcctatgtcgtgttggtagcagttaagcaggagggcttttggtctagacggttgcaggcagggtaaacctggggcttcagcttctggggctgggggcaggagtcttgacctcggggcctctaggaggctggtttggtgctgcattttcaacaggctcattcagaaggtaaacccacattcgtcctgcacagctcactggtcagcagccattctggcctggatgcctggatgttcacagacggacagctgcatgtgacccccacctcaggtggctgggccaactttgtgaccactcactgtcacagaggagcagccccagcggacccgtggcccgtctcttgcttggctccgtattccctttgcttcttttcctgacttaacctaaagctggcaggaggcagctccatcttggcctgactctgtggggagagagcccacgcagtgtgcatgcacccctgacctttaacactccctccctgaatcatcacctgatggtggcctgggtacaggtgtcaggtccagggtcagggccacttggtgggtacctagccctgagagtcactggccctttttccccttatgtatattttttaaggtttcatttgctttcttctgttttttaattttttttttgaggcggggtcttgctgttacccaggttggagtagctcactacagcctcagcctcccaggctcaagtgatcctcccacctcagcttcccaagtagccaggactataggtgtatgccaccatgcctggataattttaaaaagttttttgtagagtcagggtcttgctgtgttgcctaggctggtctttctaagtttttaacttgttcccaatacctgtgagaaaattaagttttagttacatctttgccttacgctcttcccagcagtcaggcctggtggcaggtgtcaagttgataagtcgtaaacctcttcctcacaactgcctataaagcaaagaaggggttgggagtagtgtattaaaccaacttagaaacggaatcatttgaagcagtgttttgtatgctgctgagagtgcagctcagttacaataaagacttgtcacctggtcactgggagcagtggctgacagccatgcagtttattagcaaagctcatccagccccaaggcgcctctggccacaaccagacaggcagcaaaggagtccagtgtccacagtgcttaccagatgtggaggcaggagctgaggctgggacttatatcttgcacagacctgttctgtgctccttcatgtgctggtttgacacgtgtaaattcccacctcaggccacatgctatctgtcctaggcctggaggcatagcagtgagcaaggcagagaggaatttcgattatctgtgaagacccagttaaacacatgctagtacccaacaatttcttgtgcaggaggtgctgtggcaacaattccaagtgtttttacagtgattataggatgttcttgtcttcctgtgcaggtcgtggccgcccacctacagagccgctgcccgacgggtggatcatgacattccataactctggagtcccggtgtacctacacagagagtctcgggtggtcacctggtccaggccatacttcttgggaacgggaagcatacgggtaggggaggcatcagtcgtgactttaggcttgtaagttctcagaccaaaacgtgcacatccacacacatggcaccgcagccaagcagaggccggtgaaaggcatcagagtttcagactctcgggttgtccttgtaatccatattgcaatttcactatccacagaaacacgaccctcctctgagtagcatcccttgtctgcattataagaaaatgaaggacaacgaggaacgggagcaaagcagtgacctcacccctagtggggatgtgtcccccgtcaagcccctgagccgatctgcagagctggagtttcccctggatgagcctgactctatgggtgctgacccggggcccccggacgagaaagacccactaggggctgaggcagcccctggggccctggggcaggtgaaggccaaagtcgaggtgtgcaaagatgaatccgttggtgagtttttgaaggactcttcccttcttgcctcctgggacccatgagctttgtttttctaatgaaggccataattgttcatagttcctagttgtacttgtgagcaaggggctgtgcacctccactgttggtgtggctgaaaggcttgtcttcctgtccttgcaagaacctgcctgggtgcagcaccctaggctcctgtctgtgggctctgtggtgtctgcatggctgaggctgctggggagatggctgctggcactggcagtgggccgttttctctctggttgtttgtatgatctttccctaagtcttgctttttcagtaggatgtgctcatgtggcattgttttgatttgtcttgatgagctcagtgagcctctttaatccatgactcagtgttgggaaactgtcaccattctgtggatagttccctcttcaatcctgcaattgcttgctggatgtgtactggtgtttcccattctctcttccatgtcttttagcctagtcccgccatttaagtcttagttctctcttcaggtgtggcaggtctctgtgaacccacctgctggattactttcaaagagcactttccattttctaggtttctatttgtctgtacatcactacccagcctgtctcataactccgtggagtgtggggtgccctagaagagcctgtgatgggggctgttgctgaggatggggaagtggcccgggaggaaatgtgacaaatgcgaggccctgtgcagggagctgcctgggtgtgttgctgactacagaggtggccaggatggccagaaggaaaagagtgaggtggtcagagaggtggcgggcgcatggagcccgggtgctgctggcattcgggcacctgttttgatacagggaggaagtcccgaaggccatctgacttttttaagctgtcttttttccttttcatttttgtattcttcctgccccaaataaagtaaaagaacatctcagaaattcatccagaagggacctgccagaataatctgagctggtgtagggaggccttcattctttgcttccctcccctttgaaagggacggggaaaggaaatagtgtcatgtggcctgggcctgccccatgcactgggctgtgagaacctgactcctatgttggaagttaagtaatttgtttctctggtaaatctgggacagatctcgaggaatttcgaagctacctggagaagcgttttgactttgagcaagttactgtgaaaaaattcaggacttgggctgagcggcggcaattcaatcgggaaatgaagcggaagcaggcggagtccgagaggcccatcttgccagccaatcagaagctcattactttatcagtgcaagatgcacccacaaagaaaggtataagcctctgcattttaacatcagcagactggttatgctgttatttctaatgtgatgtgttgagggcatgttttatgagttgcatttcgttcaaagtttatgtttatcccatgaatgcaggggtctgccacattcacggtcgtgagcccctagttactgacatggtaacaggaagctgtgtgctagcttgtggcactgcttcacacttgctgagatggttctttttgtcacagagtttgttattaaccccaacgggaaatccgaggtctgcatcctgcacgagtacatgcagcgtgtcctcaaggtccgccctgtctataatttctttgaatgtggtaagtctaaccttccccatttcagtcctaaagaatcacaaggtgtaactttggtcagggctggggaggcaggcgctgaccgctagccctactctactggaacgggaggaaagggaagggtagagagcagcgtgctgcagatgggtggcttgtttcctggagccgcgccccatctgagtgggtggctctgcttttcccttccagtctgtcccctctccccaccttcctcttgtcctgccccatctgccttgctggtttctgatcctgcgttgtcatggacagccttattgcgagcaaggcctccccactgtgcactgggtcctttccctggtctcctggtgcccctgggtgtctgaagggttcttgggcatgcatttcccaccagctctgtcttccttgggtgccctcatcacacctttgtgaagaccagtctgtcttccccttggaagctggagcctgggggtcactcatcctttgaggtggtgtttctttggcaagccacatcttgtgctttcccattccggcagtcctgtgtccgtctttcgtagaccttggtccctgtcgtaggaggctctgcccccagcctcctgctgcccctctggctcaccatctcccacgtgcctcatttccctccactttcccagctgtgccctttgctgctgcttgtctgctgcccgtctccagtcccagggagccccaggtctctgcagtcaagcacaggcccactctctgcagggacagcccctgactgcgccttgtctgtcggtgtgggcagactgtgcacacgcttttgatgtcttgactcgtatgttttaaaacaagtaattttaattttaagagaacccaagtgagccttttggtgcctcggtgaccattgatggtgtgacttacggatctggaactgcaagcagcaaaaaacttgcgaagaataaagctggtaacgtgcttgcttgggtgtcaaagatacgtgctgcctgctgtgtctgcctcgctgcttggttagggaggggctgagcagtggtgacaagtgggggatgtgggtggggcatgtttattttatttatgtaatcatctactttgatttttaaaattacatgctcattggaaaagactcaaatagagcaaaatgtgagacttaaaagtagaaggcctcggccgggcgtggtgtctcatgcctgtaatcccagcactttgggaggctgaagtgggcagatcacgaggtcaggagatcgagaccatcctggctaacacggtgaaaccctctctctactaaaaatacaaaaaattagccgggtgtggtggcgggcacctgtagtctcagctactcgggaggctgaggcaggagaatggcgtgaacaagcgaggcagagcttgcagtgagctgagatcgtgccactgcactccagcctgggcgacagtgcaagactctgtctaaaaaaaaaaaagtagaaggcctctctactgagtgacagctgggccagtatgtccctccctagtcctggccctgcacatattcaggggtgtgcctagagccaactgggctgtgctgggcacatgctgtagtgcttgtttgtttttaaactgagcagcatgtgggcatgccaggagggaggagaagcgggccagcatgctgttggcatcctcccccagtggtgctggctcttaccggcactatttcctgagtcctcccactccatgtttgggcctagccacacagaacacctggcacagcgcagctctgggaaggctgtgtgtcctggcgaagacccactgcccttttggaccatgcccttgccgtttgcattcatgccctgcattcgtggtagttgacattctttcacaaaaagccatttgcctcagcgtccagggttagttggcttcttgtagggtggtgttgggtgtaccccaggccctcgcacccacaggttgattctcgaggtatctgtcattgccgtgtgttttccagaaggcctgctgcccatcttagattctgcctaagagacttttgcagctcaacaaagggggtgtggtggaggttttgacagataacttgcagtggggccttttgtgggggtggagatgccttgggcgtggctgtgtgctcttccctctgcgggatcacccgctttcctccctatgtgctggaacccacttcccttgcccagactcttggctgccctatagacagcttggctccatgtcttgccagcactgatagctctgtggggtctatggagccatcagcccttggctatggcaactccgaccccagtgggcatatccgtgccctgccctctagcagctccctctagcgtctctcagacctggctgcatctctccacccacgccagccactgctgctgccacctggtctaggtacctgcagtagcctgctctcaggcctccctgcatggtccagggcccgcaaagctgttttctcacgtgccaccgaagtggttccctaacatacagctccgagctcctccctgcctgctcccaggaccccagggtgagagcgcacacacccagtgtggcccgtgaggctttctggtagcctgccacacgtctgggcttttccttctgtcctctcctgaccctgtcactgaagtgctgtctctcctcagggccctcgctcagcctctgagctgtggggatgggaggcagcagtgcacagttcactctgcagggtggtgagaagagggcagtgcccaagcctcaccctcgggctcttttttttcatagcccgagctacactggaaatcctcatccctgactttgttaaacagacctctgaagagaagcccaaagacagtgaagaactcgaggtgagtgttgtggtcctgccctgctgggagctgtgtgtgcagtgcggctaccctgccctgttagtgtgagctgggggtgtccgtgggctgtgctcatgccttccatgccctgtaggttagtctcatccagcctccaggttcttctgtttgtatttcataaagaggaaacttgcctgtctttgtataggcagggaaaaaatgtcctttttgttagagatttttgtcctcttttgcagcattgagtgtgcaccgtaaatgtcgggtacacataggtttgtgatgggaatgaatctttgaggcagtctacaagatttagattgttcttttttttgagacaaagtcttgctctgtcacccaggcagtgacagagtttgatcttgacccactgcaactttcacctcccggattcaagtgattctcccacctcagcttcctgagtagctgggattacaggtgtgtgccaccatttctggctaatttttgtatttttagtagagatggggtttcaccatgttggccaggctggtctcgaactcctgacctcgggtgatccactcgcttccgcctcctaaagtgctgggattacaggcattagccactgcgcccggccctagattgttctttatatacttgacccttgagtaacgtggaagttaggggcaccagcctctcacgtggtcgaaaattcacgcatcactttcagtcctcccaaaccttaactacttactggtaacctactcttgaccagaagccgtaccagtaacaaacaattgattaatacatattttgttatgtacatattactacatctgtccccaacctagttttggcaccagagatcagtttcagggaagacaatttttccacagacggtgttggggggcggggatggtttcaggatgactcaagcacatcacatttattgtgcactttttatttctattatcactacactgtaatatgtaatgtaatcactatacaactcaccataatataaaaccagtgggagccctgagcttgttttcttgcaactagatggttccctctgatgacgatgggagacagtgacagatcatcaggcattagatttgcataaggagtacacaacctagatcccttgaatgcactgttcacaatagggttcacactcctatgagaatctaatgctactgctgatctgacaggagacagagctcaggtgtaaaatgagtgatggggagcagctgtaaatacagattaagcttcacttgctcacttactccccctgcccccaccactcatgtcctgctatgcagcccggttcctaacaggccatggattggtaccagtccatggcctgggggttggggacccctgatatatactgtattcttacattaaagtaagttacaaaaagaatgttattaagaaaatcataaggaagagaaaatttatttactgttcttgaaatggaaacatcatcatgaaggtcttcatcctccacatcttcatgtcgaatagctgaggaggagggggaagaagaagagttggccttggtatctcaggggtggcagaggcagaagaaaatttttgtataagtgggcccatggagttcaaatccatgttgttcaagggtcagccatgtgaagaaccatttaaaactagctgtaaacctttttgggtaaatggttatttgtagcaagggcttgtggaattttgaagggtgcattcttatttatataatagctttattgagatagtttacatactataaatttggccttttaaactatataagtggatttttatatattcagagttgtataaccatcataactacctaattttagagtatctcaacacccccaaaagaaactccatacccattagcattccctcttagttctctccaaccaccaaaagccactaatctgctttctgtctctatatatctgccaactctggacatttcatattagcggaatcatacaatatgtggtcttttgtgactggcttccttcacttagtgtgctatgtcagctgtaggtttttatcagaataaggaaatttccttttgttcctggtttgctgagagtttttgtaggaatgatgttagattttgtcaaatgtttttctgcttctattcagatgatcatgtttttttttgtcttttattttagtaatatagtgtattatattggtttttgaatggtgagccaaccttgcattcctgggatatatcccacttggtcatgacatataatgatttttttaatatgttgctggattcattttgctggtattttgttaaggatttttgcatttgtagttataagcaatattgatctgtagttttcttgtgatatctttgtccagtgtaacagcaggtacaggtatcaggataatactggcctcataaaatggttggaacatgttccattttcttctgttgtgtggaatagtttgtgaaggattggtgttcattttttaaatgttttgtagactgcgttcagtgaaaccttctggtcccaggcttttctttgtccagagctacttaattgctaattcaatcttacatgttataggtctattgagattatctatttcttcttgagccagtgttgatagtttgtgtcttttttggaatttttttcccatttgatgtagattatctaattgattagcatatatttgttcctagtatccccatatgacccttttttatttctatatggttgtgatggtcccttgctgtcattcctgatttcagtaatttgaggctttcttctttttcttgatcagtaaattgttacacttgatgatacatcacaggtctctgaggctctgttgtttcttctctgtacttttttctttctgttcctcagtgtggattatttcaattgccctgtcttcaagtttgctcctttatcttctgttggctcacattctgctggtaaacccctctagtgactgtttcataatttctgtcttttttaaaaaaattctttattgggtaatgcattgtttttatactttaattctttttttttttttttttaattatatatatagggtcaggcatggtggctcacacctgtaatcccagcactttgggaggccaaggcgggcagatcacaaggtcaagagatcgagaccatcctggccaacatggtgaaaccccgtctctactaaaaatacaaaaattagctgggtgtggtggtgggcacctgtaattgcagctacccgggaggctgaggcagaagaaccacttgaacccaggaggtggaggttgcagtgagctgatactgcgccactgtgctccagcctggtgacagagcgagactcctgtctcaaaaaaaaaaaaaggaaaaagaaaaaaaatatatatatatatggggtagagatggggtttcaccatattgctcaggctggtctcgaactcctaggctcaagcaatctgcccacctcagcctcccaaattgttgagatgacagacgtgccactgtgctggcattatacttcagttctttagacatggtttcttagtcctttgagtatgttttctgtaggtgatgtaaaatctgtttctggtaagtccagttctcagagagcgtgtatattaaactgcctttcccttcatgtatgggctgtctctactttcctatttctttgcatatctcagaattttttgttattgtcaagaattggacatttaaaatatatggcaactctggaaatcacattacctcacctcccttaagtttatagtttttgtcatatgtccttgctctctatttgtgactgtatcagtttgctagggatactgtaacaaagtgtcacagactgggaggcttaaatgacagagatgtatagtctcaaagttctggaagccagaagtccaaaatgaaggtgtcagaaggctaagagaaggcctttctccgtgggtggaggatagcgatctccatgtccatgcctttctctctgtgtgcatgctggtctccacattgcccatttgatagagacacctgtctcactggattaggccctaccctaatgacctcattgtaatgtgatgacctctgtaaagaccttgtctccaaatactgttgcattctgagggacttcaacatgtaaatttgggggtgacagtttacctcataatagtgactttcctagattgattctgtgaagtgtgtattctttatgatttgtggccactgaatacacgggccctttagctgagtggtctcctgatgcttggacagggattttcgtaaattccctgagccagtaagtctcccggcctgtgatgagagctgtgggtctgtggggctcacctggtgtgctccggtggctgccaactgtcttagcctttgtgtgccacctgcacagagtctccaggtcagtcagctgggaggttttcctgggcctgtgcgcagtcatctccagacatacgctagagcctttcagagccccatggacatctccagcttttccttcttgggttcttggccagcctcttgtttgcccaactagtgccccagcctctggcagctgcagggtgaaacagttgccactggttccttttgacaaaagccctcaggaactgggctgttttcactgagtgagatcaaataaagacaaatcctgccatgaggcttttccagagggtggccaggtaaacccaacagtgacagttctctgggcctggggccttgaggacccgttctccattgagtggctaccactgagctggggagaagggctgggaatggggcgagttaagatgccagcaactccttgttcttagcaagactcgttgtctttcttgaatcaacactcctcagattgttgaaagcctttctttagtttccagggttctgaaagaattaattctgaccatttttgctagtgttcttgttgctttaatggaggagagcagattttggaggtccttattcggccattccagaactactttaggatgggttttgtaaagttttctcatctttgtggactggtgctgttataaaatatggttaagtgtctatggtagtactaacttgctcttaagtttcttgaactcctggcttcaagcagtcctcctgcctcagcctcccaggatgatgggattacaggcgtgagccaccacacctagtctcttgctctcaagtttctacatgttttctgtgctttatgtaactgcttcatcgtggacaggctacagacagattgcagaccacatgtggatcaagcacagtctccaagtactagctgttccaggaagagtcacatttgtccctttttttttgagatggagtctcgctctgttgccaggctggagtgcagtggttcgatctctgcttactgcaacctccgcctcctgggttcaagcgattcttctgcctcagcctcctgagtagttgggactacaggtgcacgccaccacgcccggctaatttttgtatttttagtagagatggggtttcaccgtgttggccaggatggtctctatctcttgacctcgtgatccgtccgtcttggcctcccaaagtgctgggattataggcgtgagccactgcacctggccacatttgattttatttctgagtgacccaaccgtgggaaatatggctcccagggaggcttccaaggccctctggggaagtgcttgcgtagaccctggcccaccaaaactcttagtatgggttgctgcagacgatggtgcctgagttgtgtaggtctcacgctgccttcctgtctgagtaaaagccctgcctgttctttgctatggggtggtggaaatgtccatgaaccactgtggtttctggtgccaggagagggcccagcggggagtcaggttctcagcctccactctggggttcttctgtgaagtggagaggctttgcagaaaccacattgcaaagtagtctgagaaagaagaggtttccccaggtggagaaggacatgggggtggggcatgtggtggcttccgctgtagactcccctgcctggggctttttccacacccctactccgatcctcccacactgcagcctgtctggagctagcgtcatatctccccaggtaaggagctcagtttcgtgggactgcccccacttcctgtgccagccgcaaatgggggcccctgccacccggcacaggacccctcctcgtgcttggaaatttgctaggactcaggaactcaggaaaaattttacttatgaaacttatttttcatgaagggctgaaagttcctcccctctactgacacatttgatttctccggggagcccaccctggccacctcctcagcataagctctgtggtggggtcgttttgaatcacaaaagacaaacctagcactcaggaaatcctcagggttttaagaactctgttctgggaacctgagagaagaccgtgtgtttttatgatgccatgccttggtttagggtgccttttgtatgtgcccctcctgagaagctctttgaccctcttatttgtatatatgtcatctgtgggctgggcgcggtggctcacgcctgtaatcccagcactttgggaggccgaggcgggcagattacgaggtaaggacatcgagaccatcctggctaacacggtgaaaccccgtctctactaaaaacatacaaaaaattagccgggcatggtggtgggcgcctgcagtcccagctactcgggaggctgaggcaggagaatggcgtgaacccaggaggcggagcttgcagcgagctgagattgcgccactgcactccagcctgggcgacggagcgagaatatgtctcaaaaaaaaaaaaatgtatatatgtcatctgtgatgtccccatttaaaaatctgtcagaggggaaagtagcttttccctccgttgtagggtggtgggggtgtttagacaggggtggccatctcctgttcctgggaagtttctatttgctggtcctccctagcgaggctctcaggttgtgtccccgccccctgctcctcccagctgcctgtgcagaggtgccaacacctgtccttggactgtcccctggacagcctggggcgtggggtagtatcccctccttgtgtggactccggaggtggggttgacatgtcaggaggggcgggttgatgcctgtgaggtgtggtggccacgcgtgtatgctacttgattaaaaagggaaaaaaggaacaactggcatcatttccttttcacaaagcttgtggtgatctcttggtattttgttgctagctgtgggttggtggttcatggctattaaatttaggtattagtgaccaagtgttttcttttttttttttcatcttattttaaaatttacatagagttaaattcactttttggtacagtactgtgagttttgacaaatacacagtcatgtaaccaacactgcaatcaagatgcagaacatttctgtacattccaacattcttctttgttggtcaaactctcccacctgtatcctctggtgggcactgaactgcccctgtagttttgccagatcctgaatgtcctcttagtggagtcacctggtacgtagcctttgaacctggcctctggcttggtgtggtgtgacgcatccgtcgtgtggtcatttgtactcctgagtgctggccaccaggtggctgtgcccctcagtgcgtctctccattcttccttgagggacactgacaggtttctgggttttggtgatgggcagtaaggctgctgtaaggtcgtccaggtctgtgtgtgatgggcggattcgtttccttcaggtaaacccttgggatggggttgctgggctgtgtggcaggtgcacgcttatgttagcattgccctcacacctttctcagtcactaggtgaccgtggaagtgtgtctgttttggggctgtctactgtctttcgagctgtgtgtccttttcctgatgccacactttcctgatgacttgaagtcttgatactgggagtcctccaacttcgttattctttctcaaaaaattgttttggctattctagctcctttgctgttccatgtagactttagaaacaatatgtcagtttctataaaaaattctgggctgggtgcagtggctcacgcctgtaatcccagcactttgggaggccgaggtgggtggattacctgaggttaggagttcgagacctgcctggccaacatggtgaaaccccatctctacttaaatacaaaaattaggtgggcgtggtggcgggcacatgtaatcccagctactcaggaggctgaggcaggagaatcgcttgaacccaggaggcggaaggtgaggtggcagtgagccgagattgtgccattgcactccagcctgggcaacaagagcgaaaccccatcttaaaaaaaaaaaaaaaatctgcctgcattttgattggaattgatcctgtagatcaatctggggagaatggacatcctaacaatattggattttccaaatcataaacatagttcatctgttcatttatttaggtcttctttgatatctttcatgggtggtcggcagttttcatcacacaggccctgtgtatattctactagatttatagttaaatattttatgtatggcactgtgatgaatagtaccttagttccaattgattgtttattgctagcttacagagctagaatttgttttatttgcactgatttattctagtagtttttctgtagattccttatccagttttcttctctaatttgttaatgtagttaattacgttgtttttttaaaaatgtgttcctgggataagtcctacttgggcatggtatatgttccttttcatgtgttaatggctttaatttgctagttccctgctgcatctgtgttcttggtgttaaggtcatggtacgggtagtgtcatcaagcgaagtgggaagtagccctcctcctgagtttttcagaagggcaggacagatataggattggtatcatttcttccttaaaatttgggcctggagttttcctaatgggaaagttttaaactactactgtatgaactactaactataactatgactactctgaactactgttgagtttcttgaacaggtgtagggctgttgaggctactgagatagtttgtgtcttgccaggcattggtccatctcatatagatagtggaatgtagaggtgtcgggcgtctgtggtgctcccacacggtcctttggcatctgccaggcactgattgcttaggtttctcctgtgctgtttgtcagaagcaacagggatttgtctgcaggtcacttctgccatctgtctgctctcatgagctggagcctccacctgtccctggcgggttaaccctcagtagcacatgtggcctcaggcagcttggtgcagggcatcctggtgtcggtcttttttttttttttttttgagacggagtctcgctctgtcgcccaggccggactgcggactgcagtggcgcaatcttggctcactgcaagctctgcttcccgggttcacgccattctcctgcctcagcctcccgagtagctgggactacaggcgcctgccaccgcgcccggctaatttttttttgtatttttagtagagacggggtttcaccttgttagccaggatggtctcgatctcctgacctcgtgatccacccgcctcggcctcccaaagtgctgggattacaggcgtgagccaccgcgcccggctggcgtcggtcttttgccagaaacttctgagcgtgctctctagctgtgtgtgtgtcagccactgcctcagcttctccagggccagtcccgaagccgtggggtatgtgggttcttgtgggccgacagcactggacgttgctaattggttggctggttgacaaacccttgaggttccagggcctgatgtcttggtgagtgaccttccctggaaaaagacccatgttgatttgtgcacttgagaggagcagtgtcttctggggacctatttgaagacagtagccaagccatacctcgaggatttttcgcttgccaacctcagggctagtgccttcctcttctatgcagttgcagcgagttggccttgctgcttgctggagcggcgagggcagaggagctgcccactgccctgtctgtagggccagtgtccctgtggagcgggcttggcacactgtggagcctgcacagcgaggcgtgtgaatcatttgattctaggtttcctcgctgcccatgggccaggcaggctccaggtccctgcagacccctccagaacagggccagtgggggaagcactgtgagggtgtggctgatgggtaatctccagtgcttcaaagtgtggtcttttttggaaagaggatgattgcagatagaattaggttaacatgagatcacactgaagcagagcagtggtgtgatccagtgtgtctggtgtttctctaagaagagggaggaggggcagggctagtagtccatatgaaaatcggagcaatgctgccatagccaagggatgccggggccaccaggagctggcagaggctccctagaggcttctgaaagaggatggccctgctgaggccttgatttcagacttcagaatggtgagagaataaacctcttgttctaagccactgactttgtggtatgttgtcacaggagctccaccagggaggttgtccatgctccagagtgggctggatagcatcttcctttcacccaggaggcactctcagcttcagccaaagtcctagtctgggaaggcacagtgggcaatgtctctgcacctcagcctgctgcagcttccctatgcctcactgtgtggaatctccccatcacctcttgtttccctgtctgcctctcttgtccttcctgtgtgttcttgggttggctgcagagccagggtgatgacactgttggaagccttgctgggctgggcctctgctggccacctggggctgggctctgtgtagctgtgtggggctttggcctttggggagctgggccttttaaggccagcttttgggtctggctgactttccctctcctgtagtctcagttgtggcaatagtaaagcctctctgcaaaggtgctttatctttatagagttctgagaagggtgccttatggatcagaatcagatccaaataaggtgggcctggccagccagccatgtacctggggccctcttaggataccagactccatcccacagtgctcagggtggaagggtgctgtgggctctggagatgggcaactggacggtgaggtacggagcatgtcttgtacccggtgggttccttgcagagttgaggtatgaagtgctaggcgagctcacaagaacagacattaagcatctggggaaagccaaccgcaggcccagccatgaagaggccggtgggcctggtggggactcacaagcctctgctttgtgttgtagtattttaaccacatcagcatcgaggactcgcgggtctacgagctgaccagcaaggctgggctgttgtctccatatcagatcctccacgagtgccttaaaaggtagggtaggggggtgcctccccccatgagtcaggtcgggggagctcctctctggcgtctcatattcttgtggctgtttgtcccaaggcagaggcatggccaggtttccctgggtacacagcagccccttggccctggccaccagtcagtcccacaggcctgaatcgggcgtgtggagaattccctcctctggctgagatgcagtctggggagaggcttggtcatttcctaagggcttcccagagcaggcctcctcagaggcagctggctgctctgctcaggggacgccatctgttgtctgttttctcttaaagaaaccatgggatgggtgacacgtctatcaagtttgaagtggttcctgggaaaaaccagaagagtgaatacgtcatggcgtgtggcaagcacacagtgcgcgggtggtgtaaggactccttctctgctgcctggtggccgctgggcgggcggcccctggtgtggccctgcgcctctgtggcttggtctcagctgttgccctggcattgtccctgagcccagctgtgtgtgctggccaccacacgttcagcctaaggcggactggcagccgtcctgcctgcactttccctgtcttttccctttcccccgctgtcacccctgtctccgtccagcccttgtccctgtggcaggaggaaaggccctcctcctcgaacagccagcagaatcctgctgctccctgtttctggaggtgtgcgtcttggcgggagggaggctctcggctgcgtggctttgagtggtagtgtcctcagctcctagactctgagggccactctctcaaggtggcagctgggtactgtgagactcaggtgcccagagcagtggcagagtgctgcctattcctgtagaatgtgccctggctggccctcggggtgtgggtcaggagggctgggagcggcagggggccccatgagcactgggtgtttgtgaccccctctccatgcttgctctttctctgtgtaggtaagaacaagagagttggaaagcagttagcctcacagaagatccttcagctgctgcacccacatgtcaagaactgggggtctttactgcgcatgtatggccgtgagagcagcaagatggtcaagcaggtaactggccatcagcaggtcccagggcagcctgtgctgccaccctggagcgtattcctgaggctctgtgctcagagggggcagagctgggcagctctgctgttgctcacagctgcctctctcctgggccacttgtgtggctttgtgggcaggggtggggtcgtcccagctacatctcctatcccagcctgctgggcatggtcagtgaagtgtgggtgattgggaacgcaggctgggcccagctatgtggcttgtagggagatggccaaagtgcaaggcagggccaggcaggagatgctgaaggtgcgcccggctcggaggtgtgcaaaggctcaggagccagggccagctctccctgcttgaaggagagcgagtgtgtcagggtagctctccctggtaccagtgccggtccatctctaacagaagagcatatgtgtaccatctgtcttgtttctgctgttgtggccaacatcctgcagtgtaagccagtgcccactcctgaggggtggagggtaacatggggaggtgagtgtaatcattttcctcaaatgattacagaaactctctgggttcttgccctcctggtcattggaaggggaagtagttgtggaggggttaggcctgcaggtggggcagccctaggactgtgtggtgggtgggccctctgcccaagccagctgccaagagcagggcctgcctttaggtccctgagaccgaggcctcggcactgtccccgaagaggcctttactctggacatgataagggagggtgagggggctcacacgggccaccagggcatgttaaggaacttgagagagatttttgggaagcaagttgaaatgtaggtagcacttgcttctgcccttgctgtgcatggtccttggctgtgacggagggagagaaggcaagccccactctggcccgggggtgggaaacttccctgagcaggagggggaaaggtcccagccaggcacagccacagcttgggggagctctggcatcccgaggaaccacagcacccttggggctggcctaagacgggaaggggctgaggccagcctgatgctgctctgcattcatggagtgtgcagagagctcagtgcctgaggctgatgggctgggctgcagcgtgctgttcttactggctatggccacactctggtttcactccttgatgaggactctgggcaccacgagcacctcacctccctactctgcccatggcaggaggccatataagtggcgtggtgtgggcagaaaggcctggcagctatggactgcccctcgctctctgctgctgtcagtgggcctggcatcactgaggcgggccagtcagcatgcagttatgttgccacagctcctggctgtttcgtgtctgccagaccctgggcgcgcctgccttcagggtcccaggcacacagctgctgggcagcgggcaggccgtagagctacagcctgcagtcctgagcgtgaggtgctatacttcccaggagacatcggacaagagtgtgattgagctgcagcagtatgccaagaagaacaagcccaacctgcacatcctcagcaagctccaagaggagatgaagaggctagctgaggaaagggtgagtgccaccctagcgggagggctgccgggccacggccattcctgtggcacctgtggagggacagcagaccccaggacccgtgcctgagctgacaccttggaaatgcttggatcctccttccaaaatcagatacaggcttttctttgagcttcgacatgtgtgatagttttataaatcacttcagttttggttctgttgttagagagctggcaggccagcctgttggtggaccatgaaggtcacagtcttggtgggccacctgagtcccatgtcctccctgggtgtttggaggtaggtcagtgcacctgccagggttgaatctgtagggcttggtcctgatgaagcctcctaaagccaccttgggaaccccactcaaagaggggcctgtcaggctggcagtggtgtcttctgtcttcaggcatcgtctgcctggccacggcgtgacctgcccacctgggccttctgggtgggagctttcttaagtgtggcagtcccctggcctgggtgagagccccaggaggtatctgctgccgcccaggccagcaggtcccttgctgctccctggggtggggcttggcctcctggagccagtgggactgcctggtttgcccctggtcggaagaggggctgtggggctcaagggcagcaggtgcaggacatagtgctcctggctgggcctggggcaagcaaaagctgggcaagggaggaacacccaatggggaggcctggcctgtccctgtaactgcacccaaaattcttcacttcttggtacatgtcctgattgccagggaggctgcacatgttgtactctgatggcaatgcagggggcctctgcaatctcaggctggcctgccccaggccttccctgctcctcctagcctggcatcacaagcactggtgccgttggggctccagggcctcctggcatgatctgctgggctctccctccaccttgtgtcttcccgagcctctgccaagcccacctcactggtacccctgacctttgttgttctttcaggaggagactcgaaagaagcccaagatgtccattgtggcgtccgcccagcctggcggtgagcccctgtgcaccgtggacgtgtgagggaggtggcacgggccagggcgcgggggccgccagccgcacttctgaggagaccagcagtcatgcatcgtgcaccacagtgtcaggcctccaacccacgctccttccctgtggccaacctgtgggcccggccttagggtggaggctttagtgtacagggacagccatggccacacagcacacatgtggagcagcggctctccctggaaagctccaggcctgaatggatggactcagcgactgcaccagtggcagctggtgactgtggacagtggtggaccctgcttctgtgcacctgctgcaggctctttttatgaaggctttcatgaattttagtatgtaatacgcactgacgacacatgatgcttggatgacagatgagaggggatggctgagtcctgtggctggcccgtgatgccaggtggcccatgtgcccagggcgcctgcagggctgctacagggacctggtcaggaggtgcacatggtgccctgccctcacccaccctctgtgtttccccttctttgaaaaggtagaagagaaaggaatattttaaacctttttggcttaaacagaattttagcatcagaactagctttctgggattggaggcaaaccatcaaggtggtccctctccagtctggacacgatgccagcaaggatgacgtcctgccacctcctggagttaccctggcctcctagggtccctttttctgatgaagtcttaattccctaaaagcgcctctttggacactgaggccctctctgcctttcctggcctccggcaacagttttttacaaagattttttgcagtcgagtccatatgtccacccattgatttttaaagcttttgtgatattttagcattttgaaagactttcacagtgagagtagaaggtagatttggaatcatgcattttagcaagtggacttgttgaaacaggaagcaagggccttcagtgtagcccattcttgatccagagctgttgcctgtgacagcggtttctctggatgtcaaaggcagctgcctggtgcccagcttgcttctcgactggtggcccctatgggtgggtgtgcgatggaaatgtgttcctgccggagtctgaggcaccagggtgtgctcaaaggctggccctggtggtggactggcacctgtgcagagtgccgtgtgcttgtggtgcgccatctgaagcaagagtccagcgttctgccgtgtctgtcccccaccatgccccctacaggcggtactgatggcgcttttttttttttttctgtcaggaaaacaatgttggcctgtgggccgcccacaacatatccttccctcactacctgtgtgaccaaggttggcttctgttgacctttaaaaaagaaaccctcaactcaaattgctataattagacacttgcttctgtcttgcctcctgtctgcagctgtgaatagtcatttgactgtgactgttgcccttagccagccagatgcgcctgtgaaccaaagcttcgtgcacatgtgttcccctaaaggttggggagcctcgctgtgtcttgctgttcccaggcaccaccacagcaggtgctgccatactcttgtggtctctgtgcgccccccccccccccccacccgtctgccaagcatgggtatgaatcgtgcacacagccatgcttcaaggccggggcaggggagcctgtgctgatgccatccagggcactgggctgtgcctggaaggcgagccttgattgtctgaacacataaagcaaactgtccagaagggaatggctgatgtctttattctgagggtgagaggctggcaccctgtggacccttgactggccagatcccctcctggggcctccctgcaggctggaccctgcctttgtaacagctgagcagcaccccagcatggccccttccttggttgatgccctctctgctgggctgagggccaggctggccacagaggggccaactctgcccagtgttctccaccccatgcccccagctggtgcagttcccagacctctctctgcctctcctcaagtttaagtatcaaatcgaacattcttttttaaagtaagctctgccctgactcccccagccatgcagagaggcttgcagagctgcctaggcctagtttggccctttccctggcacccaggccctgtgttcagacccctggctctcatcacagaaacaccctttgttgagcagttgtttattctggccctcacagccttggctagtccacaaaggccctggggatgggcaacaggctacaggaacccacctgtcttcctggtcagggcccctggcccctagcagcaggccaatcctggtggggcacagggttctgtgccctttggctgcctacctctgaatatcctggccagcaagccatgccttccccgcccctggggccctgggagcccttcagctcctgtccccataatgggtcctgggcctaggatgaggggaaggtcccagtttcttgtagggtgttatctgggggtcctggtgtgggttgagctggagggctgtggggccccaagacccctgtgccattggggtgctccaccctctcaaacaggatgagcatctcacagtgcggggtctgcgggaacaggtccactgccacagccttgaccggccggaagggaatgcccttcacccggttagatggggctctgcagaggctgtggggggaaaaggggggcgctaaggtcagccgataggctaatcaggggctcctgtgggagctgggggcttggtagcaggcctagcccccacccaggcccctgcagacactcactccacaaagttgcccatggctgcccgggggttgcatgagacgtacagcagccgcctgaggttcttagctctccggatggccaggatcaccttggaatctgaggaggcaaacaccagctgggtccccacagccagagagtgcataacatggtgagccaccccatgtgtcctcgttcccgtgccacctccttaagcaaaagccactcacgcaagccagcacggggtgggtccaggatggccacgaggtgctgggaggccagtctgctcaccagggtgggcaccaggtcctcggccctcccgcagtggaactccacattactcaactctgaagagatggcaccgtggcctgtcagagggccacatgccctcccagcagggccagccctggggaacccctagccaaagagcttgctcacttgctctacctgtcgggcagcccccaagccctggctgtggctgaggcttgcagcaggggtggcggctgcccccatccccacccccacccacggccttgccactcaccattgtcctgggcgttcacccgggcgtcctccacagcctctgggcatagctcgaccccaatgaccctctttaccttctgaaacaggaaagcgtggtgtcgccccacccagggaggggagtacatggggccctgtgggcagcaaagaggagctgggcctggggcatgatggagtcagctgtggtgactttgagctggggtcaatgggggtcttggggtggggagagggtgccctcagcagggcaggagggctcacccgggccagggccaggccaatggtgccggtgccacagcacacgtccagcaccatgctccccgcatccaattgggcccagtcctggatgactgtgtagagcacctcggctgcgggtgtgttcacctgggggcaggcggtgcccaggatgtcagtggctcctctcctgtggtgccactggtgccccgacgcccacattcctggtccctccatcctgccgggacctccggcgcccactccccaccttggtgcccaacgtcttccctgaccccaccttggaccagccttgctgatgccctcatccagcccctggctttaaaagccaagcccgtgctaagcacagcctcctccttgccccacttggttgagggctcatgaggccccgcaggccaataggctgtaccttccctgccccagcaagggggctttgcctcccacaactcacaccggggcccctggaatcacccaactgcagctcccacccccacacctagccctccaggaggtcctgccaggcctgtctccaaaaacggccgctccaggtccccacagccttcctgcagcagtgagcaaacagtgaaacagtatttcccagcccagaggccaccatggcctccctcctgccgagcccagagcagtgccctgtggtaatgcactgagggccactcctcatcctccctgtgacaagggccactgccgtgtgtacctctaggttatcccgagtcaaatcagtgatgaccaacctctttcttacttcaccctcccctgtggctcacctgcctggatactcccccaaatctcaccgcctgagcccactgttcccatcacgtcctgatggtgcgtcaggcctccctcaacatgtccccatgcccaccagggactcatggctacctggaagaaggcgtgtggagagatccggaaggtcagccctagcaggtcctcgtggatgcaccggtccccagccacatgctccaggggcaggccctcctggctaggagtctttctgtgggcgaaggtgcaggtccttcagtgtcacagtccctgcagggacctgccccgccccactcgggctccttaccgctgtccctcctccacgaagtagaggcaggtcactccactggccctgcctggccctgctgtgaagtgctgcgctagggaggtcttcagctctgccagctcctcagggctcagcttctggagtaagtggtgaaaagttcccatcaggctgtgctgaggcccacctaggctaggcaccctcccccagcagggcccccgttgagacctgggggtggaagtaggcaatggccatggcctggtggcggcggctggtgcgcacagtcagctgcttccagtggcctgtgtacgtctctgggtcgtatgccgagtatggagtggacctgtgggaatcacgagctggcccaagtgcccacaactgggcaagcagtccccctgctctctcctctggccacaccttccttcatctggctgaaatggcaggcactccagaattcccggggcaggatcaccaccctctgctcccacaccgcataggacttcccgggagccccgtcacaggtcctcaccggatgaactcctggaaggccttcaccacctgcttggtggcttcggggatgtgcacggtgtcaaacggggctgccacagcacacgtcccgcccttgtacttgccgagccgacagcccacggtgttatcctccccatccaccccgacgccaaccagaaactcacacttattacgatactcagtctgcagggagagagagctgcaccttaccctggctgcccagcgcttgggcctggaaaccctgatttccccacaggggctggcagtcaaacaagaggaacagctgacaactatgtgatgttaccagaagaaaacacaaagcagggagatcaacaggaagggtgagcaaaagcaaagtttttcaaaacccaggataggggtttgtggccaccgaagtctagtctgacctgctggggtgatggcctgaccccctccagcgggcagcaggccttgttgtgcttgtgcctctgctcgagcagccagggcagcaaggcacggttggtgctcccgatttccctgtaagaggagcagatcggtggttggactccacctactgcccccgacccatgccaggccactccccaaatgtccaggctcctgacccctcctttgggatgtcattgtgcccactgtgacgtgggtgtcttgctggctagctcccaaaggggccgccagatcctgtgctgggcctcccaactggtgcatggacaggctgaggaagcacaggccgggcagagccctggccaagaggggcgtcttgcgcccacactcacttggcaagtttctgcagcacctgctcgcactccagctgcttccgctcaagctgctcagcatagggcactgtccatagaggggtcaccacgtcggccactcgtgttactggtggctcactctcaccctcctgtcgcctcctcctggccatggggtcggccttgggccgggccaggcgcacactgagtgggcggcctttccagagggcaccatgcaaaacgcgcagggccttgtccctctctgcagcgctgcggaatgtcacaaaggcgcagggtggttgcccaaagagtttggttttgtggggctgcagaccaaagcggcccaggaagcgccggacgtcgctgaagctggcgtggcgaggcacgttctgcagctccagtttaaagatctcagaggtaaacaagtcatccctgatgtagctgtagagcccgggctgaggccccggccctgtagccgccccagcgccctctttctccacctcctccagggctgccggggctgcagggggcaccgagacggtagggcagctcagggcactgctgctctcctggccacagctctccatgggcttcgggccctgtgtggggacagatggggtgctagggtgaggactaggccctgggggcctggccccccaagcttccttatgggacacccagacctccgtcggtgcactctgcactcagccctgcccctcccccagtctaccctcccgaccccattcccgtctcctttcctcccctatcgcacctgcctcgtccccacctattctctggcaggtttcctgacccaccccgcctcctcccaccccatccccgtctctacccagcgtctccccgcactctacctcgttgtcgaggttctcactcatcgcccaggcggttctccgcctagaccagggacgccatgggggccgcctggccacctcgtcctgggcctgtcacaagggaagtggcctgtcacaagggaagtgctcagaggggaggtgctcacagagccggtgcaacgccgcgaggtcgccgccacccccggcttcgccccaggcggggcgggactcgaacctgcgatgctcaggtccgggtctcaggcttggggctgtaccgcccgcccgccaggggcccgcgccggccgctcgcttcgccagccactcttagtccgccagcgcgtgcggcggaggccgagcgtctctatgatcctggcttctggcaacgtcatcgtcacgcgccggatccaacccccaaccactttagccagctctagaggcgcgcgtggccgggacggaagtgcgcgcgggtgtcgccgggagtgcgcgctcctctggctgacgggcgggccgggcatgcgccgcgggcgttttggcgggaagcgcggggcgggccggacaatgagagtgtccgcctcctgagccaataaagctgtactggttttgaatcgcggcgcgtttcccgccgctggggtcaggggtcgaggttcgggtcgtggggcggagggaagagcgggcgggcgggaggcgccggcgccagacgcggagggaaggagctacgagtagccgccgagaggccgcggagccagcgacgaccgacccagccgagccgccgccgccgccgcgcccccatggcggccgccaaggtgccgccgggcccaagcggggacagggtgggcgggcggggccggggccgttatcagcggccacgtgggcggcccgcgccgccgccaccaacctccgccggcctgcaggctcggccgtctgctgggcctcggtggcgcggagtcggggcgcgtggggtttgggggctcgaggcctgcggagttggggcgtttgggggtgcaggctctgcagaggcctgggggctgcagggcccccgcgtgaccttggggtgggttggggagcggccgtcgccacgcgggacggccccagcctccaggaactggtgcgggcggcgggtttcctccggctcggcccacttggggctccccactagtacggtgcatttattctttccgtcgcccacgcagcacttcattcattcggttcttacgtctggaaccgccactggcctctgtggcagaagctcgcgttccagcgtggggcacaggtcctagatgcgccgacccaggcggcggctttgttggctgcggtgtctggttgagtgcgggccgctgcagagccgcagtgctgtggggaacagtgaagagcagcgaaaagcttatgttttcttttccagtttgagtctagtggtgaagtcttgggtctcttacggacttctgggtgaccaaggcatgtgttctggaagactcgaacctaaaatatgattattggtgctctcttatcctctaaattgggccaggatttcatgactttcaccggtacaatttatctagttattaacttagttttctgaactgtgaaaaaattgctggcagagctgtgaatccagtgtaaatactagcagtcctgtagcgacttttttcgttttactaagcaagagcacaactatttcctaattagtcaaaactgaaagagttacattttgctttaaagtaatatttcaaaatctatttcgacccatcattgtgtcctttgatcttcacacagcaggtatcatctgcattttatggatgaggaagaaactgatgctcaaagagatgaggcagtttctgccaggccactctctgcaagtgttggcggcttgtagggtcccccatcagtctgtgcacagatctgattgatgtctgtgaatctgggggaggggccccaagttctggtgtctcactctgtgctcacatggagctgggcataaacgcagagctttcctagtgtggaagagtgggcctaatttcttgctttggggttgggcccatccttgtatctgaagtcccttcattgtcggagggctgaccactgcaggcactggttgggctctggttgtgagccagatccataggccagcagtgtaacctctttgtatctccacaggacactcatgaggaccatgatacttccactgagaatacagacgagtccaaccatgaccctcagtttgagccaatagtttctcttcctgagcaagaaattaaaacactggaagaagatgaagaggaactttttaaaatgtaagtaggctgatgtcccagaaataggactctttaaggttgaggttacaacttttatgggtgtccaggttttggcctgacttttaatcagactgaggctgcttaaagaaagggcctaaagttggtgactaatcccatgtggaaatttaacccgttcctttcatgaatcttcaccagatgcccttgctgccctgcagccagttgcatgaagggcatcccatcttgctgctctgtccactggcatggcggccccactgcccttttttgccactggcttctgaggatccagggagtcccttggttgagcagggggttttaagtttttgcagcatagacttctttggcatcgtgaagcttataaatcccccacccggtgtctgttgttgttgttgttttgagatggagtctcgctctgtcgcccaggctggagtgcagtggtgcgatcttggctcattgcaagctccgcctcccaggttcacgccattctcctgcctcagctggaactacaggcacccgccaccacgcccagctaattttttgtatttttagtagagacggagtttcaccgtattagccaggatggtctcgatctcctgacctcatgatctgcccaccccagcctcccaaagtgctgggattacaggcgtcagctaccgcgcccggcccacccttaatatacaacatgatgcttgcgataacacatgaaaataggtgatggtttagttattaaaaccacttaaaaaaattctgtacatgtgcttcttgacgctttcagttaagagctggctacagtggtgggtaccagccttgtgtcttgtgacagtgtcacagcaccacagagactgtggcctgtcgcctacactcaggattgcaacaaacatcatgtttagttacacacctcagtgaaaatgaggttgtagtttttccctgttcaagttcatggaatccccccatccttgaagttgctttaagagtccaggttaaggttttgttgctctggggtgggagagggaagcagagagagtcattcctactgtgagtttcctatccaaggaagggggccaggagggatacctgggaaaggagagctgtgtgtcaccctttggtcacagagggtgatggacatctccctgaaaccactgggtggccatggctccactctgctgatgcattgccgtagcccctgtttgggagtagctctttgctgtggtgaagtgcttgcctctgttccctcactgcccatgtcgggtgggaggtgctcctggtggcctgggcccaggcccttcctgagggaggtgaggccagcagggtgggcccgggtctttgcagtaaagctccaggggcatcctgttggggaaccctgtgagacagtctcttgccagaatcatgttggggcagagagcagagtcgtctgagagaggcaggcagagctgtgcacagagggagggcgccagcctgagccctgagtgcactgctggattctgggtgccctggtccccagcgggaggggctgctcctgggcaggagggccaggtgttggccagggcctgttgcctgattagaggcctgggcctcttctctgggtcatctgacctcagatgacccgcccgcctcagcctcccaaaatgctgggattacaggtgtgagccaccgcgtccggtcatctaattctcttggttgtggaagtggaattcaagatgacctggagttttttgggctgctgtgcttcctggtggtgtcgtgacagaggtccttggcctgcacctgatccatgttgtccctgcagatctctggggctggggtgctcttgcacagtgaccatgggacggagtcttgctctgttgcccaggctggagtgcagtggcgcgatcttggctcactgcaacctctgcctcccaggttcaagcaattttcctgcctcagcttcttgaatagctggggctataggcgcatgcctccatgcctggctgattttttgtatttttagtagagatggggtttcaccgagttagtcaggatggtctggatctcctgacctcatgatccacctgccttggcctcccaaagtgctggaattacaggcgtgagcccccgcgcctgctctctcttttttttttgagatggaatttcgctcttgctgcccaggctggtgcgcaatggtgtgatctcagctcgccgcaacctctgcctcccggcttcaagggattctcctgcctcagcctcccgagtagctgggattacaggcatgtgccaccacacccggctaattttgtatttttagtagagagggggtttctccacgttggtcaggctggtctcgaactcccgacgtcaggtgatccacccacctcagcctcccaaagtgtgggattacaggcgtgggccactgtgccctgttttgttttgtttttttttaaaatagggtctcactctcacccaggctggagtgcagcagtggtatcatggctcactgcagccttgaactcctgcgctcaagggatcctcctccctctgcctcttgagtagctgagactacgggtgttagccatcatgtccagctaatttttatctttttgtagagatagtgtcttgctatgttgcccaggctggtccccactgagggaaatattgtgactgtaggagcagtggggcaatctccactcactgtatcctctgcctcctgggctcaagtgattgtcgtgcctcagcctcctgagtagctgggattacaggcgtgcatcaccacactcagatgatttttgtatttgtagtagagatggggtttcaccatgttggccaggctggttttgaactcctaacctcagatgacctgcccgcctcggcctccccgaatgctgggattacaaatgagccaccgcgcccggtcgtctaattctcttggttgtggaaccggaattcaagatgacctggagtttgttgggctgctgcgctttctggtggtgttgtgacgggcagttcttggagcctgaagaagggctggggcgttcgtggaggcatggggtcctgcagtgcagagttgtcctgtgtcctcctgcgcaggccctgcatgtgggctgcaggtctgcactcttaacctcacggcttttcttgcaggcgggcaaaactgttccgatttgcctctgagaacgatctcccagaatggaaggagcgaggcactggtgacgtcaagctcctgaagcacaaggagaaaggggccatccgcctcctcatgcggagggacaagaccctgaagatctgtgccaaccactacagtaggtggcatgaacgaccacctcgacagtccccagcagcttggcctgggacctttgggaagattcagggctgattgggaactggggagcgtgttatttcatggagtgcaagtttgtggtgtgtttgttgaatttaaaaccagaaatacgtttttcagacgtgcctctgaactcagagcaggcccgcagcgaagcttagagcacacgggggtgtggagtcagccagacgggccctgatgggaggacgcagcgcccaggctgggctcgggacgaggagtgagtgctgcagggcgagggggtgctgtgtgtgtgtgtgtgtgtgtgtgtgtgtgtgtgtgtgtggtgtctggggggtgggggttggtgtctggggggggttaatggggggtatgtgtagtatctagggggctgtggtgtctactggtggtggtgtataggggtgtgtggttcggtgtgtgtggtgtctggggcagggggctgtgtggtgtctgaaggtgtgtggtgtctggggcgggggttgtgtggttgggtgtggtgtttgggggtgtgtagttggtctggtgtctggggggtgtggtggggtatgtggttgggtgtggtgtctggcgggggtggttgggggtgtgtggttgggggtctggtgtctgggtgtttggtgtttggggtgtgtatgtggtgtctgggggtgtgtgtagtgtctgaaggtgtgtggtctggggggctgtgtggtgtctgaaggtgtgtcggggcatgtgtggtgtctgaaggtgtgtggtgtctggggaggtgtacagtgtgtggtgtctggggggcgggtgtggtatccggggtgtgtgtaggggtcatctggtgtttggtgtctaggggggtttgtggtgtctaaggggtgtggttgggtgtgtgtggtgtctgggggtgttggggtgtgtggtgtctgggggtgttggggtgtgtggtgtctgggggtgttggggtgtgtgttgtctgggggtgttggggtgtgtggtgttggggggggtgtgtggtgtctgggggggtttggtgtctgagggggtgcggtatcgcggtgggggtgtgtgtgagagagattgggggtgttcgggcagtgtaagagcagatgtgtgaggtgcccaggcaccagcctccccagttatggtgtgttctaccctcaccaggatcttcctggggaggaaacgggaggggaacggggctgagaaggtggccaggtcctgggcgcctctgaagctacataagtagaggcccttgggcaggttcagccaagagctccagccaccctgtgaggggtccagcctggcctgcaaagaagtggcagtaggttgtcctgagtatggctggctgccagctgtctttagattgaacctgcactgcccagcttgttggcatgtttggaagtacacttgtcctggggtgtcccttggtaagcttcctagtgtcgtttgctgagtgtcatgcgtgtccggcggggcagggtccctcatcccaggtgcaggatgactgctggcaggagcctgagtggctcagcccttgagggcgatgcagaggggtgggtggtggtctgcctatgccatgggcacctcactgcacggcctggcctgccagacttccttgggaactggctcctgggttcccctccctccctgctcagcatgtctagtcctggggaagcttgcactctggctggtcctcctcctcgagccgtttgaatcatttccttgggggtcttccctgatgccctgtgctgctcccagagcctgggtcaggttgtgggttgttgtgtgtgcatcataagttggttctgggctcctgggcatctgggcagagccatctgtgtagccagcagtgtcttgtgcccatcatgggcccttggtagacagggaaagtggcagtgggtagaggctggcttctgggtaaggtgtcgaagaggctgtgggctgggtcggggcggggtgtgaagggggcatgcagggggcttggcatccgctgtggcaggctgcagtagacgagacccccccccagctcccagttcagatagtgacgtgtaggggtatcctgggggtgcatgtggcctggactgggcatgggcacctgggatggtctgggttctcagggagctgttctgaagagtggtcacctgcagggccatctccccttggggctgcctgtgcctggggagttggggtggaggcgtccattgcaggccgtggctctgtctcctgtgccctccaggcttcagtcatggggatgcaggtgggcactcctgcatcaatcatggggatgcatggccacggcccccagtgggctcccttctggcaactgccccactttctagccttctgctgccccccactttcagataggctggctctatgtgttgggttcccttaggaaagactgggccccctgggccttgtgccctgatatctgaccctgggcttctgacttcacggccagggtcagaatcaaggggatcagggttgggcttgagtgcagccctgggatacagctggggcctgctttgccagctctgcttctctgcatttctggaggtgggggtctgtgtgccaagtgatcttgaacacagctcaggagctcctcgtggagatggccttacggtcagggaacaggtgcccattcctatttaggatggtcctggttttaagtgaatatggaggattttcaaagaggtttgaataaaactcaggcgccgtggtactttgtctaagcctggttctccaaccccagactgtccccgtgttgtctgaagcagacccctcaggttggtgagcagggtgctctgtggccgagggctgggtgggctggcctttgcagtcatctcaccatcttcacgagcttctctctcttcagtcacgccgatgatggagctgaagcccaacgcaggtagcgaccgtgcctgggtctggaacacccacgctgacttcgccgacgagtgccccaagccagagctgctggccatccgcttcctgaatgctgagagtgagccaagggccctggggacctgcctgacttggggctcacctgcgtggcagcgtggcgggttatgtgcaacaaatgctgttgccttttggggagagggggcagtaactgggaagtgtgtcgtgtgggctgccctgccctgctgtttgggggccatgcccagactgaagccatgagcagcgccttcccccttaaactcaaagctgtgccaagtagctggtgaacagcagtgcccgctcagccgccttgtggctggcactttggtttgctctccaagctccggttcccattagttgttgcggagcctgaggcccaacccagggcttcctcccagtgctgatcctcgtgccaggcttctggttcactggggccaggggcccctcatggttgcctgggtgccagcaggggctgggcagagagatccacaggcccaggctgatctcttccctgctcagaggtctttccagtccagatcgtccaagctgcgtccagtggctcctggaggagtcagtgggtactgtggcctggcgcctggtagctggccgtttggtgccaagtgaccttgtccttgctgtgggcgtggctgccccagcagcctttccaacacggttgggagccgagcctgtggcaaagaggcccatgccccttggttgcctgagggtccgtgctctaccgctctgcccaaatgggtgcagtcagatgaaggagacagaaggccagggccgatgtcaggtggaccagtcctttcttaggtcagcaattaccatgaaatgggtcttctgtgaatcctgactcttcagacccggcagggcatgtctcttccactgctcacagctcttaggaagtcttcgctctcccttccacagatgcacagaaattcaaaacaaagtttgaagaatgcaggaaagagatcgaagagagagaaaagaaaggtgacgtggtgccatgggttggggggcttctttgcagactcactctgcatctgactatacttccaggcgggtgctttttctgtctgccagataaacattccagggtgctgtggccgcctcacgtatccagagtgatgcagctccctggggacacaggtgcttcctggggagccctgagcacttgtcagtgttgctggcctcagtccaattgggcaggcattggagtccgggcactgcctggagctcaccagaaggtgctttatgatggtcctcggtttgtctctcagagggcttggtcacctctgccatgaggctggactgcagctgtggtggcaagtgaccagatgtcactgagcagcctgaccatggtctaggcagtgcttgagtgcatccacctggcttcctttcgtcactgaatttcaagaagacagactccaggaggcggcttggccaggcaggagtctgtcccgagggcgggcaagccgctgtgggtgggtgacggcacttgggaccagcctggcgagggccatgtgcttgaatgcaccgtgcttctgttttctcactgtgctgcttgtgtttttagcaggatcaggcaaaaatgatcatgccgaaaaagtggcggaaaagctagaagctctctcggtgaaggaggagaccaaggaggatgctgaggagaagcaataaatcgtcttattttattttcttttcctctctttcctttcctttttttaaaaaattttaccctgcccctctttttcggtttgtttttattctttcatttttacaagggacgttatataaagaactgaactcaacattcaggttgttttttttttttgtttctaagtttttgccctattgaagatgacttcagaaaatccattccccagtcatgaaaatgtactgtgctaactttcttttccatagtggaaacacttatttatagtcatcaaaaatagtgaataaaaaacacatttggaacctgggccagatggcaggactgtgtgtgtacaggcccctgcgctgtgagcgccgctcgcctaagcctcccgggtgtatgtccaggcctgtccgcagcacaggtgggtgctgcacctcacggtagcctgggttcctgggagagacgccctggtgtctgaggtcgtgcatgtatcttgctgtgggccttgaagctgaggtgtctgagctggcgctggtgagggagcctggccaggggtgtctggtgccgggtgtggtactgatgcacgactgtgggctgggcagcgtgggctctgccgaggcaggctccactgtgccttatggcctgaacagctactgctttttttctatggtgaggaggggtgggctttctgtgttttgaggagagaaaggaagaccactggagtaccttggctttggagcagggaggcagtagccaactgagcagagtctctagcatcggccaaggctgactttggcccctgtggcagagtggcccctgtggagggaaaggccagtctggtgtgctgggggtgggggctcggccctgtagctcttcttttggaaagcctattgtaccctggccttggagaaaactggggtcttggcctcctggacttgaagtccacacttggcagtgttggagttatgggcatctgcagtaactttaaataaggagatattttccagtacgccattgggggttgtcatgtgtaatggattgtctctgcaaataccatcttaagtgtgtggtcccaactgccataacgtgccctgtcaccgtttgtcatgaacacctaccagacgtgcttactgtgaggctggctgcctgctgccatcacttgctctttcgtgccctccacctgggcctgggccctgttctctctgacctccgtgtgctgtgtcctgtctggtgactgcctgctggtttaaacaccagtcctttgtctctctggggcaggggtccccaatccctggcctgccgaccggtacaagtctggcctgttaagaactgggcaacacagcaggaggtgagtggtgggcgagcgagctttaccacctgagcgcctcccctcagataagcagggcattagattcctataggagtgcgaacgctaacgtgaactacgcatgtgaggaatccgtgttgtgcactccttatgagaacctagtgcctgatgatctggggtggacagtttcatcctgaaaccactcccccacccctggtccatggaaaaattgttttccaccaaactgatccttggtgccaaaagggttggggactgctgctctgggggatgtacttccaaagtcaactactctcaggtttgtttatttttacataaatgggaaccactttatggtctctagcatcagccaaggctgactttggtgggtccctgtggcagagtggcccctgcagaggaaaaggccagctcaggagagaaggctgtgccgactcctcatggtttccagtgccctacatgttcagagaaacgtctttggtaatgaactatggaaatggtccctgaaggtatggtctttgctctagaaaaagcccaactgatgactcctcactggcatcttgactgtgttctgtgagctgtggccctcatgctcatggactgcttgcctccagcaggttggcagggggacagtggtgcactttgcacccaagaagaggtgaagcctgtgccctatgccctgtgccgagtgaggtcctcgtgttgggagggtgacgccgtccactgcagatggtgccttgctgtgctgcactcttggtgacacccggggccccaggtcgggtacaggtgtcagttggaggctttgatgtctgtgaaagggagggccccttgcactggctggagcttccaggagagaagcccttggctaggacaggcaccccccagcacagaaaggatgtttagcattctgtatttgatttggggttccaataaaattccaggctgacttccttcatctggggatgggagaaatgtctccaagggagagtccccagcagtgagaaggcccctcggaatggctgggagacagtgccatcctgtggtggggctgtgttgcagggtgcatttgaggatgcagcttgttgacactgcaggatgcgatggtgctgcgggaagggagctgtgctgggagacagaatgcgtccgcgtgctggccccacgggaccacagggtaggctatacaaggacgcccatgtgggcactcgggccagccgtccagcccagtgtgtttccattggcttccctttggcagacaatggtgagcagaatggggtcctgccggtgctggggactgtgtgagaatgcagtgtgcttcagccttccatcccatgtctgtctgccgggctgcaggctggggagcctcctgctttctgcttcattttccttttccctgggatcttagctcttcttgaggaggaaactaggccatgggcttggcagccatgttgggtggggaggccggtgccaacctcgcttggttctctgtctccagtagtgggtctgcactacttgggacccctctgcccaggcctctgtgttaaggaaaagggatcccaaggccagatgcaatggttgacacctgtcaccccagcactttgggaggcaaacgtgggaggatcacttcaggccaggagttcaaggccagcttgggcaacatagtgagagaccctatctctacaaaaaaatataaaaaaaatagcctggcatggtggtgcacgtctgtggtcccagctacttgggaagctgaggcaggaggatcacttgaaccctggaggttgaggcttcagtgagccatgattgcaccactgcactccagcctgggtggcagagtgaaaccctgtgttaaaaactcaagggaaaagggatctcaccaagtaggcctgattccgcttcttcccactgtcagcatttggcagtttactccagggttcagctggtggaggaaggtgacagtcctggcaccctgcacagagcatgggcatggagtcagacctggatcctgaggggctctgtggcatgtgccactagaggaggcacttcatgggggaaggtaggagcaagggcaaggctggagatgggcaccaggtggcaggtgtgttgccaactgagaggctcacttgtggccactgcagagcccaggtaacgagccatctgctccagtggtgtctgctctaggctcaccattgtgccctgagacccctccactgcctcagagctaccatcagtgcttgggagcgctccaggctgcacctcctggagcagggcaccctgagaacagagcttaccactacggctgcctgggagaaagcccatcaccatttctgctgtgcagtagttagttgcattaagggctgggtcccggccccagtcctgggttcctccttccaatagccacaaccctggcctgcccaccctgaggagctgcggccgggtgcttccccaggggagcaggggcctgcaggccaaggagcctcatgcctgtgccgcagggtagggccgctcggggttctggttgcagaggagcagacactcagggctgggggcgatgggtgaggtccccccacagatctccacctagggaggggtctaatgggtctgggcttcagaacaggggacgctcggggcatgttggcgtggccgaggacaatgaccctcactggggacgctccggagcttgactgagggtctcccgctggcaccgcctcctctgccggcgtgtgtgtgtctgggggggggacccacacgaggccccgccccaccccgcccacagcgccgtcggccccggcccggtccaccttaagcggcggcggggcgggtgggatttcctgcgggaggagacgcgccgggcctatcgggcagggccggggcgccgggcttcccaaagggccccgcctcggggaggatgggggctccagccgaccgtctctcaagcctgcagctcgggccaggacgtggagggcccggcgcccgctggccgggctcctccagcccagtggcccgagggagggctgcgaggcggtcagaaggcaaacagccacgacgccgctgcggtgtcacacccgcgccccctcgtgaattccaaggggcttcagaccagaggggtcgttagggaaagggctgcgcccacagacgcccccgaggccacctgcacggctccgcggcccgggaccaggggggcctggccttcgccgtggtgcccaccacccgggccgcaggggtgcgtgggtgcccggcccccgagagccgcgggcgcccgccgggctggggtccccgaggccgcggggtcctgccccctccgaaggtcccgcgaaccggtggcggtccccgggccccatcaactcgccccgcccggtcccgccccgccgcggcccccagcgcccggtccaccttaaggggcgcgctgacataagagcgcagcagccgccgccgcccgtggggtgggatttcctccgccgccgccgccgccgccgccgcgggtcctgcgccgcgtccagcccgcccgcccgaccccggcccgaccccggccggccctgcccgcccggccccggggagggatgcggcggcgcggcgcccaggatgccccgcagccccgggacgcgcctcaaacccgccaagtacatcccggtggccacggccgccgcgctgctggtcggctccagcaccctcttcttcgtgttcacgtgagtcggcgccgcgtctgggggcacgcgggcagcgatgggcagggcccgcacagcccgggcacgggggcagcggtcgcgggggctggcggggccccgggcagtgggcgggcggggcgccggctgcaggcgatggcagtccctctccacccgctggggctgggggagttgaagcggtgtgccggcgtcccgggcaccggggtgagtcccttgtgtggggacaccagtgcgggctgggcacctcgggagtgtccaggcaggccctggcggggagcgctgggccctggcaggggaggaggccgggctgccctgggtgtggctgcagcccttccctccccatgggacccccgaggggacgtgggccacccacaaccatgagtcttctctgcaggtggccgtgggtgcctctcgggtctcctcctggctgcccgccccgggccagagtcaagttgttcccacgtaggtgtggcctggcctcgttgccacgtgcctgccccacagccactggtgacccgggcctggcccttggcctccttctcaggaagacccagtggtcatcacagctggagggcccaggccaggccacacccagggcccgatgttagcacatcacctccgtgggctggccatggtgcacaccaggacccttgaggtcctgtttctgggagtgagagcccgcgcctgcaggacactgggcccctccagcctcaacttcttcacccaagatacaggctggcttaggaccagagaggcatgcggacagcacagcctccctctgtggctgtggggtcaccccagggctccttcaggcacaaggagggttgggggctccaggcttcggttgcacagatcttcaaccacccaccccccttccaccaatctggggttgagacatagcccaggtggcacgaacgatggccacctgttccaaggtggggccacccctgagcatgtgagcctggagaggggcaggtaggggctgcctggcgctcgtcacctttgcaagagtttggggggcccccacgtgcatcgcaaggctgaatcgggtgcccgtggaggcgagagagttacctgcaggctggggctgggtgggcaccgcaggctgccaagagcatgtttaaaaaaggcctgtgtggacgggcttatttctggctcgggcaagccagtgtgttcttgtcacttagttgctgctggtgtggggcagagagaggtgggtggggggcagcctggggagcctggcctggggggacacatcccaccaaggcttctggaggggtgggcccagcccagtgctggtccccagggcctctgtccttgggcggggggtctggcttggttccttactctgtccatgcaattcagtgtcctttctcatgactttaaaagtaatgtgtgggccgggcgcggtggctcatgcctgtaatcccagcactttgggaggccaaggtgggcagatcacctgaggtcaggagtttgagaccagcctggccaacatggcgaaaccccgtctctactaaaagtacaaaaactagccaggcgtggtggtgggcacctgtaatcccagctacacaggagactgaagcaggaaaatcacttgaacccgtaaggcggagtgagccgaaatcgcaccactgcactccagcctgggtgacagagcaagactctgtctcaaaaaaaaaaaaaaaaaaagtatgttctttatggggaacttgtgaaatacagaaaaaaaaaatgctaagaaattaaaatcaaccccacacaccccccatctcctgtcctccttggagggctcctctgttcctggcgccgcgtctgcagcctggctgtgtggtggctgcagctgctggttccctcacgcgtgatgtcagagggccctttacgtgactctgactgtgaacctgacccagccctaggcatggagtgcttgggtggctcccactctgctgagcaccagtttcccctcctctgttctggggttctggtttcggcgacaccagcagtcttgaggtatggggttccctcctggggcagtgcaggccatgcctgcacccaaccctacacctggcctatgctgacctctgccggccctgctcctgggagaagatgccatgtgtccctgtagcaggatggtggcctgggtgctcacctgggtttgatgtgcagtggccacctagcaaggctaagaagccctgcttgccccctcagggcaggtgaggccacacccctgggctgaatggctgtcagtgatcctggcctcttccccgacccgccccgcctctgctgaactcctccgagactgctcagttcctgagaaggggttctgttgggtcggctggcccattgatgccacccatagcagctgtgctgattctgggtaggcaggggtccaggcggcccccttcttggggcaggccacttgtctacccgttgccccacctcctgccctgtatctggtccaggcacacaggaaggggagcaggttgctcttgtgccccgaatccctgcccttagtgcctatacagggttcccgacttcactgtttgctcctcggacgttaccagacagtgagtggccccagccccctctctgcactcagtaaacatgagttgctgccggtggggtggcttcacccatgcaccaggtgggcaggagttctgggtgtcatgtggtgtggggagctggaggcctgagaaccagggacccctccctcagccagatcgccaagggtcttgggaccagcaggacattcacacatctctctaggagggtctgggcatggaaggatgcccagttgtgaagagcaccctctcaggatggggcacatacagcagggcagtttctcagaggccctcttccttcaggaagccttcctaggattttgttgttgtttgtttgtttgagacagggtctcactctgtcacccaggccagagtgcagtggtgctacctcggctcactgcagtctcgacctcctgggcgcaagtgatcatcccacctcagcctcctgagtacctgggatgacaggtgggcaccctcacacctggctaatttatttattttttgtttttttgtttttttttagtagagatggggtctcgctatgttgcccaggctattctcctgagctcaggtgatctgccagccttagcctcccaaagtgctgggattacatgtgtgatcactgctcccggccccttcctatgtttctgggggttttgtatccccctgggcttcagaagccctttataccatggtataatgctaggctgggtcagctgctggcagagggttcgaagacccctaggccaggctcccgaccctgccctgacttcactccagagccacattgcagaatgacagggaccctgtgaatgtccgagggctggggctgcctggcaggctgccagtgcctggggctgagccaggctggcttatctctgtctggggcatctgggatggtgtggctggtccctagatcgtcctgagccctctccttgcctggaggcccagctcaggacagcagtcagaacaggccctgggccagactagccttggtgggccaggagggactgaactgctgactgggacctcatgagtctggggaacctgggagtgaaaactcagtgtgagcccccctgctgggacccaccgcatgtggcctggggtattcctggcccccgagcctcagtttccccatctgtccaggtgtctatagggattggacaggtaggtgcaggtacttcgaggcccaaaggcctggcctgacaagggcgcagcagcttctgccccgccggtcccgagcgccccacgggcgagtgccactcatacacaaacagtgctaatgaagaacctgatttaaatgaaaacgtctgagttaaaattttccattccacatttagctgtggcggacattctgcccctaagccacccctcttgctcggcggtatctccctgccagcccaggcgggacttggggcctcagcccgggtggggcctatggtggtggtgcatgtccctgcctgtggccctggaggagggattggaacctcggggctgggccccctggacctgccctccacccgtagcttggctggagccagccaggaggggctcagagggacatggcgggccagacactccacctccagcccaggcccagagcctgtctttgcctggccctccggcaggcgagcctggtgtgcaccatcaggtctgggtgggagtggagcctccccgagcctggacccagactactgcctgctaggccctgcctgtgggaatgcgtgtctttgagtgtccctgagcatccacacatggcctcccctgtccccatgtgtcctcatgcatccttgcatgtccttgtgtgtcctcccgtgttcttgcgcaccctgagagtgcttgtgtgtcctcacacttgccctatccacagaggggcaaagggaagcccagagagtgggagggccgtgtctgaggcccagagtgaggggcagccgagccgaggctggatagggctgggtgcagtgtgaggaggcatgtgtctatgcatgcctgtgttcacgcgtgttcacacataggtcttggtgggtgagtgatgtgcaggcgtgtctgcgttcatgcatgtgcaccagtgtgtgcacgtgtgcatgtctgcatgcaagtgttcatgcatgtatatgtgttttgtatgcagacatgattgcatgtgtgcatgtgtgccttctgtgcaccagaacaggttgtctgtgtgtttatgtgtgtacatgcctgtatatttgtgtgtgtgcacacatacccatgcacatgtgccctggagcatgtttgtgtgtgtgtccatgtcttcacacgtgtctgtaggtgcctgcgtgtgctcctcatcttctctcccactgagccctgagagctctgggccctggtgggttggcctgtgagctggtccctgttaggcaggatctgaccttggggactacagagaggacagttgcctcactctggaggactggaggagtgggcagcagctcaggtcccagtcagagaacccacaacaagcctccccaacccctggattagggcccatatgggccctcacaggcatgtggcaggtacccgcactgggcaggagggacccggtcacactgcagatttcccaaagtagccccacggctgcaaggctgctgtccagcccgcctggtgtgggggagtccaggctcagggaggacacagcagtaccgcctgcttgggctggcagggagctcaagtcagcatggggttcaggccccgcctgcctgatgggcgaacacacccccaaggcccccgttagggccaggaggcaggctggcagccagcgcaggtgcagaggggccccgaggcttccatcctgaggtcagcactgggaggacagaggctgcctccttgcagcccgagggttgaccaatggcactcgccgcatcccttcccagagcaggccagccccacgggcatcatgagggcctgcgtttggtttaatgctccgctgtcaacatcttgaaattctctgtaatttttaaataaggggcccgcagtttcattttgcacagactatgtagccagccttccccagaaggctcgtggagagctccacaggccctgcctctccctgggggagctgctcacctgcctgtgcccatcttgttgggccgaccctgccttaggggcctgtggtcctggctgaatggcgttgcattggaggccaggcacatgtttgagtgctgcctgtgtgccaggcagggctggggagggtggaaggaagcctgggggctgagccactgggcagggacagggagagccctcccagcagagggaggtgtggccgcagctgtgtcctcaccctggtgtctacctccacgggctgggccctggacaagaggaagggtaacttgggctcccagccccgccgaggatggctgtcgtgggaagcggagtctttaaatagcctcttgctttccactaaaaatagtgaagctctgctgccgtggaggtggttgccggggcggcggggctggctcttggccaggcgggcgtgggtgcagcagcgtggccacgtgcgctggagtggtaggcagcgcgtgggccccatccactgctagtggccatagaggtcagggctgctgtgggggatccccactagccccccgactatgcagagggcctgggtgcagggagggacgcaaacccctgtgttcctgtccctgctgcttgtcacagcagctgtctcagggtgcgcaggggagagacaaggagcctgaggccagaggggcttcttggaagctgagtgggtggatttaggaacccgctgcaggccgtgtggcccgaggaccggcaagtctcttcagaggggactcgggccaggcccgttaagggctgaggaaggcgcctttcaggaaggtgtgtgagggcacaccttatagggaagctgcagagggcagcctggagtcctggaaagcttcccggaagagggggtggccttggagccaagtgctgatggctgggaagatgggaagtggtggggggtgttgtgcattctagagtccctaagtgttctactttgtcatctggggagggaggtgacaaactaaaaagaaggggctgtctggatggggatgtgcctgactgggaagagtaggggagacatgccccatgcacttactgaccaaggactggggctccccacaccccagaatctgcctggtgagaggccccactgggccagggacaggcctggatgaggcatcgtggcgcattttccatctggggctcccacctccagcctgtgtaccgcccccgccccctaccccgccccagtcatggagcctaggtcgctggaatggggtgaccttaggtctgtgggcctctctgagacggctgccctgagaggttgccgggtcagggcacgggtagcccacatgctgtactgatacgcacagcctctggccgttactcgaaggagcgatgtggctgaggtttcttggcagggctgtggcagcctccccactgcctctgagctctgagggtgaccttgcaggcccagcctgccgcaccacatagctctgcgcctgcatccgctctgcacccccagactccactctctgcccccactgtctactgcaggtgcccgtggttgacacgagctgtgtccccagctgttcccgtctacaatggcatcatcttcctctttgtcctggccaacttcagcatggccactttcatggaccctggtgttttcccccgaggtagggccctgtgctgcggcagctcctctcactttcactagagtgtgagtggctaacttgagacagccttagggattcctggtgggtgggctggacttgggggagggattcacctgccaggaaagtcaacttcctgctcactgcctggctcctggtctgtagcggatgaggatgaggacaaggaggacgacttccgggctccgctgtacaagaacgtggatgtgcgaggtatccaggtccgcatgaagtggtgtgccacgtgccacttctaccgcccgccgcgctgctcccactgcagcgtctgtgacaactgtgtagaggtgaccgccctgctgccccgcgctcccccagccctgtgccacatccctgcctgccatgtgccctgatgcactgctcccgcccaggactttgaccaccactgcccctgggtcaacaactgcatcgggcgtcgaaactatcgctacttcttcctgttcctgctgtcactcagtgcacacatggtgggcgtcgtggccttcggcctggtctacgtgctgaaccacgctgaggggctgggagccgcgcacaccaccatcacgtatccttggttcctgtgggcctcattgcagaggcgatgtggaccggggacacgttcaccagggagattgagcctcagaaggcttggttcctgcccagggatccccagtgggcaggtggccgtccctaggttgggaggaggtttgtccacaggcacctgctctgtgctgctgcgatggggtctgcggtgtcctggcctgcaccgttggccttaacgggctagcatggctgtcatgtgtgtggccggcctcttcttcatccctgtcattggcctcactggcttccatgtggtgctggtcactcgggggcgcaccaccaacgagcaggtgcagaccccatgggggatgggtggccccaaagggccgagagagttggggctgcatggggacagggtgggggctggggcacccttgcctgaggtagcttgtgcagctgtgttgagacgaggctccaactctgagacccccacgtggggctacgcctgccccgtcccctgcgcacatcctgcctgtggacactgtggccaccagtgacccagaaatcccacagctccctgcaagttcaggctgggtaacctatgtgaggggcagccctgggctgatcccacctaagccacttcccgcaagtatcagcttctaaggaaccccagctcccttgcccagccccctgcccaccctggcctggaccttgggaggccaggctggctgagggtcctgcatccacaggtgactgggaagttccgcgggggtgtgaaccctttcacccgaggctgctgtgggaatgtggagcacgtgctgtgtagccccctggcgccccggtgaggcccggcctgggcagggtggaggggggcctctgctgggtgtggggcgggcagccttagaccctcttggtccgtttggctcttgccaggtatggccagccctgcccttgtgtgtttgtggcaggtgggctggctactgacccctgtgccctggtgcaggtacgtggtggagccaccccggctgccgctcgcggtgagtttgaagccgcctttccttaggcctgaactcctggaccgagctgcaccgctcaaggtcaagcttagtgacaacgggctgaaggctggcctgggccgtagcaaggtgggcgcctgggcttagggatgggctggcagtcaggcccttggatggggaaacaggcaggttggtgggggcctagaagaggtggatggggcagacagagccgtagacagattcttgggagggggctaggtcccaggctgaatccctagtgaagccctgcccctcatccaagccccacacaccactgaccccgctccctcccagtccaagggcagcctggaccggctggatgagaagccactggacttggggccaccactgccccccaagatagaggctggcacgttcagcagtgacctgcagaccccgcgcccaggcagtgctggtgaggttggggcagccacgactagggagggatatgggttgaccctcctctgacctcagtctgacagtggtctgcatccccagagagtgccctgtcggtgcagaggaccagccccccgacacctgccatgtacaagtttaggccggctttccccacgggtcccaaggtgcccttctgtggaccaggcgagcaggtaaggaggcctagcctgccccctggcaggcctcgtcccccaggcccgcctctaggagctcgccccacagccttcaccccgtgaaggccccacctccagagccccatctctccagcagaggccacatcccctgaggccatgcccctcagggctctgcctgggtcaccaagggccttgtgtgactggtaggaccctgtctgtgtgcacccagagctgggacccacagaggggagcagggtgtcctgggaggggctggcgtgggccatccaggcttggcgtctgtcccttggccagcattgccctaggccaggtgggcggctgcccccaggagcactgtgtaccaggatgcctggaattccaccattagtcactctgtaaggcccacgggaagactttggaagaatttgagacgtgcttgagaaagcacatttctcttccctgagttgcatgagtgctctgtggtcactggaatggtgggcagtgcggggcggtctgtgcagtgatcaggaacaccaaacagtcccagggtgccatccttccttctgggccaccccgagaggcaggcctgtgactgggccctgtgcacctagaccagccccatccccagggacctctcccctcaggactgatgtctttcctggagagagtcactgggtgaagcagtgagtctgagcctccttggccaagggtctgagtctgcaggcatgtaggggccgtgcctcgcaggaggaggcatccctgtttggagatgagggctctgggtatgtcatcttcctgggactcctgggtccagtgggggattgggtctggttggccaagtgcattgagcccacatttgccctgatccacttctggctttgtggttcctgaggctcttgtcccaagcccaagcccaagcccatgcctatgtgcccgtcacaggggctagacgaggctcctcctccctctggctgccctgagtggtgggcccctggggctgcatggctccaagggcagaaccccaggtgtctgcagtagccagctgtggcctccctcctgttgcagagcccctgcccctcagccgtggatgctcagggacagggccatgggtcactatgtggctcttatggctccttgaggcccagttcctgaggccacggtgccatgtgtggcccccgtgggtgctgactggcggctgcaggcggggtggcaggtgggcagtggtgagaatgccttctccctacaggttccaggccctgattccctgaccctgggggacgacagcatccgtagcctggactttgtgtccgagccgagcctggacctccctgactatgggccagggggcctgcatgcagcctacccgccatccccaccgctcagcgcctctgatgccttctcgggcgctttgcgctccctgagcctcaaggcctcgagccggcggggcggggatcatgtggccctgcagcccctgcgctctgagggggggccccccacgccccaccgtagcatttttgccccccatgcactgcccaaccgcaacggcagcctgtcctatgacagcctgctcaatcctggctcgcctggtggccacgcctgccctgcccacccagcagttggcgtggccggataccactcaccctacctgcatcctggggcaacgggcgacccgccacggcccctaccccgcagcttcagccccgtgctgggcccccgcccccgggagccctcgcctgtgcgctacgacaacctgtccaggaccatcatggcatccatccaggagcgcaaggacagggaggagcgtgagcgcctgctgcgctcccaggccgactcactcttcggcgactcaggcgtctatgacgctcccagctcctacagcctgcagcaggccagtgtgctgtccgagggcccccgaggtcccgcgctgcgctatggctccagagacgaccttgtggctgggcccggcttcggtggcgcccgcaaccctgccctgcagacgtcactgtcctcgctgtccagctccgtgagccgtgcaccgcggacgtcgtcctcctccctgcaggctgatcaggccagcagcaacgccccggggccccggcccagcagtggctcacacaggtcacctgcacgccagggcctgccctccccgcccggcactccccactcaccatcctacgcgggccccaaagctgtcgccttcatccacacggacctcccagagccaccgccctcgctgaccgtgcagaggtgggtgccgggaggtgcgggtgggcttcctggcacagggcagctgtccagccgtctccagggcccctcttggctgggcactcataggtcatcccaggggcctgagtttttctctggggacgggacagggaggatgcgcctcaccctgccttgaaggccttggctagcccgtgtggcccagctctgaggatgtcctgggcacgctctggggacagggtatgagaatttgtgtcctgagcccgacgactcgttcttctagagctggcacagacccagcatgtgggaggccatggggctttctctttggggccagtatcatgtggcagcctgggcctcctttaggctgtggctctggcttcctgggtcacagtggccctgtccacccagggctctccctgggcctgcttggctgcatctctaggaggctggggctgaggatattacctagcagcagaatgtgccaccctgagtggccgggccctggccctccctgtaggacatagttctaggaagcaggggcttccctgctcgtaggtggggaagctgaggactggagaaagcaggctggctccaggcacccggcaggttggtgactgagaaggcggggtcagctggctcacaggcccaggtccaggtaggagagctgcacacctgctggggccaggacccacgccacagacgcatggtgtcctcacggcatctgtcgccctgtccgggcctggaaacctcaagcacaggcgcagttgtttcccgtcggcagatgcagccccagagggagagcccagcccagcccagcccaggccacttggccacaaaggggctgagggcacagcagtccagccctgagcgggtctcctctaccccacagggtgggacctgttcagcttttgtggagttggggaggaggctgccactgggagtgatgagtggggagcccgagacctagaagtgggcagcattgcagccaggcagggatcgcagcccggggacaaagggctctcgcctcaagaaggtttaagtagcaaagatacagctgctgttggtcagcgctggtgggcaggagggcagcccctcgttttcctgagagagagcaggaatgaggccaggcagagtggctgggctcccagtgcagggcacggcaggggctccattcagtgcccacctggctgccccatgctctctgtggccagtgctggctaggagggacccagggactcgggagggtggtggcagttctgacaacatctgtctgtcctgtgacagcacagctgctccccaggcaggctctgcatccctcacctgctttccaggtgaaccctccaagcccagagggcagggactgcacggggccccacaactcggctgcactagtccacgtccgcgtcgtctctgtcttgctgcctcctccgtcctctgtccccgtgttcgtgtgttcaccgtgtgcatgtgtgtatgtgcttgttttgatgcagggaccaccctcagctgaagactcccccaagtaagcttaatgggcagtccccgggcctggcccggctgggacctgccaccggccccccagggccctctgccagccctacacggcacacgctggttaagaaggtgtccggcgtgggtgggaccacctacgagatctcggtgtgaggactgactgccacacatccgccatggtgccacggggaccaggaccccacagcgcaccccccctccccaccaacttctctgccccagggacccgaggccaccccagcctggtgtggacccatcggcgggagagagtgccacgcctccacagcttgccccaagcgctctgcctgcccgtccactcatctgcccatggggaagtcggctcactgggacaagggccactgggctggtctgtgtctgggcctgtcccatggctggggcagtgagggggcccagtcagcctctttggggcaccctctctcagccaggcttggcccactgccatcacccagcaccccagatcaccgccaggccagcccccaatggtccccttacggacaggtcccagagatggacagaggcacccagggcccccaccgtccttctgacacagcctgtgggctcccggaccgagtgtcccccgccaggctactcctaactaacgcgttgcctttcacggaccccgctggaagcttgtagcttggcaaggctgatgcttctgccctggcctgctctgggtggtggtggataggtggacagacggccagccagccagctgtggccgggggcccggctccatgtgtcccgtgtctgtgtgctgtgctgccgcgccgtgtctgatgtgtcagtgctccggccgccgctgtccctttcatcaaagccttaacctttgctttatgctcttgtgggaggcgacgggggggcaggcgggagcaggcacgggggtgatgctgccacagggggctggtgacacccagagccccctccccagccctcaggccctccctgccaaactggagaaccccaccccaaggcatgccacgtccgcagccccggcctggctgcggtgctcgcgccgtgggaaagcacactggggaggggtcagtgcttcccttggtgtcagggacctgagagtaagcacatgacagcgtctgcttgcgttgtgtctgttttatgtttttatatctacatctatatatctataattttattaaaaaaaagaaaaagagttattttgattctttccttgggcaaggccagggctattgctgcaggatcccgagttaggggagggcaggggccgggccccagaagagggagtggctgctgtctggtgtgcaggggtcggtgggttcctcaggggcatttctgccgacttgggctgagtcagaggcttgggaagagggggcggccgatggtctgtggctgggaagtgtgagggtctctcgccttgggtctgtgtcagttctggcagtgacagggtgtttgggggaaagacttgggtctgccgctacccacaggggactctcaggaacccgagagcttggggagatgaaatgggggtgcataggggccacctgttggctcagggccctgtgggggccgctgaacctgctggaactctcctgcctgccacatgccaggggcagggctgagggagtgtgagggatgcacagctgttcagggctgagacattctgggctggggctgtcccagcgtgggaggcgtgcgggctgtagggccccgaagctgacctccacctttctgcttctctctcacggacgccgcggcccgcagggggcggattggcacctgcacccgtggatgggggcggcgtggccagccttgggtgcctcctgggctgcacctgtgccaccttggccgcccggaggaccgcccaccactgcgggccccctggagccaggccgccggggcacccccacgcggggccatgtgccgcctgcacttggctgcctccagtcttttccccagcctctcggggccctagcaggatgacaagtaggcggctctggggcccaggacagcccagctggggacccaggaggtcagactgcagtggaccctggggcagggctgggggtgggctgggctctctgctccaccagccacagcttgacagattcccagcctgccagggcctgagaccctgtgtccacatgacctcagggagtcccccacctgctgcagggggtccagcaccccacaggggggcagtcccagagctgtggggaccggcacgacctttgcccagcctccctacccaaccaagcactttagactaagccacttcctcctcggggagcccaggcctccgtgggttgggctgggtggggggggggtctcaggttgcccctgaaggtctctgcactcctcctgcccttcccctgacacatgaacagatgccttaacttcctggagccaccagcctggtgagccattggcctctgcctgccaccaaggtcctgtggtcttggccagctccgcctgggccccactggggctgcctgcacccagagacgatgccggcgggatctcagagggcctgaggcccaagccctgtgtcctccagcagtggtacggcctgcggcagggtggcactccggccagcccttctccgtcacagggtccctgtccctgggtccaccctgggctgtggctctacatctcccatttggggacgagaaagccacaaaaccattctctattgttcttaagggtacccctgctaattaattccccaaataaaatttttggtgttgatcagctctgtctaccaatgtggtcccctggaccggacagggccctgggttggggaggtgacaggacctgggcagggagggtggtggccaggaagggaggggagttgcatgaggggcatgaggtcagtggatcagcaggttcagcgctgaaaacctgacctctgaggtccctgggagggcctggcccagggggcaagacctgaggaccccccagtccttactgctgttgcctttcagtggagaccctcctaagacgccttggggggtcagagccccgtgcagaggggctgccttctggagggcaggtaggatgtggggtgggaagccggccctgagctggggtctccaccctgagggaccctcgctgcaggatcgcctgggcatccctcccccaatttccacagagacgtgctcaccggccacttatgtcatgattctatgtccagccacaggcccagccctcaggacagaccccacctccacccttctctgcagcttctggcaaggatggtgcacagtggtgccatgtgcagggggctggcacggccactgggcatccggggcagtgctggtcgcctggcctccttgctggggccgctgggcctctggcctagaagggcaggaagccgtccactttgaggcgcaggaaggggtccagcagggcccggagcttccagacggtggcacggctcagcaggggtggcaccagcccctcgaaaggtgtggggttcaccacgtacacgtaggcagcggtccagaccagcagggcgcccagcagcagcctcagggtcagcagcctgcgggcggcggtggtcaggggcaggggcgcgcggggggcctgggggctgggctctgccgtgcagtcacctaccagagctggcctgccaggcccttggagcttcccagctttggcctccctttctgtcggggaggggctggatcagagcccaccccgagtgtccaggctgagggcagggatccctggctttgggaaaccctcctcagacagggctccccgcaccgcagccctggccccttcctcctggacaggctcctgcagccacttttccgatgccccctgccctggacctgccctcctggagcccatttctccctctcgcccaagcagggccctgggtggggggctggtctccagacccagagtggggcgtggggggctcaccgacatgcttgccatctgcttctccttcctggctcgagtgcggcactgggcccgctccctgcgggggcctcactgtcaggaccccacaccctccacccccagcctggcacccaccccctggctcggtgctgtggaggtggggggtcaaggatgggtctgccctgtcctgaccaggacaccttctgagaccctgctcagctggcccggcccctgcccccgtgttacctgagaatctccagctggatgtcctccatctggtccagcacgccccggatgtccttcttgaggttctgggggccagaggaggtaagcacagcaggcccctcgccccgccctccgtggcctctcgcccgccgggccccgtccttctgggtgctgccctgtggggacctaccaggagcccggtggcctggttgttcagggccatgtgcatctcagccacgttgtcccacacctagggggaggtggggtcacgcctgaggagcaggacccactgggtgggcccccagcacccctccccctcagccaggcgggcacctctgtgatgaccatcttcttcctctcaaagcacaggcggatctgctgcagctcgttctgagggtggggcccaggatgggcttgggcagcatcagcagggtggccagtacctccccgctgggcccactggcctactgcacgaagacctccctccctaatgaatccctcaggcccacctggagtgctgttacgaagcttcctccccccccacagcccctcccccaggcccacctgggactgttgcacgaaagcctcttgcccctggcacagctcccgccgcagcagctgcagaggtgccctgttccccaagggctgcgtgccagccgggtcggggggctgtgggagagcccccagatcagccctaagactgcgggctagaggggcgttggctgcatggggtccctgggccctgtatttacccaggccagagcagtgcagcttgagtgttcgggacacaggggcaggaactgctgccccggccccaggagggcccccagctgctcccgaagttcctgattctgccttttctggggtggggggcagagagagggggctgcctgtcatggccgctcctgcggctggggctggggcaggggcaggggcgccaggtggtgggtggggctggggctggggcaggggcaggggcaggggcgccaggtggtgggtggggctggggctggggcaggggtaccaggcggtgggtggggctggggctggggctggggcggtgggtggggtgctcaccaggctgtggttctcctgctccagctgcaggaaggactgttctgcagagcccagcagcccgcactgaagctgggacagggctaccctgggcgaggccagggcccctccctcccgtgacaggggtgggcatgggcagggtctggtccctgagccaatggatcccccctgcctgggagccccctggttcgaccctgggtgcaggggccagccccacccaagccctgcctccaggtctccttgtctcggcccctcagtgtctctcgctctctgctcctggctggacagaaagagcccgggagcctcgccctccactgtgggcccactgccccctgcccctgggactgggaaaggtctctgggactgcactgagtgagcagaggagatggggcccaggcagggccaccctacaaatccctggcagggctggtccaggcctcctccatggctgctggaggctggggttgggggacactgggggtgggggtggccgcaggggcccagggttttcagcccctccatccctccctgcaaccccttcctgatcccaggtccaggctctggcctggcccaacctgccaccctcttactgagggggctgccccaggcaacagtcacaaaggcctgggtgcagccagggcggtcacaatgggcccctcccacctggtcctgaagctgccccgcctgatgacctcactgcctctgacccactgacccaccatgcgagttttctttctttctttcttttatgggaaggggacttgctctgtcacccaggctggagtgcagtggcacaaggtgtctcattgcagcctccaactcctgggctcaggcaatcctcccacctcagcctcccaagtagctaggactacagatgtgtgcaaccatgcccggctaatttttaagttttttgtagagataagggtctcgctatgttgcccaggctggtcacaaactcctggcctcaagcgatcctcttacctcaatatctgaaagtgttgggattacggatgtgagccactgcacccagcctagttataaaacagataatacacacactcacagtgtggattcaaaaagtatcaaacaataaaaatggtgtccaagcttttcccacctttatctcctgtccctgcagacaggagcttcctctttaagctcctagaggtgggctgccgtcccctgcccctggttcacacagaagaggtcatcctgtagcccagctttgcttttcacctaatatatctctgaggttttaaaacattcttttctagctatgtattgaatatttacattatgccagatccagtacatgccattgttatcctctgtttttttttttttttttgagacggagtcttgctctgtcgcccaggctggagtgcagtggcgcaatctcggctcactgcaagctccgcctcccaggttcacgccattctcctgcctcagcctcccgagtagctgggactacaggcgcctgtcaccgcgcccggctaatttttttgtatttttagtagagacggggtttcaccgtgttagccaggatggtctcgatctcctgacctcatgatccacccatctccacctcccaaagtgctgggattacaggcgtgagccaccgcgcctggcctgttatcctctgtttatgggtgggaaagctgaggcaggaagccctttagtcacttgccgaaggccacgctgttaacggtcggaccagatttgggtggcggaagagaactcatccgacagtagggccagattcacgccccaggcccgttccctcctgctccctggtgctcctcacaccatcggccctgctgcccctcactgcccctgagtccctgtgcccgtgtcctccttcttgaacccatcagccgtcagttaaccctcagaaagctggctcggagaagtcctcatatggtaggaagagccccgttccctcctctcccggtgtcctggcccccctgcaaggtgacttcacctcctacatcaagaggcgggtactggtctccacctctgggctctgggccggcctcggatgcacttggccaatgggctgctcctaagctgctgtgggcagaggttggcacgacacttgtgcgctgggcctggacctctcttgcttggctctggggactgtcctccctgcaggaggcctgggctgggctgcaggatgagaggccatgggtcaggagaggcttctgtcgtcccagccggtccccagctgcctaaagatgggtggacaagcccagcgaggcccccagagaaccggcccatacgttagccaagttgccggccatgtaccatcgagccccgggctgtcatggtggttttgccactgagttttggagtgtgctgtgacgtgggaggagacattgagaggcctcacaagcctagaagcgtcttaccctgacctcacacctgctggacttcgggctgggaagagaactggggccgagggcgttttcccacaggactggaaggccggtcgtggtccttggtggtgagagctggccaggctgccagccttctccccggaagcctgcagggtcccctctgatccctgcgcctctgggggtcacaccaactgtgggtctttccttcctcaccacgctgggcacttggtgagcacattctgccttgagacggggcatttctttgataacatttcttctcatttcctgcttgttctggaactcctgtcagtcaaatgttgggccttttgaattgatcctgtgagtccttctttctacctttgcttgtagatagacttccctgaacccaaacacaaacactttctctctgctttttaaaaaattggttttggggccggacgtagtggctcacgcctgtagtcgcagcactttgggaggccaaggcaggcagatcacttgaggtcaggagttctagaccagcctagccaacatggtgaaaccccgtctctactaaaagtacaaaaatttgctggacgtggtggtgtgcggatgtaatcccagctactcgggaggctgaggcaggagactggcttgaacctggaaggcggaggttgcagtgagccgagatcaagccactgccctccagcctgggtgacagagccagactctgttttaaaataaataaataaataaaaataaaaaattggttttggattttagcagtcctgtttttcatttccaagacatttccattgttccctgagctcccctcttcttgttccagagaattctgttctgctcttagggataaagtggctttggggggaggcgaatcttttgctttctgcattttctctcttgcggttcttttttgtttgtttagtcttggagcttcacatgagactcagtgctcaaatgtctggcttttctttcttttcaatccctgtttataggggagacaggcagagctgccgggcactcctctttccttgttaacttgaggaagccggacagccaggtcttggaagggaggcctcctgcctccaggcggcatctcgggctgcagggctgtggtctggagtgcggacagtaccagctcccactgctgtcctgccatgcttgttcgcagtactcgtctcctcacaccagtgacgaggccactgcttgccagccgcttgccttcttcccgccaggctgtcctgctacgtcagcctccgctctccacctcaagaagtgtctcgaaatatcttctctgcagatgacctctctcctgttctcagtgccacgtggggcctccccagcagaggcggctggacacctggccctggctgctggaggttgtttagctgccagagggtggcggtagcctccaggaccctcccctggcctctgccctgttcatcctttgccggaatgtcatgggtttcaggatgtgctgagctccgaaaccccatggggcaacttgggatgggggctaaggaaggcctcttggaggagccctgaggcgaggtggccctggggtggggtggaggaggccctgagcagcaggggagggggttgcaccctgctctctgtgtccctgagtgaatggggcaggggctgcaccctgctctctgcgtctctgagtgagtggggcgggggctgcaccctgctctgtgtgtccctgagtgagtggggcaggggctgccccctgctctctgcatctctgagtgggatgggggctgccccctgctctctgcgtccctgagtgagtggggcgggggctgccccctgctctctgtgtccctgagtggggtgggggctgccctctgctctctgtgtccttgagtgagtggggtgggagctgcaccctgctctctgtgtccctgaatgagtggggtgggggctgcacctgctctgtgtgtccccagcctgctaagtgccccacaggggccaggatgctgaggagtgagaggtcttcacagagacaggtggctcctgtaataaggaagacaacactggcttcctgggcgaacagcagggcggggtccttaggtcccactgtaggtgcccaggcccggatgagattccccagtggccctgagggggcgcccgggacaccctggatggcccagtgtcctcccgtcaccctcgcccctgggcaccatcctccttggcctggaaaccccaagctccctgacgcccccgcccctctccccgggcctgtgccggggaaggatactgctgctccgtcagtcagccatagagcccctcctcccccagcccctctcacccctccctgtggtccttgccaatcgccctgagcccgaaaaggtgggagattcttggagagatggggccctggatccccggccctggatccccatccctggggtcccccactcacggggtcagatacgctaacaaaggccaagcgccctgccaagcggtgtcctggattggggtgggcgtgggggttcgcctcaggtccaggctccgggatgtcgtgcaggacagggcgcggttgcggcgggggcactggctggaagccggaactcccggcctcgagggcggaaagtgtggccagcgcagcgtgctgggggggccatggccccgttgccaggcagcgcctccctggacgccagttgccatggaagccgcttcctgcccatgttgccagggcgtccagatggcctcgaggagcctggttcagaggggccgccctatgcccttgcccctcctccgctgcccagggatgggctgggaggacaaagaggaggagaggctgggactcccagcatggagatccgagtccttcctgctggagccaggctgcggcccagggcaggggccagatggggctgttctgctgtctgcaccgcggacttgatgttcataccccaagctcattttatttattttctatttttattaagaaagagtctcactctgttgcccaggctggagtgcagtggcgcgatcacagctcactgaagcctccagttgggctcaagggatcctcccacctcagcctcccgtgtattggggaccacaggtatgtgccaccatgcccagataattctttattgttttatttttgtagagactgggtctcgctatgttgcccaggctggtcttgaactcctggctcaagtgatctgcccgcctcagcctctcaaaatgctaggattacaggtgtgagacacctcgcctgtgcttggctgctcccgagcatatctcagaagccaggaaacaggccctgaatggatggagctcggggtcactgggccagccacagccctcagaggaccccatctctgtgccctctaacctgggctcctggcccacacccacccaggctgcctgtcaggatctgctccctctccagccctcagagctgccctatgtggagggttgggggtcccagaaaacctgggagaaacgggtcctggaaacagggtcggggggaagggcagagtgctggggatgctgggcccacgacctccctgtccctggggcttccccatgtcagaggtgaggctcagagaggtaagggcgcaccctttgtctgccccctccccagcatggccaagtcgctcccagggtgcaggcgatggcaggccatttgtctccctcctgggtgagtctctggacatggattctcacattttttatttaagaatcagagagatataagaatgtcaaggaaaaatcctctcatggacaatgcagccccagtaaatgactgtcagccggcgtgtccagggcttcaaggccccaggaagtggccatgctggggctgccaggcctctggctccagggtcactggggctgaactgtctgcccaggcccggagacaccctgcccctgaggagcccaccggcttggccagtccatcttcttggcactccctgaccaccacttaccttctagtcggacagtggagcctggggggacagcgtggcagagtgcctgatggtcggtgacaaagtcatctccaaagtccttgctggggccaagagccaggactccttgcccgtccccgtcactgccctgtgcccgcccagcacctgctggggactaggctgcccattggagaaggaaacacagtgctgggctgtgagctcctgaagcctgtctctgtgccccaggaccaggctcctgggtggagggagagaccaggggcaggtgaggaaaggcagggcccccagaatccctccatgcctgcccctcagtctccaggacttatgtgcaggtaccgtttggagctgtggtgcagttcccagtctcaccaccagatggcaccatgcccctgcagaagcagtgcccagagcaggccaggtggttctcgggggctgcggtggaggaatccacccagccgaagctctggcagggaaggggcagtgctagggggagccccctccccacttggatccgaagttcccatggggcctagggcaggggcttgccaggtagccagaagttcccttgctgagtctagggtgtctatcccacatttcacatggagacgaatcatcccagacaccccggcactgtcccggggccgtttgccacccctcccaaggggcagggctcctgtcttggggccttcccaagcatagtagccttcgggcagccccggcctggccccaggttgtcccacttgtcagtgggcagctggggctgggggaggggtcccagctcctgtccaaggtcaccattgcccctgaccagggtgtggcagctgctgtggcctgggtcagtgaggccgtggacggagggtggcctgggtgtaggcactgctctcagctaagagagagcccatctggaggaagaaccaggaaccagagggatggccgggttcccagcgtgcaggaggccagcttaagttcagtagggtccccctgcagggactccaagaggcaaaccacatggagagtcacctgagagggaatgatggaggctggggaggtggagcccccacctccaactgctgcctcggcccccacagcaggggagggcgggaggctggcactggcactgccctgggagatgccacctgggccttggtctggggaggagggctggccaggaggctgggtacggctactgctctggagtgaccgaaccatttccaccctgcttgccttattcttctcatgagggcctcaaggggacacaccagaggtttactggggacatggcaggggagggatctcagtgctggccttctggggccctgcgtccactccgcccctttctgacctgggctggggcctctgccctccccggggcctggagacagagcccttttggaggccctcaggcttgacaagcctacttcttagagccaggctgtgggctgggctgtatcctggtgggatgagggatctggggcttgggtgggagtggggctgggagcaggtggaagttggtgcctcaggctctgaggaatgggcctgggatggctgcaaagtggaggagaggctctctcaaccctgggctttggggtctgagcccagccctgtcctcaggcagtctgcccctgcagccccgcattgccatgttggttggagttgcgatgagaggtgctggggcctcccttgcctctgcccagcacagctgagaagttacgtgctgctgcccaactgtgggggtttcaaaccccgctggagcctccaggtgggcccttgggcagcagggccttgtggcgggaggaggggaccctgggaagtcagggaccaggcgggggagggagagaaggtgggagcacagttgtgggtgtgggtacccgccccttcctgaactgtgttcctcccggcccacctgactctagtcctctgtgccggctgccaggggatacccgaggccacctgcgtccccaaaagaaggtctcaccttcagagccagcctttgaggctcctgggtgacctcagcctgttacccttgaccctgagttcacctagatcaagtgggaggccgctctttgggcctcagttctcccatcctcagggagtaggtcctctgtcccctgacagcacccctcctcgctgtgccaccaccactgccagggttctgatctgtggatgttccccagggggtggctctgggctctcaggcaaccggctactgtggatggtggtttgcacgagaatagtgtcactcttgggtcctttgcttgaagttggctctgctgagtgcagcctgcagacattttcaggaaactgaatccacaggctggagccttctgcttccccacaacccaaacggcccccagccagccaaacagccacgagaacccagctgctagcaactgccagcaggaaacccactaccagccgctcacagatggacagcccatcccaggagctggccccacctccccgcccctctgctgaccaacccagcagctccttgggtgggtgtggccaccctgctgccccaacctgctcccggaccctgtgccaggaggtgcttcgcctcagcggggccttgcctcccccagagccgctctgctgcctgaccttgcaatgtcatgggtcctctgggcactggcgcagttgggtgggatcagctttggccagcaggtggggggcaggtgggtaaatcctccctctctgccatctccgcttccttcctcctgcccggcttccctgcctttttcctactctggctccagggttgcactgctcagaaagctgttgctgcctggccagcacgcaggcctgattttcctgggagcctggactaagaccctgaccagtcctcccacccaccacccacaccaccacccagctagccagcagctaggccaggagtgatcaggagggggcccaaccgaccacccacccggcgtctccagccggccaactctgcccactcagggccgtgagctggaggtgccaggagcctcccgggaggcagtgtgaggcattcttcttagtaagtcccgcatcgatgataaagggcagtatcagcccctctctgatgcgcagtgagcggctcaccatacaggggaggcgtttaatttatctcgggaactgggcgcaagttataaaaatggtaatttcttggagattcaattacatgttttcattgttaccctcgataatcaaggaaacgattttttataaaaggctgtgggatgatactgatctcaggagaggatctgggccgggtgggggctttggggacgaagaggagggcagtgtctgctgggggcaggcagggcaagtggagctgggccggccggcccaccagctcctgcagcccaccagttcctccagctcctccagccctccagttcctctagctctccagctcctccagcccaccagttcctccagccctccagctcctccggccctccagctcctccagcccaccagctcctctagcccttcagcttctctggcccaccagttcctccagccctccagctccttcagccctctctggcctcagtcttcccatctgccgacgggcccatctctggtagggagggtctgcgttttggcatgagggctgatgaagtgaggcgtgactcctgggccgtgagggtggctgcgtccctgcccctcccttcctggtgcccgagcagtctcgtccatctcctgagggctctgcagggaatagagaggggttcctggtggagtgtggacctgattttttccccaagtgatgtcttggctctaaataacatctccaggattaatgatgccggcccccaacagcaccaggtgattggaaaaagggttttatggccccgtgggtgaaattgaacttgcatctgaggtgtatttccaagatgggattttcctccctggcagaggcggcacatttcacgctaatgataatggcagctcctcgacattcatcacctatagttggggggacacccgtctggggcacaggggcagggtgtccctggggtaacctccaggtctcctaatctcagcagactctggggggctggttctaggagatgcgccctcacccagtgcagggccagggaagggggaggcaggagcccccaggggatgaacgagctctagctgggctgcaccagggaggaggctggaaggaggccccaggctgagggtaggacccggctagtgcttgcccagggacccacaggccccttgctgagcagactccagcgaggggcctggcccatcttgttgcaaagggctagagtcctgggctgagctgggcagttgaccttggatctgactctgtctcccctgaaagctgttccaccccaatgcaggctcctgcagcctagcacagcgcccagccaggatgggcaggaggaagcccttcttccgacgggctgtcaccgcgccctgcctgaggggcctcaagccccagggctcttgtctcagaactgggccgtggagattcaggaactatgggagtttgggggatcttggtggctgagggctgtgctcatggaggactccttgagttcagaagatgaggcccaccttctgcatagccaataggtcattgtcacagggacactgaccaccagcaccaacctccatcccccggcacctgcctttatcacccatttcccaggtgaggacaggggctcaaagaggggcagggttcctctgaggtaacacagcaggtgagcaacagagccagtgagggcctgggggtgtcctgccacgggctgaggtgtgcccacatgcaggaatccaggggtccgtgggccaggacactgccaagagttgggggctgggggagggaagggggcattgccaatgctgcagcccctgccctggggggtaggagggagatgcccctccgggggcccaagggcagggtgggcccatgctgttccctcccacctgccacgggtgaacctgacaggagtggggatggagcctggcatcccgagggaacctcctggagtaatcactccacatgctcgcggtaaatactgggcccttcttcccctcccagtaattgaacttatttacttttaactaagattaaatgttctctgcgagctcaagatactgactgccctgtcaggctcagtccacgctctgctcttcctgcctctggggaccaaccccaggcagggagggaccaggcagccctggagaagcacagaaattgtttttccaggaaactctgggtggataatccacttacatcatcaccactgtcaccatgagcatggccataaccaccatcatggtcagctccaccagcatcaccaccaccaccaccaccatcaccatcactgccaccaccaccgccaccatgactaccaccaccatcaccaccaccaccaccatcactaccaccaccaccatcactaccaccaccaccaccacgatcactaccaccaccaccaccatcaccatcactaccaccaccaccaccatcaccatcaccaccaccatcactaccaccaccaccaccaccaccatcaccatcactaccaccaccatcactaccaccaccaccaccaccaccaccatcactacaaccactaccaccaccaccaccatcactacgaccaccaccataaccatcactaccaccatcaccaccaccaccatcaccatcaccaccaccatcaccatcactaccaccaccaccaccaccaccatcactaccaccaccaccatcactaccaccatcaccatcactaccaccaccaccaccaccaccatcactaccaccaccaccaccaccatcatcaccaccaccaccaccaccaccaccatcactaccaccaccaccaccatcactaccactaccaccaccatcactgccaccaccaccaccaccaccatcactaccaccaccaccaccatcactgccaccaccaccaccaccaccatcactaccaccaccaccatcaccaccaccaccaccatcactaccaccaccaccaccaccatcactaccaccaccaccaccaccatcactaccaccaccaccatcaccaccaccaccaccatcactaccaccaccaccaccaccaccatcactaccaccaccaccaccaccatcactaccaccaccaccaccatcactaccaccaccaccaccaccaccatcactaccaccaccaccaccatcaccatcactaccaccatcaccaccaccaccaccatcaccaccaccaccatcaccatcactaccaccaccaccatcaccaccaccaccaccatcactaccaccaccaccaccaccaccaccatcactaccaccaccaccaccaccatcactaccaccaccaccaccatcactaccaccaccaccaccaccatcactaccaccaccaccaccatcaccatcactaccaccatcaccaccaccaccaccatcaccaccaccaccatcaccatcactaccaccaccaccaccaccatcactaccaccatcaccaccatcaccaccaccatcactacaaccaccatcactaccaccatcaccactaccaccatcactaccaccaccaccaccaccatcaccatcacttccaccaccaccaccaccaccatcactaccaccaccaccaccaccatcaccatcacttccaccaccaccaccaccaccatcactaccaccaccaccaccaccatcaccatcacttccaccaccaccaccaccaccatcactaccaccactaccaccaggaccaccatcactaccaccaccaccaccaccatcactaccaccatcaccaccaccaccaccaccatcactaccaccaccaccaccaccatcactaccaccaccaccatcaccatcaccaccaccaccaccaccaccatcactaccaccaccaccaccatcaccatcaccaccaccaccaccatcactaccaccaccaccaccaccatcactaccaccaccaccatcaccatcacttccaccaccaccactgccatcactaccaccaccaccaccatcaccatcactaccaccaccccaccactaccaccatcaccaccaccaccaccatcactaccaccaccaccaccaccatcactaccaccaccaccatcaccatcacttccaccaccaccactgccatcactaccaccaccaccaccatcaccatcactaccaccaccaccaccaccatcaccatcactaccaccaccaccaccaccaccatcactaccaccaccaccaccatcactaccaccaccaccatcactaccaccatcaccaccatcactatccccaccatcactaccactgccaccaccaccaccatcactaccaccaccaccaccatcactaccaccactaccaccaccaccaccatcaccaccaccaccaccatcactaccaccaccaccaccagcaccaccaccatcactaccaccatcaccaccacaaccaccatcaccaccaccatcatcagaaccaccaccatcaccatcactaccaccaccaccaccatcaccaccaccaccatcaccatcactatcaccaccaccatcaccatcgttaccatcaccatcaccatcaccaccaccaccaccatcaccatcactatcaccaccaccatcaccatcgttaccatcaccatcaccatcaccatcaccatcaccatcaccacacctccatcactatggtcgctgtgactgagcccatcctcactactgtcatcagcactgtcacagcaccatgctgacaagcccacagtgggtttgagggctgccattgcttgggactagttcctcaggcacaggaggctccacgctggtctgattgcattggaggggatgcctgacaaaggtctttatggggtgtgcattgtggagtggggagggggaggctcagggaggtctcgaggacttcatgccgtgggcattctccccggcccccttctgtctcagcagctccccacgcttcttgactgagctggagcagaggaagcaggcaggggtgggaggaggggcaggggcaggagaaggggcaggggcagccacaaccacctccacttaggttggagcacagcctcctggcctccctaaagtgaagggccacccagaggaggcacctaaccattctcccctccggactccacccagtgcttggatagccagcggggcagcttggggtcggggctgggcactcagccaaaggggctggagagcatgccgtgtgcagagcctgctcccatgaggtggtgagagcctgctgcactggtctcctgccccgagccttggcttgctcatctatgaacgggtgacgtggtgcctgctgcacagcaggccacaagagcagagcgacaggacacagtgaggggcggtaaggtgctgcctggtaagagagctgtgggctggcctcaaggggtagcctgtgtcctcttgctgagaatagtgggaagcgagctgcgagcttgggcccacagtggtggtcttaggctgccgtggtcacataacgccacctcccagtgcctgcggcaccacccctgggctccgcagccccagccagccgtccatgtggcccatcctgtcctctccaggcctgtctgtgtgcacccagtggagggtctcctgtctcctgtggctccctgaggctgctggtcacagagctgatgaggacactagagaccgctgcggggctgggcgggggccctgtgggagcgcagcagcctgggatctgcagctggggctgacctagcacagcaggccactgatgccacctctcaagtggcaggggcttcacagcctcccactgcaatcccggcaggcctcggtgccagggcggccccatcctgggggccactgaggacctgcatcggccacagggctcgtgagcatgggcaccccagggctcagtgggggcagctagagggagggttcagtcacctaggcctgcccagagccctgctcagggcccaggatgaactgatgggggcaacctgcaggcggtgccagcgagagtgggcgctccccacaacaggggagccacagccagcctcaccgagagcagggagggaatgtgtggagatgcaggaaacctctgccacgtccaggaaatattattaacaattaaaaattttaaatcttggtaacattcccgatggccagataattaatataagagcagataataattactcaatgattaataactgcactgaatagttttcaaagtaattgtgataaagagaatgttaaatgaaaacccatcaaagttgctgatgccctgcacagcgagggcaccttagtgctgggggtggccatgtcgactgggctgagactggccccccgggcccactgtgtcctggtggcacgtatggagtgtgaggaccacctccccaacacacacggggtgaggaccctgcacgcacatgcaaaggcaggggtctctcttagtattggggcaggtgggcagaacctgtctctcttcctgcctcactgggattgtggatgaccatggggttggctcaggagtctgccctgtgcctgcagatgttctggatatctgggctagtgttggggggtattatctgacccatggaccagtctctggttcttctattgccccagccactccaggcctttggtgaaccccctctaccattcaacttgacctgccatgttcctgagatctagcccagggctactccatccaccaattctcactaaagtgtgagtggttgcttggcactaccctaatctttgccgcctcatgtgtttattggtgtgaagccttcagctgcagggggatgaagaaggtgattccaggcagagcaggcctgctccctccacccttaggctactgactctgcagtcctggacagtggctgggagctaccaggagcccaggttggggcaggacctggggacctactgcccctcacataagccagtttctccaatcctggttccttgccctgtctgccatgcctcccagctgacaccaccgtgcggctccctcacctcatcctctgaacaggaccatcctgagttgtcacagcttccagaccccccgaagccacctggtcccctatcaggctgaggctgtccagacatggcctgccacgaggccctgagtggatatgctggcctggacaccaaggatgagggaccctggcacttcgcatctcagggatgccgggtgctcacccgcaaagacccagaggagagaaggggagaaaaagtctgaagggctcgtgaccaccctggggtcctgatggggccaggcacggtggccatacttgtaaccctagcagtttgggaggctgagatgggaggactgctgaaagcctgcctgtgcaacaggcatagaaggccctgtctgtatgaaaaataattagctgggtgtggcagcaagtgcctgtaatcccagctactcaggaggtgagcccaggaattggaggctgcagtaaaagtcatgattgtgccactgcactccagtctaggtgacagagtgagagccagtctcaaaataaaaaaataaaaaataaaaaaaaagaaggactcctggatcaccctggggccgcgcagggatgggtgggctctggaggccacaactctattctaaccacagtggtaatgatggcttcgggcaggaccactgatggcacagaaatcaccgggtgaaaggctgatgcagatgggcctgtggctgagctcagcttccccacaagatcctgcttccagaaagaagaaggcgtcctcctggtggagagccctcggagctcagcccatgaaggagggacatgtggtgcccctgctgcggctgccgctccccaagtcaccaggaaatgcagaccactgtctgcggccactgcattgcttcccttgttcagaggtcgtcatcccacagtgatggcaaagatggcagtgaccacggggcaggggagagcccagtaggcgatgggccagacaggtgcgggcccgggcagggcagatggggcgcttaaactgctcttgctgcttctttgagagttaaatgtttcaaggcacaagactttaaaaaggaggcacctggagacatgaaggccaagggtgacagcctcgtggggagggccgttgggggccttcccgatgctcggcacagatgggcactgtgggctatgggccgggcaggtgtggtcctggcctcaggttcctgtctcccacttctgggagctctgcctcccttgtggcctctgtttcaaggtcatttctggatgggcaaactgaggccccagtggctggggttgtccaaggtcctgaaggccagtgttggagcctccgggcacttggcccctgcggcccccacgccgctacccccagcccaggccctcaggtccagaacctcttgccctccagcctggggccactgttctgagagtgtgccccgaacgacactccctcattagccgagtcccagctctgtgttctggggttggagctctggggctgttgtcctctgggcctggctgctcactgaggctcctccaggggccctgccacccaccttgtgtgcctgcagatgtccttcccatgcgagcaccagtgccacagccctgaccccccgccctgcctaccccatcatggctcgccaccagcccagctgagctgctaccccgagcccaccacttccctaagccccagcttgctcctggcacctggcatcagcctgggaggggctgatgatcttgggggaggatcctgcgacaactgccgggcctgggacagtgatggaagtccaggcctccagggaggctaggaggctggtcccagtccctgctcagccattagggctgcccctccccatgttggcctcagtttccctgtgcgtagcatgggtttgcggtaaaggtgatgcactgccatggcaaggtttgttattgagggtccttggagcggggccactgcagcaggaagtccccgtggggccccctgcgtggggttggcctggctcaggagatggtcccggctgctatttcatgtatcgtgaggacaccgaatcctaccccaaggccatgagggcagaaggccaaggctgtgagccttccctacttggagacatttgccctggggagcggctgttcccagaccctacatgcctcccccacgagtgatctgcggactggggagggcactgcctacatctgccccaaaggcagtggcagaggctttgtgggatgagggtggtttgtgctctcagaggcactgggctcagccagcggctgaggtagagctggggccctccggggcaaaacatcaaaagtctctgagctcctgtccagggcttggatgagttgggattggtgctgccccagcacccaggattccccaatgcacctgccacctggcagtccctccccagggctcagcacccaccatgagtcctcaaggatttgggtgattcagtggcctgcctcgctgggcctcccccttaataatgcattcttgctaataaccttctttcctgtgtgtcattaaacacatcctcctgctggtgggtagtggagcagccggtggtggctggggaggcccgggcccccaggagagagggaaccctgggaggctggggggtaggaggggacagggctggtgcaccacctgagaataggtacaggggctccagctctgggcagcatcatgagacgcttgtggggtcgggggcggcagggcagaaaacagcctacaggggccaggctgggggctgccctcctcgtcctgtggtcactgggctatgggaatgggaatgagggcagggcagtgctagtggcccacagccctggggggcagcagcccagggatggttacaggacaaggtttgcgtaaaaccaggcttggaggccggtgtggggtgatccctcttggaggtgaaggaagggagcagtgtggcaacgtcctggaaatcatggtcagagggcccagctggggcgtgtggcctggaaaaggcactgcccccacccccaccagccagggtctttcccttgcccctgccccctcctcagggccccgccctgtcagccctgcctgtgggtttcagccccatgggcagagcatcagacttagcccgggtggaggacatggtcggtcctgcgggcaggtcgggggagtcccaggccagggcccaaggccacccgggggcagccctgcccacgcctcatctggtggaccagggagaagtcctccatcaggcatggttacaaaacttctcagacttaattaaagtcaatctccagttactcaaatgccattgatttggatctcgactgatggggaaaatatgatcatcatcatgggaaacatcgataggaaggcgctgagtacctgggcacagggccgatctggagccaacacagtcacggagcccctgctctgggcccgaccacggggccctcatgcagaacccttgtccaggcccttccggaagggtctgccacttgctgcctgggtgtccctgaattctcaccccctggctgaacccaggggcctcacagaaccgggatcctgcagggctgatgggaggctcaagggtgcgtgtcttggggccggcagcagccagcgctctgtggagaccgtctaccctcgtcacgtggctggggtcctcttgatgttgcaccggggaccctgggctggcaggactaagtctaactggggatccagggctcctgcctatcagcccccagtgagtgagtgcaagagggaaggccctttggccagtgctgcaccttttacttgcgtgggctttgaggcttggacccagcccgaggcccattgggcagcagatgtcagcacctctgtagagggcagctgaggccagacttctccatccagcctcagcagagaagcaagggcggagagcaggtagaacatcaaggcggaaggaggtgatgctgttcgggggctggggagaagtgccttcaaccagagcacctgaggttctcttctggccttgcagcctggagcctggtctggggctaggaggtgtcgcagctgtgaggccccaagtgcaggcccaggcagaggagacctggaggcagctaatgtgggggagagttgactggggatcgtaatctagttttctgtttttccttggaaaaagaaagacaaagtccccaactcacctgcccttaaaataaaaagtcacaggctgggtgcattgcctcatgcctggaatcccaacactttgggaggctgaggcaagtggattgcttgagcccaggagtcgaagaccagcctgggaaacatagagagggaaaccccctccctacaaaaaaatagaaaaattagccaggcatggtgtcgcatgcctgtagtcccagctacctgggggcctgaagtgggaggatcctttgagctctggaggtggaggcttcagcgagctgggattgcaccattgcactctagcccgggtgacagagtgagaccctgtctcaaaaaacaaaacaaaacaaaaaaaaccaccaaaaaccaaagtcacataaaatgtcttcataaatacaatagaggcaaacctcatgtgatttgtgttcatggacttggaggggccaaaggcccaacagaagtgagaggaggagggaggggaggggtgcaagggccaagggtagaggccgggaggggccagcatggtggcctgagtccactgcaggtggcactgctggctttggtgtcctcatttcatctcctgtgacctctgcccttggcatgtccccaggtacctcctgtgggctcctggctggggtggggtaggaggaggaagctgagggtggccagggtctgtgtccatcgaggggtgtccaaattctagtggagggagggctggaggggagtggggaggggcctttggccaaagccaggtgctggggtgtgacggatctccacggttgctgggaccttgtggccattcctgggacatggctttcaccttaacaagggccctgggtgttccaggggtccccatcccctgcccctgggggctcagcacacaaagcccagcctggggcctgggccatggtagccagggaggtcagggtgtgaggccttggtggcctccaggtgggcggtgagccagggggtgtggacatgtggacagtgccgggcctgggtcatgcacttcgtcaacccttcacgcctagaccacagcctctctgagcagggcccagcttgcgttgtgctgagtcttttgttactttaattaatgcccagcttcctgacgcttaattaaactggaattgctccatgtccaatagccaagcatcccattagatacaagttaatgcaactgtcgcagtggccatgaaatgaggctggtgcgtcccccagggagggatgcagaatgcatcttggaggacagcatggcctgaccgggcagctgcacacagggccaaactgagcccgtactggacagccagccctcagcccacccagtacttccacaagacccttcccaggcccctcgaggaggactccccatgggggccctggcctccagctcctctgcacgcccgagggcagcctgcttgcttcctgctgaggtttgctgttccagctccatgagaaactcatgctagtgtatcaacatttggaaaatgcagaaaaattagagaaaggaaagtagggactccccaccccagaaaggtgccatcctcccatgggcctgcgttttgggctccgtaggggctacaaggtgctctctggggcctgcagtgggggccggggcaggagctctgggaaggcgtgggggcagaggccacattgtgaggagccattggttcttcaggagccggaagttctaggatggggggcagggctgggagccagcgggggtgaggcaggctggggatgctggggtgataccttgcacccaccaatctccagtgccagcctctcaccctgatggccccgtgtccaaggcagcctcacggtgccctctgccagtggccaaaggcattgtgcctggttggtccatcaccccagagtcttttaaaattaaattaaattaaattaaattataattaattttagagatagggtctcgatctgtcacctaggctgaagagcagtggcaccatcacagttcactgcaggcttgaacgcccacgctcaagtgatcttcccacctcagcctcccaagtaactgggactgcaggtgtgcaccaccactcccggctaatatttaaacacttatttatttatttatttatttatttgtttttagatggggtcttgctctgtcacccagactggagtgcaattgtgtcatcacagctcactgcaaccttgaactcttgggctcaagtgatcctccagcatcaacctcccaagtagctgggactataggtgcaggccaccacacctggctagtttttaaagttttttgtagcgaggggctttcactatgttgcctagactggtctcgaattcctggcctcaagcgatcctcccaccttggcttctcaaagtgctgggatcacaggcctgggccaccacacccggccagcccagactcttggttcaatcccctagagggcttgagtggggcaaggaggtggcaaagtgggcagcaagggggccgccctggacaggtctccctgtccccctacccgagggtactgagcggcctctgcattgggctcccaggctgggctgggtgggtctgaggcaggagcagcctccccctggaggccagctcaggtggcagaggcccggtctgccccgggtctgcggagccgagggcaggtctctggtgcgtaggttgctgggcctggctctctctcaagcttgtttgctgtttgggtcctcctctttggggccagggccacacgcacctctgcgacattagcttggtgcctgtgaggggctgggtatctcaggagatcgcagcaggtcctagcactaccctgttgcattcttcaaggactccccgcagcccagtgtctgtggagtggggcgtgaggtgctgcctcccatgttgctgcttagaaggacgcagccctggaaaccctcactgtggagtctctgagcccctcatccgcagagcagcagttgctgctgtttgcacagacagcaaatccggggcatgtttgtttagtaagattacctctgctggggcctggcccaagggacaggccaggcacagaggggtgggggctctgtgcatactgaacacccccccgagagtggctctgtctacagccggaccactctggaagtgacggcactgcgggcctggagggctggggcagtccaattgggcaccatgccctcacaaacaacacacacaccagcggtggggttgcgagggggcgctgagggaggatcctggctgccctgcttaagccctgcagcctgtggggctgtgtccacccgggtcgcatgttgcttctacctgcacggtggccccaccacacaaggtgccgtcctgccctccagtcaacttcctggggctctgagcagcctgtggtggcacctcacctgggcagagggtgggaggagcagcgcccttccttctgtgcagggagtctgatcagggttctgtctcactgtgggacagtgggggccggggaagagcggcaggtaccaagtgcagacagcagatgtagatgcatgcgggggtccgggctggggccaagaacacagccctggagtcagggacaccggcttcatgtcctcactctgccattcaagagctgggggacctcgggcaggtggtgtaggaacagggaggagtctgcctgcagcacgcagaggagggctgtgctggtcagggggtgttttggggagaggacctcaaagggaggttgactttgggaaaggggtcagagtacagaaaaagtgggtccaaatcctgcttcagcactgagaccctgcctcggcaggggtctccaagcttggctccaccccctgaggggccagttactgcatacctcgcccacccaggagctgggggccctggtcctgtttcccagggagctgttggcacttgtgggctcctggctggggtccaggtgggctctgctcctctgccctgcccagcgctttgtactgagcccatcctgcagagactcaacggggccaaacgcacattccttgaccttctgtgagtctgtcagtcttcatccctccctggacctaggaaggcctggacagctttgaccattggtgttgggtggacatggcgctgcgctgcaccccaggccctcagagcccagctgttctgctttctgcttttggtcctgagctgccttgaaggaatctgaccagcagggagagcccacggagcgggagggcctgtggggctcagccctgcagccggtctgccgaggccaggcctgggggcacagctggggctgagtacactgaatgccccctcgatgccatgcacagcagaagagctgcccacaccgccctgctgggccctgcccgggctccagacccacagaccaagcacacaagagactgggctgctttgtcatgcagcagcaggtagccggacacatgtttccccattcccctgccatcctctgaaatcctgtggggagaaagcatgtgaggtccagtgggggttggggtgagggtctgactgggggctttctaacccacgtctgagtcccatccggcgccagtgccacagtggcgggtgactggtgctgctcacactggcaagctcctacctagactttggagcccaactccacaaggcccctgaactacccctgtaggcaccgcagcccccttgccttcctctgctacgacatcaaccactctgatggtatttgtggtttgatgtgtttaagtaaaaggcttgttgcagagtttaattgaccccatatgtctgcctgaggaggccgtgagctgcagagggcaggtgtgagctgggctctttcctcagtccccatgtcttgctgggtactcacagggcacacacgagcacgtgcggcaggggcaggggccagcgggggatggggaggcttggcgcccacggccccgctgccccatgtttccactgcagccgaggagaaaacgaggactttacggctgtcacaaacatttcatcttgtgcattttacagtccacgactgctgtgaacactggggctcctgtcggagctagaagattcataaaatgcatgtgaattattttattttattttattgttttgagatggagtctcactctgtcacccaggctggagtgcagtggcgcgatcttggctcactgtaacctccacctcctgggttcaagcaattctcctgcctcagcctcccaagtagctgggactataggcgtgcgccaccacgcctggctaatttttttgtatttttagtagagacggggtttcgccatgttagccagactggtctcaaactcctgacctcaagtgatcctcccacctcggcctcccaaaatgctgggatcacaggtgtgagccactgcgcctggccaaatgcatgtgaatttttatgttcaattattccaggttccctgctcggggcccatgggcttccccatgtacaacccaccggtaggtccccgcccagtccatgctcctcaaaggccagcctcacacccatcccacgtcctcttggctggtaaacactctcccccttcttccttctccctccacatctcaactgctggaagggaagagctcctcagtctacttggagtccctcctgcacaagaggatccagggtggtccaggagggccaaacccacctctttgggtgcacccctgggcagtggattggggatccagggcttgtgggggtatgcacccaccagggcaggtccctcaggctcactctccctgcgcctcagtttcctctcctgaaaaatgggcttgtgactaaatgttgcagggagctgctgagaaaacgcctgctgaaagcttggcaggaggtcattgtgaccagggatggggctgggtgcttcggtcaggccagggctggaggcaggggctcacactggggtcagcagtgcaggggcgtggctggcgtggcaggcgcatggggattggctcatcagttgcggcctcacgtcccttcgttatggcgcctgcagaagatgttctctgattagtctgctgaattatgaattaggttccgggtccctgtgcagctgttcccggcttgtcatccccaccactttatttccccatctgtttataaaaccaggagcgccgtcctgcaataaacacttcaaacgctttttttaggggctaattaattgtgttgcatttcttcgacacagcatgcaggccggacctgccccgaattcccaatgcgggtgtggctcctgctgagcgcctggggagggagccaggcctggagcctggggggctgcatgtggccgccccaagtttgttttctccaaggcagccctccacctttatgtggcgggctgggctgtctcaggaatgcgccggccatgtcaggttccccctagattccccctccgcaccctttggctgaagtcctcctgctcggaccataggacactcttgaaattatctgtggcacatccaaggtcaaggtcacgccctgctgccagctacagtgctgaccctgagggctccacctcccaggcccactgagcatcacgctgtcttccctgccttgcctgcccagagcacctctgccctccaggaccccctcagcgagtgcggtgggcgagtgcagtgggtgggtggcccatctaggcaagccaatctctcctcggatccgtgcacctctttggagaaggcctctgggagccccagccctgctgtgcaccctgaggcctcactccgtctgaggaacccagagagcatcgcggaggaggcttaaaacaatgacaataagaaaacaaaatcacaatcaccaagtcacgaaacagctcagaggcaattgagttaggcagccccctgccagtgcccaatgccggtaaagtggctctttaggaactgagtcctaatgtgggctgcgcagcgggtcagaggaggtgttcagcctgtggccaggcattggggccccaagccagtcctccactgcggacagaaccttgcccagctgcagctggagcctgaaggcatccactgcgtgcatctggaggggtcgggggttctttgtccccaaggccactgtggctcctgtgggccaccgtcatgtccactgggactggtgggaaactgggtctggggacttgtaccctccgcttcctcatgtcctcatcctcaggtgccctcccagcccttcaggggtcctgttttccagctgtgggcaggatgttgctcctctgccctgtctgtccacgactcagggtgccaaggctggtggagcctccctgcagccccaagggaggaggctggggccagagacgccctggggtggggcacgtctcttcccagtgaacctcagatccctcgggcgcccacgctccccactgagggcctggggccacagcactctgcctgtgaggggtgggcccttggaggcttggggacatgcgcgcccacaggcacgtggggagagcctgctgagcgctgtctcagtgatggttccccacactggcccctgacatggggcttggtgtggcagcttgttggggaggtggtgcgtggagcaggatggggaccgggaggtggttgctgtgggctctgcggggcgtgagggccggtgtttgccccaagctcagtgcctgcctgtgaccacaccagctcataagtgacctctgggtggcccaggggtgagcggagaggggacctgagcaggcaacacgggcctggagaggagctttgtctctctaggagaaggcagcctgtcctgccagacctggtatcacgccaccccaaggcaggccccgcagagccctcgggagctccactcggagatggagacgcgcttccctgtgtcggggcttcgctcagaacatttttatgggctgttaattgttatgctttcatttaattctgggtgtcattccatgtcagccaagcccgacaggctgggatttatgcttccaaattatggggctcgggctgttcagaggtaaaacaattacccatcaatcagccaccaaccggcttgtgctggggctggcagccccattagcgggcgtgggcagccatggcccagcaagaccccttgagggacaggactgccttcgagggcaaggcagtctgggtgaagtctcgccccaggttggccctgtgctgtggcagggcgcagctctctggggaggcggccgctcagggaaggaccccagggtccacattcacacccaactggctccagtgctgcagccctcggcctcccatatgatggtgtgaccctaggtgggctgagggtgacccgccggaagacgctgcagcatcaaggtggggggaccatgggtcccatatgctggggcctggggagccttggccagccatggtcactcagtgggaggggcagggtcacctgcctcctgagcaccccatccccaggagggagggaccaggtgtgacccacttcacagggagggaagccttggctgtcagaggggacactgcgtctctcactgggaggacctcccggcctgggcttgaggcccacctggatctgtgcaaacgtagatgtgggtagggtggggcaggggaggggaggtgggcaggggaggtggagtgggctggctgtcagctcaggagtgggggtcggggaacctgggccacagagcggatcctgtcccaccttgaccctggtatggttgagtcggcggctaagccaggccccgtggtccttcacccagggagagcctgtgccaggccaggcactgccaggccagcacacagccttgactgagcgcctccccgtctcaagttgtctcctggatgcccggctggctgctcatggggacaggggcaggatgggacagcgagaagaggtgggctcccccagccccagtgaccctccaggccagggattggcttctctccctgcagagatcgcccttccctgcccctctgcccagctgccctgggacttgtgtcccagccctgcccagcattcatcctgggtgatctgcacgtgggcatggcgcctcaccgggtcagggtggtgtccaggtgagcaggcggaggactctcctcactgcccagcagtgtcctgctcccccagctgctctgacagccaaactggtccccagctggggcatctcacgcccagacctgctgcccgttggtgcagtgcagcccccgccaatgcagacactgtacctcggtctccgggaccccctctgcccctgcaattcgacgctctgctcctgccctgctgggatcccacgtccctggaccctccctatggcagtctcgccccgcgaccctgctacaggcctgccctgccacccccgggcacactccctcatccagagtctgtgcagtcacatgtggacccctgaggccggcctgcggctccctgctcacgggcggctaaaagggggctttccagtcacgccctgccctggccttctgcctaaggccctggccctcatgggccaggcatggtcctcaggcccttggctctgccaaggctctgagaccccaccctagagagaccctggcccacccagcctggccctgcagcagtgccccaagtgcccccgagcccggcctggctgctgccagggtgaccaccaggggcagtagtcagatagagggcggtggccgggcccagtgtgtctgggtgaccgcagggcctgaaggtgtggtggcccacccgggtcagagtgaaactgaactcctaggtcagggtcgggtcctcccagggtcgtgtcctctggaacttggggcgagtcactacgcctcagtgtcatcgtgggcagaaccttccacatgtggcattgaaatctttcaaattgaataggaaaagccccacgttttctgagccctatatatagaccagtactgtcctaagtgtattctagggaaagacagtggccagccctgtagctcagttatttctgtttaaagtgtgaacgggctgggtgcagtgcttgaaaatcaagcatgaagtgaaacccagtgggccgtgcatggctctgacacccatgagtcattcacacgatgccacttgctcattgctgtcccaccccaaatgcagcactggtgggcgagaccctctgggcatattacctgcgggatgtggctccagcgcctcacttccagctcactgctgcctcaaactcctggactcaaggaatcctcctgcctcagccttctgaatagctgggactacaggcatgtgccgccacacccggtgaattttttttttgtagagaggggttctctctatgttgcccaggctggtctcaaattcctgtgctcaagcgatcctcccaccttggcctcccaaagtgctgggattacaggtgtgagccactgcacccagcctcttcaccctttaaacagaaacaacaactgaacatacagggcagaccagtgtctgtccccagtgcctgtgctgggggtgactttccagctggggctcagcattgcgagtgggaagacctcctggggccaacatggcttggattgtgagggcacgtgggtcgccgtggggccagagtccagcagtggcagagctgcacagcagtggggaggggcagggcagggcagggagagggccccggctggcccggctggcccagcctgcccagggctgcacggtttccatccctgtccccagctgcagtgggacacctgccatgggggaggctgggggaggcctggggtggcgccttgggctctcagccaggagttcgctctctccaggtcaggctggcagagcagccccagggcccctgcacccccactgcccatgcccaccttgggctctctgatgcccggcagggcctctgggcttctccctcccaagcttgggtggcaacgctggcatttggagcctggggagctgctgacagtgctggtcctgcccgcgaaggaggcggtgccaggctgtttggaaatgtcaggctgatgggtggtggcactgcccagcaccccacccccgctcccaccccaagaggctggacacgggctggggccccggtgatggagccaggccgggagccaggagatgctgctgagcagggatagctggctgagggctcctgggcggcaggggatccgaggctgatggacaaggggcctctccttgccaccgcagctgcggccttggtgggccggtcgatgcggaagagtgatggtgcacgtggggccgtggggtgtcggagggaggtttattgatgtcggctgatttccctgggggccccttgctggcagcagccaccatgctccccgagagctaaccgtatcaggccggaagggtggtgggcagtgtgatggatggactccggctgtcggctggctgggcctggatggagccccgagatgggcacactgggccgtgacaagagtgccgtggggtccctgggggagcccaaagaggcctctgagagggtctgtgctgggaggtagacctgagagaggggagacaccatcccagggtgggcacaggcatggggcagagggcacgtgacgccaacctagggccccagggggtgggacggaggggcctggttctggggcattgggagaggcctgggactctggacctggtctgtctttcttgtccccagtgtgagcaccagcccttgcagctgagccctgggaggcgcctcctgcccacgcagcaaagctcagagctctgtggcctcctctgggctcctgcacagcgggtttgctcccagctgctcccctgacacggacaccttcaagggccacgtgactgccatccccaggccttggccctcgatgaggaagggcccttctcaacctgtggctctgaaataggtctcatgatggtgccagtttaatgacaggagcagtggctaatccagtggtcattattgcatgggctgtcatgcccttctctatccgtgctccctgaagaggcgagggtccactgccggctgccacacagagaagcatggccacagaaggaggctcctctgctctgagtgggatgttggctcctcgggccacactgggctggaggacaaggggaggcaggggtgggagggccctgggctggggtggatggggtgggcctcacagatggcatggccctgtggacagcgagtggcttttcctccccaggtctcgtcctgagccctgctcctcctcctggcctcccctggccccacacctctcccactggcttcctttcctggcctctttctctctgctccttgtctccatctctcattcctctgggccttgcttcacggagtcaccagcccgtgtgacaatgtccactttccctggcctcatgtctccaacttagtgtgggacctgcctttccaggctctttggccacatgagatcatggaaacacatggctgctgtacccacgctgacctggctcagccctggctcatgatgcttcctgtgcaccctggtcccatctgtacctcagtttacccatctgccacacagggctgagggcatctgccttgtgtgtggcggtcaggctggcccagtgaccgccgagccattttggcttcctcaggtctggccactgtgaaggacatggctgtgccccccgtctgccctgtgtggccctgggcacattaaccccttccataagcctggtctgcagacgagcgcccaccgggctggcagtgcctgaagagtctcgggcgacgtccactcacctcccaatctggtcccagctctgctcaaactcagactggaggatcccccagggcagtgactccagttcagagtctagctgactgcgtccctggcagccaggcacggcccaaggtccagagctggagactgacccccctgtgtaggacctctgggaagtccccaggacccaagacggctcagggctagtgaggtagggacaggtggctatttcaagcccccagcgggcttcctgcctggggcacctgggcacagtggagaaagatggctcccggcagaacacatgcccccatccttcggggccagatgccttgggttgggcacggagcagggcccccagcagacacagaggccagggtgggaagggccagggcaccgcgcagtctcttgccctgtgtcagggctccaggcctatggtggggctgggcctacccaccctgtcactttccccatacggctttggggtcccaggggttcaggggcccctcctgcctgacccagccttaactttttgttgtttcttctcattacaaaagaagcatgttcaaaagaaccccacagtcctccatgaaccccacagtaccccgtgaactccagagtcctccatgaaccctacagactctcatgcaccccacagtcccccatgaaccacatagtcccctatgtaccccacaagctcccatgtaccctatagtccccgatgcaccccacagtcccctatgtaccccacaagcccccatgcatcccacaggcccttatgtaccccacaggcccccatgcaccccacagtcccacatgcaccccacaggctcccatgaaccccacaggcccctgtgcaccccacagtcccacatgcaccccacaggcccccatgaaccccacaggcccccgtgcaccccacagtcccctatgtaccccacaggcccccatgtaccccacagtcccctatgtacctaccccacaggcccccatgcaccgcacaggcccccatgaaccccacagtccctcacagcccccatgcggggaaagggcctcacttctggccgctgactgacttgccagtttcctggagttctttatccaactttcaaggttgctgagtcccgggaacacctcagaaacctcacgaaacagtgacaggttgtcaatcaagcagcaaggttgacatgtttgagcaacgttcagcctgggaggcgctggggccaattagcagagactcccaggtagcagagcccccgggctcatggctggggggtggatggtcagccctgacgctgctgcccccacccgaggatttctccccagccatggacttggggctgagggattcctgtaccctcccggccacctggacagggtccccgccgtggcccggcctagggcgttggctcagaccacacctgcccaaggatggagcctgacacccaggaagcagctccttgcagcgccctgggcctccgtggggcccctcttggcagagtgacctggggaccaacccccttctgtgaggcaggtgaggatgctgccttgtgggctgaaggccaaggggaagaggcatactggggccactcaggctgagcagtggtcacagcggccacccctccctctccaaggctctggcgaccactgttctgtttagcccctacccctccccaccttttaaaaagacagggtctcgctctgtcacccaggctggagtgcagtgacacaatcagagctcactgcagcctccaactcctgggctcaagcgatcctcttgcttaagcctccgagtagctgggacaacaggtgtgtgccaccatgctcagataatttttttaaaattattttttgtagagatggcggtctcactttgttcctcaggctggtctcaaactcctggcctcaggcaatcctcccttcttggcctcccaaagccctgggattatgggagccaggttcccaaacactctctgctcttccctccacctggcatctccctccccaaagctctgccccatcctgaagtccccactgcagatgctgcccctcccagaaggtagctgggcatgggctctgcagctgcagagttatggactgggcctccctgggcagcttcctgggagctgcaccatgcacgggtcacgggaccctcctgggtaggttgaactgggaggcgacagagacccttctaaagtccctatgccgggtgctgggctgtagtcacatggtgccctccccaggaatccctgaggggtgggtgcgtctctctcagcagcaccagcaaggaccagcggggaggggtgagcatctttgttctgtccaagagcctctttggagcacgagcacttgccacatgcaggagagagccatgttcactttccttttatggctgagtttgagatgtctggatagagagttatcagccaaggcactgataaggtctgcggggggaatatactgtaaagggctgagcgtggagtgggggctacctctcctgctcgggctggtgttgggggttggggtgggctgggtgaagctgccactcctggcctggatatatggagccctgggcagtcctgcctgtcccatggctttgctggacacaacaagaactgccagatgtcatttgtgtgggaatcattttgctgtttgagcgaagttggatttgttagtgtgctcaccagtgtggatggatgaggtctgaccaggaggctgcctgttgtctgtctttcacagagggccctccacacccagggtagagctggggagaaggagtcctggggaaatactgagttaaacaaggctgatgtatcctctgcaggacttctcagtgcctttagcatggcgggtgtaggtgagtctaagagatggccaggtagcctaggtgtggatatcaccaggctagggctgctgtctgtctcctctgctcacgctcctgtgcagggagggacttgagggtgggcctggggaaactgtggaaagtaggagtctctgtccccagacactgtctctgaactggggccaagattcagtcatttcatgtccccactaggcagtgcttacagatgttgcccagtatcagctgcattgattaaaggaagagctttctgaccatcaggtgggggcgctctcctggtgagtggggctgggaggcagagccctgtcctccgcggtgtgactgggacgtaatcccctcctggggctgagtggagcaggggcttgcgcctcccgcaggcctagctgtgtgggatctcatggcactctgcttttattctgtttgctccaataccttctgcttgccacctgcgatgcttattttccatttccagtggtgctgtaagacttcctttcaaaatataatcacttaagttaaaaaagcccattcgaagaaagccctcgagtaaacaatagtggagcaggtgggcaggtggagctggcccttggccggtgtgtgggctgggggcaagtgggaagggacaacgtgggaaggaaaggggagcagggggtgtggggaccctccctgggaaactcccagcccgccctggcctctgttactgcctggccctgctgagctccctgggctgctgtctggtggccaacactggcgttggctgcccacatgccatggggtctgcacacagcaggggctgggggacagcgtcacaggaggaggaaggccacctgtcacaggagaaggaagggcacacagaggcttgtctgagccccacgtgaggattaacagaggggatgcattgcagtaaagagcacgaagctgctgtgacctttgcctctgaccgccccccttgcagggccacgcctgcacgtagcctctgggcaggtgccatggggtctgccaaggctggcattggctgcccagatgctgtcctgccctgaggttccatagtcctccggccactgtggcctcacactgtgtccagctatgctttttatttacctgttaacctcccagcatacttattcatgataacagtgacagggaatggggcgaaagtctgaagtgtccttcaccagcaaggggctggtggaaaagtgggactcctgtctgaggccactctgggtggtgtctgtgtcccaggactctacagccaaacccaatgcagctgggggccttccatccacagacccacatgagcagtggtaaggacctgctatattgagccagctcctcacacacgccctcttcccagagggtaaactgaggcccaggatgttgcctcttgcctgaggctgcatggctgggtggagccaggccctgacctctttgcttcttcacctgcccagggcaggtgtttggatgttgagtcgactgatgccccagggcgccaggccctccttccatctcacggtccctgcccctgaggcccgtgtgttggggctgggtggaggtggccctgtctcctttccaggtgagtggtgcgcaccctggtgagcaaggaccccaggccctggctgcagggcctccctgtggctggaggtgtcttccacacggccagtgtccggcacgagcactctggggtcggacacttgagatgggctggaaggagggggcatagagccttgcacagacaggggcagctcaggcctgggtttgaatcctgacctaggcaccctgtggtgaggacagccacaggctgaggacactggtgtccagcatgtgcccagctgtcacctccaccctgggtttggcatggggctggcagcaggcccaggagggatgggagtcagagtgtcagggaagcagtgggaactcgggacactctgctgctccatgggaacagcattggccctgtggtgtgggcagcctcagcaactgggcaggggctgtcagagcccaggggatgctcccagaaagtgggatgggagcccagagcccacagcccctgatatcactcagcctgggagcaggcccactgcctccaccgtgcagacgaggaaactgaggagggcccttgggtcccctgcccaggcctcacagagagcaggtgacagctggagccaccccaggcttgtccacccccctgaagggatccccaggtgcccaccctcttcctgccatctgggggcatgactcctactgctgacttgagagtgaagctaccgccaccgcctccctccacacctgggccagcctgggccatgccaggggcatgcctgcttctggccccatgggcctactggtcttgaccattaaaaagcatgtgttggggctgggcgcggtggctcacacctgtaatcccagcattttgggaggccgaggcaggcagatcatttgagttcaggaatttgagaccagcctggccaataggaagaaaccccgtctttactaaaaatacaaaaattagctgggcctggtgcctcccacctgtagtccagctacttgggaggttgaggcaggagaatcgcttgaacctgggaggtggaggttgcagtgagccgagactgcgccattgcactccagcctgggcgacaaagtgagactctgtctcaaacaaacaaacaaacaaacaaacaaaaaagcacgtattgggactacagtcaatgataatttattgtgcatttaaaaataactaaaagaggctgggcacagtggctcacgcctgtaatcccagcgctttgggaggccgaggtgggcggatcatgaggtcatgagaacgagaccaacctggctaacacagtgaaaccctgtctctactaaaaaaaaaaaaaaaaaaaaaaaaaaaaaaaaaaaaaattagctaggcttggtggcaggcacctgtagtcccagctactccagaggctgaggcaggagaatggtgtgaacctgggagatagagcttgcagtgagccaagatggagccactgcactccagtctgggcgacagagcaagactccatctcaaaaaaacaacaaaaaacaaacagacagaaaactaaaagagtataattggggtgtttgtaacacaaagaaatgatgaatgcttgagataatggacaccccatttcccctgatgtgacactaaccattgtatgcctgtatcaacatatctcatgtaccccgtatctcatgtaccccatagatatacccacctactatggtcccacagaaaaggcatgtattggggccaggcccaatggctcacacctataatcccagcactggtttgggaggccgaggcaggaggatcacttgaggccaggagttcaaaaccagcctggacaacatagcgagacccccatctctaccaaaaacaaacaaaacaaaaaaacttagccaggtattgtggtctgcacctatagtcccagctacttgggaggctgaggcaggattgtttaagtccaggagtttgaggccacagtgaggtatggttacaccatgggtgacagagcaagactatttctctaaaaaacaaacaaaaaacaaaaacaaaacacaaaaaagcatgtgttttcctgttctcccaccaccccacggcaaagacagtactggctattgacacaaaaggtgtgaaacgcccacatgctaaggaagacagaagcccccagaatccaacctgggggtgtttcagaagtgctgaaagggaacagtgtggtccctttaaatgatacgaaagagaggaagggggctgggcgcggtggctcacgcctgcaatcccagcactttgggagcctgaggcgggcggatcacctgacgtcaggagttcgagaccagcctggccaacatggtgaaaccctgtctctaataaaaatatgaaaattagccgggcgtggtggtggactcctgtaatcccagctacttgggaggctgaggcaggagaattgcttgaacctgggaggcagaagttgcagtgagccgagatcaggccattgcactccagcctgggcaacagggcaagtctccatctcaaaagaggggaaggaaagtgctgggtagaggaaggcatggtccctggctagggttccacccccatggacctaggtgaggacaggcatttcctgcccacatgttgtggcatttcccaagactacccgggcctgccatgctccatcttgtgcctataaaaacccctgagaccctagtaggcagatactctagcggctggacattgagaggagtggatcagtggaagaacgcacaagtggctggacgtcaagcggaatccacagacaggcactggcaggcctggcatttgtgaagccggctgcggcagaatgatgtggagtttggctggggcagtcgtaggagagctcaggccgcccaggggaaaatcatctcccttctggctcccccatctgctgagagctacttccattcaataaaaccttgcactcattctccaagcccacgtgtggtcagatttacacaaggcaagaaccccaggatccagaaagccctctgtccttgtgataaggcaggggtctagttgagctggttaacacaagctgcctatagatggctaaactaaaagcaccctgtaacacgcccagtggggcttcacgagctgtcaacatccacccctagacactgccgtggggtcaacaccccacaacttgcccgtctgtatgctcccccagaggtttgagcagcagggcaccgaagaagtgagccacacccccattgcatgccctgcgaaggggacaaaggaacttttcctgtttcaggggaatggtcctcactgcctcctccagattttctgccctgagttgtgaggacagcacagcttgggctctgtccacagcttttactgggagcctgaggctccgtcactcactcggctgctttttcctgtgctggatgaagcccaggagctggctgtgcaggtgtgtctgggatttcatgggcatagatgactccaggacagctccttaaacaccaagctcaagcaggtattgccagctaaatgaggtcaattcctggcagtggatctcagggcgccggccttggaccccacctgcttgcccacccccagcaggcagagacctttctagaaggtcacagatgctgctgcgggatggatcgggtcccaaccctggctgggagtgatgcccgacaagctgctgtaattctcaattctgctccggaggccttggagatgctgcaggcgggcaggtggggttgggggtcagcgtcacaggaggggaaggccacccatgggggcacataggggctagtgtgagccctgcatgaggattaacagggcatgcattgcaatacagagcacgaagctgctgtgaccttcccctctgatcgctgtcacagggcctagcctgcacgtagcctcctgggcaggcacacccctggacccctccctggtgctctgctggaggccacgctgggctctggaatcttactgcacagagctcctggagacccaccctcaacccttgggccccctcttccttcctgggtcctggagggggctgttagggggcatgaggccacgcagcccttgagcacctactgtgtgcaagggcctggcgtttgtgaagcaggctgcggccatcctgggtgggagtcagggaatgggggtcccggaagtgctggcttttctggtggctgtgggggatcagggggccttgctgtgtatctgtgagctgagccatcctctgaggggctgagcgctggcaggaacctatcacgtttcccaggggcagggttgggcatgagaagccctatcctgcctctcagctaggccatgtttcataccccacagatgctttggaggtgacagatctgggtcaagactggccttcctggtgaccagccttcagatggacactgggcggcaggtgttcctgggctgccatggctggtctcctgtgctggtccccagagcagccttcctctcccctccccagacaccccatcctctgccgaggcctgtgagcacctgctgtgtgcccaccttttgcttaaaccccaggacggccttacccagatggggagccttggttggattgaaggggcttgctggaggtgcagggggaggggaggtcagagcccacatgcatcctgagctccctcatcttccacaccccatgctcatccccccaacctggccccgatgctatcagcccttagctgggggagggcggaccccggggacctcagaggcagggctcctgcaagcactttgctgcacatgtctctgttcctgaaaatgccccaaccccaccagggcagcaggcagcagggtctgtgggaaagtcaggagccccgctgatggtcctgaggggccaccccagcctcaggaggaggacctgcccttctcagggccctgctgttgctccttcagctcgcctcctccatgctggcctccgggctgctcacacgaggattagaggcaggaatgaagaaaaccaaagtcagaccactaccaggaccagggtacaagagaccaggcctggacaccacttatggctgggggccttgggctggtcagcgcctccccctcaaggcatatacacagtggatcggtaaaggctgtcccatctggggctgtgtcaggcctctgtgggaggaggcatgtggcgggcccagctcagttgatggattcagacccatgcatttggccagccctagtcagggaacattgcagccactgcctgcccagcactgggcaggaggaagtgtcctttctaagagtggagggagctcctgctctcaggcctcagaaacgaggtgctaagggggctttcaggcagcagcctcaggcaggaggagctcccgtgccatgcgaatggctttgcccagacaccgggtggctcaggcaggtcactctgccttctgtgtcctcctccttggtgggctggtgggctgagccaggagtcgggcttggggcctgttccaggcttgcaggcaggaacaggcccgggacaccccagagacaatattgatgctgtttctgcccaaacaaatgccagctactaattccggtctctgttggaaacacagaaatcaatgctcacagaacagggaggctggccctcgaggagcagtgtggtgttgggtccccaggcagtgattacgacaggacaggcaggcaggagaacagagctctcgaccttagacacgtcccatgcggccctcacctggcgacctggactcggcagcacgttgggggtcagaacagtgggttctcagggacctggcctcggggggcacccgtcatccctcagcaccctcccctgcaaaagggaagcagggcctggacatgacccccaaccctggctcctgccacattcccctgactttatttaccacccgagagactcataaataatagttgaggggtcagtgagcgaatgaactagccaaaaaaccagctggggaatgcgtgtgcaggtggagagaatgggcgctgggcctgcctgggcacaggttcacgggcctctggatgcagctcaccccgtgggagcccacagccctgcaggccgggcagcctgagggccaggacagccccacccttctctcaaggtgctggtccagggcctgtttccccatccatgtagcattcttgatctctgggtcctaccacgtcccttggatctcaggctcccagccaggaggggctcccaccaccatctcatgaccttctgaaaccccagcgctgggtgtgcaccttcttgccaggctccatgggcagcaagcacccgcccctggcctgctgggcactgcacccaggaggtgcccagtacttgctgggacagctgtcttctgctatgtcctgggctcgtgtcctgcctgcagcttccgggctggggagcttgggcaaggctcttggcctcccccacccccaccttggtatccctcaacccatccccctggacatggggttggtgcctctattggaggaggtggtaggtcaggcagcctctggcccgcaaagtcggccctgggtccaccagccgcccctctgccctgcctttcccgggtcccgccttccctttctagggctatggctgcttgtggacaagcgtctcacgggtaggaaacgggacctctgagagctcctggcctggctgggtcctcagcatgtgggtctgtgagccaggtccacgccaggcaagggtttttacctctctgagcctcggtttcctcgtctgtaaaaatcagtgaggggatgtctccttgttgcacacacagcaggactgagattagagccacagcctgccccaccccagcccctggtcaggtgggggtgctgccatctcccagcagcctgcccaggcccctccctcacctgttccgagacttcctggccccacatgggcacccggcatccttgtgggctcaccacagcctgatgctgcccacagcccatctgtgtggcctggcagggggccccacagcttggaaatgccggtatctccttgcagaccccaggtcaacactgtagattcctccctcttctgtcatggaccccaggaaggagggtgggtggggccctgggctggtgcaccgccccagaagccctcagctcctggcaggacccccctccccctgcaggccctcccctgggagcagctgcttccctgttcattccaggctgggtggggacccccaggatggccctttctctgctgtctgtgggcctagggtggggtggccctggccaggccctgtatggcctcccaggcttccccttcacccactcgttgtgggcatgtgacacattcattctaactacaaactgacacccactcactgagggcattgaaaaaccggagagccccaggagccaggtcacgtggtgaccccgacagagacaccccacaagggtgtcccagccaggtagagtggccctgggttggggaggcttttaggttggatgcttggttaggcacctgccaggtgaacctcagctgggggcagagaacctggggccaaaatctgggggccgtggtcctggggcgcttccctgggccccactgcaggcacatgccctcccaccacgcgggggagctccccctgcccgtgagccctgcttgcacttcctcacccgtcctcaccctgccccagcctccagcccgccctggagcaggctctgtccctcaggccctcttggccatggggtcagcctggtgcctgctattttgccctcaggacccctttctcctgacccctgccaggagccctcagcattcactgagttttggaggagctccctaaacacagctgtgttcactctggaaggctgagatgtgggggcaggtgcgggtggggtaatgatgttgggtgggctggcagtggagccagagaaggccctcccaggacgagggcgcagggggctggaggggagggcactcgggccctgcttgagattgaactcagttactgagcagccagtctgccaaagtctgatctcccggctttcattctacattaaaaattgatctgagatgggagaagtgaaggcagtggccatgccaccgagaaacactagctgttctctgaggctgctggagacacagcctcctccaggaaggctcccagaggcagctccagaccaccaggcccgcttcctccatgctcatctgccccacgcttgcctcagactcctggcagatcactaacccctctgagcccccagccaggcctggatgggtttgtgtttgcatgaggaggccctggtcctcacaggctccccctgtagccagggcagtccatctcatcctcacccccgtccactctgccggggctcctctgtccctgagttctgcctgaggggctgaaccaccagcctcggggcgggggaagcccactgcacaccacctccctgacatcccgggacatcttgcagagaaggaaactgaggcttaagagaggaaacagtgtctgcacagggcacaaagccacagagccgccttctgcacagctcccacctgcacctgcgtctccaggggagctgggattttccaggagtaggtcctcaactcttgggcatgtggctgggcccttcccgaccctcagaggagagcaggagccacgggacaggagtagacatgaagaagcctccacagggttgggcttgcccagggcagcctgtggccagcgctgggggtcacggccccagtggccttccgagggaatggacaggtctgccccatctctcgccttggctcaggctctgtgtgtgctcactcaatgcagccgccagctgctgctcccccacggggtctcgctcactgcatgcgggctctgctgctgctgtcggtccttggccttgagaattcctctctgggaatgcgtgtttctctctgtgaacatgttttgccttctacaggcctccttagcctcatcagagactcctgaaatgagtttcccggtcctgtgtgggccaggggccacccgcctctccagacccccagggcccatagtggcctgtccttttgtcctgcggcctcgggcccctggggtgtgtgggggggtttcctgtccttcccctgagccctggggcacggggacccctgggtggatgcccctcatcctcatccagtgcgcttgctgccggccccaggccccccgcgaggggccctatggagtcgagacaggagcccacctataggccctgtgtggcctggaaggtggggatgccaggggagctctcctgcaacacccctgacttccagactcccctgagggagggacttccacagggaaattaaccccggacgagcttggttcccaggaactcacttcgagcctccaggaaacaaacagccccagagggcaggacactcggtgtccgaggcacaggagtgagcagggtctcctgggcaccggtgacctccaccagctcatcctttgtccacacctgggtgggctgtccctggcgggctctcagggtagaggcgggggctgggtgggggcagagcaggtgcagaggctggtgaggcctgctgggtgggaggtgggggtgaccgctctctggctgccttgactccattcatcagcctgcagacccccctctccaacccccagtctttgaagccacaataaatattgatttgggcaaatcgatgcatttccgagggcctgggtcgatagcaaagttacaaggatccgggcaaagtcattcacgtgcccaactccagctctgagaagagcctggctagagctaaaaggtgactggccatgtcccgggtgccagtgccaccagctgggctaccccaagggatgggcagtgtggcccctcactctcacctggccacagccaagctggggttgaccgtcagagtccggctgcctgtctctgcgtctccccgtgtctgccccctgcccagctcctggctgcatggctgcctctccccgtcctgtctgggtgtcttcccgcctggatcccagacactcttatggggcgcttggcactgggatctgagcagttctgcacatggtaaccacgggtccagggtagagctgagggccctcatgcgacgcctccctcgggctctcacagtggcccctgcccctagatgggaactcattgcttcctaagctgcctcttccatctccacccgcagcagtgcctcaccctgaccctgggccacagaggggacatctccccaaatgcacacaccagccttggcctgcttaaggtcacctggccatctccccgctctggcctcagcctctgtgtttctgctgtcttctctgactccccgtggggtctgtggagacctgaccactgcggccccacctgggtgctgtttcgcacgtggctccctctgctctgtccaccgtccacagttcagcccttcatccaagccccccaagtgcctgaactgccctctctagagggcaaggctggggcccaggaccctgggaggaggtgcctgtcctctgagtcctcctaagccagaggctgggcagggatgcgctcaagggcggtgggcatctgggctgagccctgcaccctcttttctcctgacatcccttgcctccccccaccccgcctggtctccctccctctctaatcatttctcatggctccaacccactctgcctttcttcctctcctcgaactacaaggctgggtctggtgcactctggtggggccaccttatttatgagaatttgggaaatgcagatgtgatgtttccagctaatagccccaaatcacttgcaccgccccattagcggggaaaccagcctgtgtacattacataccacctaagtgggagccgagacagcggttttatgaccccataaaactttgggagtttattgctattgaacaaacatgtaatccgatgcttcaagttcaatatatatagccagcagcatctagagccaaccatggccgtggctcctacagctgggccaagctgctgagacatctaggggatttggagccgattggcaattgatctgctgtaggacaggggcaggatttatggtggccttgcagggctggtccttctgcatactaaacagtccagaggacagcaaggggagggcagccgcctggagcccagggcaagtggctgcttgtgggttgctggggcagagcctttagcaaaggggtatccaccttgaggacctgcccctgtaaaaacccagcttccttggagactcagctgcggtgggagccatgcagaaagtggccctgtggctgtgtgccctgcccttcaagaggcaccattgcctcctgaagcctgtttccttgtctgcaagatgtcccaggatggtttgttgcccaagaggtggcccagcagagctcctggaaggaaggggcaaacacacaggccagagcagcggtcaaatggctaagccttatccaccagagcccctcacccagctcccattcatccactgtccaccatccattcatctaaacacccatctatctaaccatccatccttctacccattgatcctttcacccatccacctgccactgatttatccatccatccctccacccatatacctatccatccatccatccatccatccatcctttcattcatccatccacctgcccatccacctgctcacccatccattcatgtgtccatccatctatccatccatttactcacctgtccatctctctattcatccactcactcatccatgcatctatccacccatctgctagtccatctgctcatccgtccatccactcatctatccattcatccatccctcccaccattcattcctctatttgtccacctgtccacctaccattcatccacatagccatctctctatgcacccatctgttcatcccccatctactcacccatccattttcacctactcactgtccatccacccacctgtccattcacccacctatctgcccatatacttgtgtgtctgttcactcattcattcaccctccattcatctgcccatatacttgtatgtctgttcactcattcattcaccctccatccatctgcccatctggccttctatcctttccctcaaagctgccccttgtccagggacagggctgtccttatagtcgcagagatgattggagcctgagagagccaaggtgacttatctcaccttgcagaaggtgctggcattattgcttgctcaggacacccgcatcctcttgccctgggcttcacactccaggaatgcctttctcatgtctgtgctgcatatacttattgtaagtaaaggagaacctcatggccgatgatagtttgttcatttcctcccagtcttattgtgtgcacctattctttcttccaagttcacagtctctctgggcttgtatggcgtgcatttcactcaccacagatgtctcttcggggctggtccatggtgttactctcccagcattgacttaaacatttccccactgttggatagtgtagctgtttccacctctttgtggttataaatatgctgtggtcattatctgagctggcagagtgaagtccgcccctctacgtgtttaattagcatagactccaagagggggcattcatgggttaagcatctcatgacttgggacaccccttgtccgatgacaaaaacctggccctgtgatccctgccctcagtggaggagggagggccttccgtggtgcccggccggaggggctgggatgtgttcactgtgagtctggtgggtctcacatgtaggcagagtggggacaaggcagcctgctctgtggcgtgtcccatggcgtccgggttgccttgtctgcagttcactcacattgcccttggtgttgctgcttcagataagttcctgccgtgttaatgctattaattttttgtcatgttagtgtcaaaaatttacccgcctcatttcttgtcttttagcttgatgttttcctttgagccacctgagaatttagcttccacacagtcaaagtgaactcatccttccctttattcttggaaagttccttctcaccagggattcggtaaatatttgcttctgtttacttcctgttcctttcaatggtttaagttattttctgtcagcatcaacttattccccagcccatatccgcaggcctcacactctaattaagaggatgccctatggccgggcgcggtggctcacgcctgtaatcccagcactttaggagcccgaggcaggctgatcacttgaggtcaggagttggagaccagcctggccaacatggtgaaaccccgtctctactaaaaatacaaaaattagccgggcatggtggtgtgtgcctgtgatcccagctactcaggaggctgaggtaggagaattgcttgaacctgggaggtggagattgcagggagccgagatcatgccatcgcactccagcctgggcaacagagtgagactctgtctcaaaaaaaaaaaaaaagtaaaaaataagaggacaccctgtgtccctccctctctccctccctacccttccttccttccttccttccttccttccttccttccttccctcttccctccctccctccctcccttccttcctccctttctgcctaaacttttctcaatagcctcaaggctgcaaataagacctgcccctggcctcagtgacttggtggcacagacgtgcaaagcacagaacgcagaaattcaagtcagggctgaggactgggggtggatgggggcctgctggggggctgggggagagagtggcagggtgagctggggacattggaaaactcttgcagctgtgactgatgatggtgggcaggtgtaaggggtggcttttcgggggaggcacattttggcactgggttatgtgcttcagcaccaggagcaggggtgaggtagcagacggaggggaggaggccatacacctgggcaggggctggatgggactggctgacagctgacctccctcctgtgcccagagagccacagcctgctcggtggcccgcatgggatgaaacctttgtggtcccagcttctgatcactggaggtgagaactagtttttgagagacgggagcaactgctgaagacccaggggctggggcacggcccagcgtttgcttttgagagcttcgccatggcccgtgtggagaggacagcaaccaccagggagggggctgggtgccccagcctgtctgccagcttctgagccccacctgcgtctgcacctactggagacagctgggtgggctctaacctggatggtcctgggtgggaatcccagctctgcctcatgtgagatgagggctgagcctctgctcatcttagaacctcagttttgtcacccatacaatgggatggtcagttagcaaggaaacgcgtgtaggtgccccgtgtagtgccggctgcctgggaggcgctcccagaatgtttcagaggtgattcttctcaaggacttcctgggccccttggtcataaggctctgaattcccagcctctggcctgagtgccacagaccctagagggttcctggccactcctggggtctgtgtggacctcgctgcttaaggccccccgtgtgcactgaagcgcgacaccccgcacgcaggggccatcaggtctttggggattgatagaattaagcccatggaacgtgcatttgcttgctgtgaagccgcaacaatctcgctgccacagggcagaggacgttctgaactgagtgtcccctcggctccctcaccggcctcctgcaccagcagatggtgcctgatgtggtggctggcactggtgccccttgccctctgagcagcggtaccatcaaaacccatcttcccagcagctcaggatcaccgcggtggagtttccagtcgcagatgcccttggcaggggctgtgggactgcaggggagacggaggtctgggccctaccatgtgggggcagcatgcaggaggggcccattcctgccccccggcaatacaagaagcctacgggggtgcccaggggtcagggacctgagagatgtgctcactgagacctagcatgctcacccccagctgccagagggggtagttcccaaagaggggcaggccctcagagtgagctcctgtcctgagatgggcaagggaatattcctgggacactgcagaactgttaccaagccaggcacagatggggccaggcccctcggcctctaagacaaggccggcccatggatggagcacgatggccctgaccttgggcacagacccgacgattgagtgagatggagacacaggcttggcttgtccccaagaagaaagaggcacagaagcagctacagagtttcttgcttccctgtttgggttgctgctggctcaggtaccacagctggcaacagaaacagaggtcaaggcccagagggagggaggggtcgggtctgctttgtccagggctggctggccccaggagggccccgaagctgtggcagaagcaggtaccagatggtcagtgtagcactgtggctagcacccaaaactggacatgggctgggagcagcctgagatgcagggcagaggacagcaagccacgagtctgaatggcccctgttctggaggcagtgctgggaggtggaggctggagggggtgtctcgcagagcctggtctgctgagacataggctgggacaggctgctgggtgtactgtccctgggaagtgcaaggtggcgagtcaggaaggccccaggagcagggttggggcaggagccagtgagcagggcaggaccctcatctggaggggctgggggaggtctccagtctgggatgggggtgttcccggcaccagcccagtgtttctggtgcagcagccacgtcattatggttggaatgtgaccccattagccctggggcggggctgttcaacatcctgaggataattgatcagagggaggaggggctgcaccgcttcctagcaggttgagttaattatcagcctgcattagcacttgacctgtggcatgtgtcaactcattactgctaattgcagggactcagtgacctctccgaacttctgtcacccctgtcacggcccctgccctgtggaggcctgtggaatgggaagtggggaggggaaggagaagggggcggagtcagccggagcctcctggccaggcctggagtcaccctgtcctgccacagctctcatgggtttagagtgggccctggggcagagggtttgcaaggataggggtgggtggctctgccgagggcggtgttctgagtaggtctcattccccagtctgcccagcctggccccaccccagctctgctgccctgttactttgtccccctgtgttcaccctccacttcctgccggggacactccaaggcctgccaaggttggagcaggggtgggactcagccattcaacaaacgcttccttggttatgcagggctgggcattggggtggggggctgacctggaccctccaagacatcagattgtccaactgctcagttttcattggggcaagtgcctcgctgagggtgaagggggctgtgagtgcccatcagggagcctggacaggtcccgcctctcacagctgtcccactctctggagctgccttggtggcagatggcactgtcctagaaaggtgaggctggagctgtctcttccaccaggggtggccaaggacgcttccagggtcttccatgcaggcctccagggtcaccctgggcgtggctgagggcatgcagaccacgctgtgctcccccccaccccccatgcccgtcgcttgcctgacatgctcctcagctgtcttgccccgcagaagctgtgtggtctcccctgtgagtagagtcgggctccatgatcctccggagcagcgccagggactctccccaggcacaattttaaagggggccctaggacctgccaggtccacggaagtggtccttgtaactctctccctggtggcagcctctggtgcattccggcaggggcagcccctcctcatcacagggaccctgtgtgccaggccccagctgcgttgccgctgaattatggatttaatagcagagaagccttgcaggccgcctgtgctggctcgggaaaccggggcccagccggggcctgtcacggtcctggtgccgccctgcttcctgtcggcgccacggagcaagcggagagatttatcttcccggctttaagaggtactaacggaggaggctgagaggcaggagctgaataattgatggccttctctggctcaggatctgctgaaaatgacacggtgcaaggcagaggggctgagagtgctgaccacaaaatgctgagaagccactccagggcggtcacggccagaaggaggacccccactcaggacggggtcacaggcatttggggcgggtgtcagaggctcctgccctgggtcattccagggggccaggatacccagaagctgggcctagaggcccacagggctggctcacccccacttccctctcacacgcctgccatcaccggtgcttcagcccagcaaccccatggctcgttggccccgtccacagcccccactgcctcctgtgtgctgggcgtgggcctctgagctctactctcagcctccttagccccaggagaggagtggaggacaggggtttaacgtggggtgtggtgcggagcggggagggctgtggcgccccctcagcccctcctttcctaacagcctcagcctcccccctggagaatcccctacctgctgggcacatctggcctctccccaccattctgtctccagccgggagatctctacccagtgaaacagtgaaacaggaagggttccctggttaccccgcgcagggcgcagggcatgcagcgggggagtggctcgcttcttcagtgccccaccgctcacacctctaggggagcatacagacgggcaggctgtggggctctgaccccatggcagtgtctgggggtgaatgtttacagctcttgaaaccccagtgggagtgcgttaccgggtggtcttttagtctagcggtctgtaggtggctggtgagagtgagctcaattagacccctgccttataacaaggacagaggaatttctgtatcccagggtttcttgccttggtgtaccaaaaaattggatcacacgtgggcttggagaatgagtgcaaggttttattgagtggaagtagctctcagcagatgggggagccagaggggagatggttttcccctggagtcaggcaacattctcgggatgtccagcagcttgtcttcttccaccagtgtgttcctctccccacacagaggcttctgtctctgccttgctagggtcttgggtttttataggcataggatggaggcatggcaggccagggtggtcttgggaaatgcaacatttgggcaggaaatgcctgtcctcacctaggttcgtgggggtggagccctaggcagggaccacgcccttctctacggagcacttcccgtccctcctctgtatcatttaaagggaccacgcttttcccttctcagcacttcctttccgtatcaacaggaggccagggactggctggacccctaggagccaggtcctacggataggtgagccggccccccagggcaaacacctccactgggcagacctgactgcccagagctggattctttacttgtaaaaggggccatgagtgacacaggctcggcctgctgtgccttgaggaaaggagaggctaaaaattctgccttctctcctaaagccagccgggctctttatggtgggggaaggaaggatttgtttatttgcactcttctgaaataaaagttctctatcctccctcctggctggagttgggagggccccatgggtgggctctgagatgtggcacacggtacccagggcagggctgggaagggtggggtgcaggggcctccctggctgcagggcccacccaccaggtgcctgggcttgctgcactgagcaggcatgggctctggcccccctcactgtcccttccaggcccagcctgtgttcagggcccaggacagggtctggccagcaggccccaggcctccaagatgttctcagcctctggagtgtgtgtgatgatgagcactcatggagcttcctgtatgctgggccctgggcttctgagagggccaccgggtggcgactgagtcacgaggtggagggccagtcccagggactccaggtgacctcgtgtcggcaccacgcccttctcccatgggcagtcctgggcgccccttcctggccttgggcccagtggcctgtggcctgaccccgtccactcctgcttggttgtcccagcagcagcaggagcccatgctggagaaggtgttatggggcaggtggagggcccggctgactcagatgatcccccaagtttcttttcaatgaacacttgtttagtgcagtttttcctcctcaaatccccctcacacaggcagacaccctcttggcccagggtaatctgctgagcctttgctcaaatatagcagctttgctgctttctaaacacaactaatccaatttgggatttggggattcgaggtgggcagcactgggcctcagatgagcccccatcaccccagacccatgcaggaagagccaggcagggtggggccctggggccacctggtgggctcagggccagggcatcgcgatgtccccatccttcacactacggggcttcctggctgcagagttggggactcagctgggaatgctggccatagaggcagagagcccccatcctgctgggccagccctgacctggcttctccagggtggcccagtgtccccttctgcccttcccctggctcccaccgtccacatccctctatctgcccaccctggacaacaaccagcacagtgcagtgtggccctgcagtgacaccacctgcagagaggtcaggcccagcctcccccgtctcctaaaaggccagcaggtcccaggagctgggggtggggcctggctgtggggcctccatgccccaggggccagggcagaccctccttagccggcaaccactgcagattcctcccctggccagcactcggggacctccctgcccctgccccgtccccctaccttgcctgctgagacatagggctccacgggtctctctcctggggccgggctgactgtggcctgcgaggggcagtcatcgtgttgggttttcctgccagaggcagaaaccacaaaattacctggaacatacacgccccaagtgacagattcaattcaattccacaaatattgacctcgcgtctaatccactcgtcctccagtgccagctcattcctgagaagcccagcctggcagccgcagatcccatttaatcccagccccacaatgtcaccagctcgcagcttgggagctgggctcatccaggccctggcaggtggggccagagctgggctctgacctctgtacccacacttaccaccatgtaaagtgctgggaagaggggtggggagtcacggcaagttgagggtccaggcttgccccagctcgccagatgctcgccctggctgccctgacctagcagctaatctctgcggggcactgcggctacatggtgactccagcacggggacatttatcagaaatggaactgatggattaaagtggaaccaagcgaattgatttttctccctgggcactgaaatgctgcgcttaatcaagcgatcaactccgtgggcagggtggctgtggggacggaggtgggggacaaggggatggtggccatggtggggactgaaaggtggctatggggacagatgaggtgagccaggtggccctggggtcgagctccagcccagcctctggcaaagaggccctgtgtgcagaagtccgggtgtgatgccctccccccaccgattgtgtgataccggccagtcctgtcccggctgagcctcggtggccttgatgtaaccctgtggggtctggtggcagggactgattcactcatttgctcattcattcatgtgtttgacacacactgcagcaaaggaaaggtgagagcagccacaggctggccagggacgattcagacttcagagtgtagcgtgcccgcccctcctcttgtgaggtccagccttggtgtgtgtggattcccaggcaccctccaggtccaccctccactctgcagtgccccgcccacctgtccacatactctgttctgtggtttgatcgccatccttctgctctgcggccaactggatggcccaagcggactgagttgggcagggtggtcatacctgtggagcctgtggctgtggttggaggccccgtgggcagctgaggcagcctgggtgggcatgtcccactgggacttaagcccctaggtgggctgtccgaagtgactcctgagtggctggggtgtgctgtccttccagcctggccgtggtggctgggtggtgttggaaggcactgaaggaagggcaggtgaattcgtgctggacctggtctcagtgccatgggccccaggagcccatgacatcactggcctcatggactgtggggattaaccctgtcactggacacccccaacacaccccctccaaaagaaaggtgttggcacaagtgaaaccccttgagtgatggctgggatttcaagctccagactggtccccactaggaagctctgggtctggctggtggagcaatgtgtacccgcgcctctgcgtctccctgcatctggcagccctcccaacagggctcatgtggggtgcagtgaagcagcaaagccccccaccccaccccaccccagactaaacacaggctgtagacctggcccagggtgagaagggcccctgtggaccacctacccaggtggtctgtggcagcctctcccagctttcggtccaggtggcccagggaggtggcagccctgacccttcctggcgataccctgattgatcatagtgaaacactgagctgggagagccaggggcacccagggctgagctcccggggcagctcccaggagctgcaagtggacctggcactaggaaggagcagtccaccgagcacctaggccagggcccgggacggtgccaggcaccagctgaggccctgccaggccagccgcatcttcacattcaagaccccaggccccagccacggctctgagctctgggtgtctgcagccacggttggcagggtgggccccaccttgccctgactgggccacggactggtgtgaagagctctaaatttcacttactcccccaaagtagaagtggcctaggactgtgtggtggctcctggtctccagaaccctgccaggctccagggcaagcagggaagtcaggcttagctgcagggcagcacctgtctgcacaccccgtcctgccacgctccctgcagggacctccgcctgttgtccatggtccagcttgctggatggggcagcagctcctacactcagagctctgccatccccagccccaggccaggctctccccacagcccgttaggccctgacgtcccctgacaaccaggagttggacaggcctggcccccaggctgccccacactgccatgaggaccccagctggctgagtcccatgtccaggctcacttcctctgtccctgcagcagtgagcacctgggaccatcatggtgagcaccacccaccttgccccttggcccatactcggggacctgggttccccaggtgatcagggtggcctgcagggcctgaggtggccatgccagccaaactccccctgccccacaactgggtcacctcttcaccctcccgcagcccttgggaacccagtgagctcctcccccttgctgctttgtgagtgctggcagtcctgggttgctgtcctggagctccaagacctcccttctggaaggctggggcttcctggtggaagatcccgctcacctcagctgtggcgtgggcctgggcttcagcctggggcagccctcatgggcaactgcttcagactggaccccatgtgctggggtggccagggctgtgcatggcaggttcagggcacagggtgcaggcaagggtgtgagggtgtgggagggcttcagtgggaggccctgatgctgagcagacacagtacagcctggtaaacaaggctcgtgtgctgggcactcatcgatcttggccattcgggcctggccaacagccggtgggctcaggcctgggcgggggctggggtgggagtgagctgcctcaggctgggccgtgggcactgcaggtggcttgtccggacagccctttccctggacccctcatgcccatggctctagctgaaaacacagctgctcttctctacaggctcgtcctggggtgaggagggtgtgggagctgcctagcccttcctttcccaaggggttgggtgcccctggctgaggaggagaccctcatggctggaacttggtggtggtcagagcctcctggaagttgaccagctgagctccagcaagtccatgcctcctgggacacagcctggccccgatgaaccctcagctgccatcatcctcaaagtcgcagcaggctggatgctgaaggcacagggggccgcatggactgtggctgcagctctctcattgtcatggggagggaatggcctgcagccccatcttgttcccttctcttaacagcctctttccaaagatggcccgagctcccatccccgcccccacagggctcttcctgcacttccccaggcatcctgggaggagaggtgggctgtggctggaatgtgccgccctctcaccctcctgccaggaccactgtgctggctgccttggtggcctggaggcctgcagagctgcccaagcgggggctccatgcgcagctcccactccatgttctgtccctggggaggcccacacagcactgcccctctgtctcattccaggtgcctggtccccagcgatccgccttgaccccagatgctcagacttgctagcccagggccagaggggcacaggacagggctttggagagggggcttcctaggctggtgctggcccagcctgcccagccctgccctgctcggcccctgcctgtctgggtgctggacctggcctgatccatgaagcttctcctagcgaggtgttttccaggcctttggaatcttagggatgatttcgtatggggaggggccttctccccagcctgctgtcttatttttgtgccgattccccgcagcccgagctcctgcccccagcacctgcctttccagcctgtgtcctgtcttccaccagcggactccagcctggctcccactgccacgtggctgcctggcgcatgctccaccccgtgtcctcccagggtcccagtgagggcccagccccgcagtgcgcagtctccgcagccatcgagtaggcggccagctgagcagaggtgctggccggctgccagcccagcacccgtcctgctgaagttgctcctggcacgcttccggccccaggcttccctgggtggtggggcagactttgtgttgctggtgtgcaggaagggcccacgacccccacccaacatgtgagaggggcatttggcagccatgggcaggacaccaccttcgaccatcagctaggggtatgtgcaaagggcctgagtgagaaacaaaagacaaaatggaccaaatgtgcttgtgtggccgggtgtgtgaattgtgtgcaggtgagtgtggaaagatgtgtgagcacaagcctgtcagcatacacgtgtgggcgtgggcatgtgggtgagcatgcaagtgtgtatacataagtgagtgagcacgtgtgtgtggacgtgcatgttatgtggatgtgcatgtgtgcatatgagtgtgtgagtgcatgtttgatgagcatgtatgtgtgggcacacgtgtgtgtgtcagcgtgtgctgactgccatggacgtgcacctggctgagtgtggaaatgtgtgtgtgagtgtactggcagtccaggttttacacccacacggctttgcctccccaggaatccgttttaatagcagagtgggctggaagggctggccaggccctgaggcagttttcaggccagcagtccctggctcctcatatgcggtgacagcccaggaggccggggccctcagagtgcagtctttggacatgcctggttgatggatccgtcattaccagcctgggagctgggcatgggctccggggctggaggacacccctttccatccctggccctggcgagcccggccctcctctcgccccgtgataacctgcagcctcatggggaaaggcacgcggaggtggtgccgcacccccagccctcacccctgctttgccaatcctggatcctggcctccgcccgccaaagtccaccattggccacaggatgtgggtgctgtgctgtgtccttgaaaatctgaagatgaggacagctcagtgggcgggggcgtttcacacattcgacacatgccctcacgcctgtgggtgtgtggcgggctggtttacagttacgtgaggatttcagacccaaagtgcagagcctgcagctgagcagtgcccagggagggctggggaggaaggtcccagccaggaaagtagggtgactctcatcagtggctgcggtgtccagctgggatgatcagggccgtgccagcctggtgcgcctgggggacccacagcagaggtcctgcatgcacttggctggcacgtgtagttctgaaggcccctggggaggcctggcacatgcagtgtttggggaccctctctgctgcctagacactgccacagaccccacacccaaccttgctgtttttcccccaagtgaggggagctgctttttccaactcggatagcccccctgcactgtgcagctcgcccacctccctcacagctattccagcatctctgggcgggtgcgggaagccggatgcagccagtaccgttgctgtttttggaaaagagaggttcaaggcagggagggcccagcctatgttccagcagggttgtctggctgggggggtctgcacctcgcccctgcacccccaggttcctggctccccacccccgtgcacgaagcccttcttgcctggcaggcctgggggcccccggccgccatgcgccccaccgcgggtgtgatttggcagcagcgttctcctcgccagcttgtttctcacataggggatgtttccatttttacagcagaaagaaaccgattccaagcgcctcagccacagccggagcgcgacggcccccagggagctgctgccacgtcaggtgctttgggggtgtgggctgctctgccagccgtggtcctaattgctgtcactcagggagccagctctagcctggggcaggcaggaaccatgaggggggtcttcggggcaggcactggtccctggcggaatccgaacctctgcctggttctcctggcaccccctccccagagacctggagcacctcccgactttgggtgggatgggcctgtggttctggaacaggagctttgcctgtgggaccctcccatgggggcggggtgtcctctcttagcccaggtgggtttgagccccacactgctccttccaccgctcagattcccgcctgcaggtccctgtcacggggctgctgaggaccgaccaaggtgactgcccatagccccacgccagcatggggcacagctgcctggcggctctgccgtcaccccccgtgctctgactctgtgctgtggatttgtgtcacctgcagacttgggtggcattgggcacaggggcacggtgtcctctgtcacttccccaccttgcttggggctggtctcccaggatgctgaagcattgaagtgcctcgaggactgttagaaagattttcttagaaagaaacatttgctacccagggcacagaacagctcctcgaggtctcgtaaaccagtgtggactcggccctgctcccgagacttggaggaaaggcagaaagggcggcaagtcacacgcaaggcaattttcaaagaaaagggcacaactcataggaggcaggggaaggattccatttcacctacagtcatggccccgcgtcttcagggaataggtgctgtctggtgcatcacattattagtgctggagggcatcgcagtcctgggggaggtcactgccagcatggcagcccataggaagtgggagggtgggattcaagggcaaggcgggtggtgggtcctggcccctgatgaggcaggtggatggtggacctgcctccaccctacccagcaggctggccaccagggcgtgtccacagactccagacaagaaggagagagtaaattgaggcatgtggggcccaggccctgggcgcaaggctggaggcctgaagtggcatcccatcagctggaatcaggattgcctcgatctttgattcttgagacaggaggagtgtggcggtggccccagcaggatccctgagatcttacacaggtgaggtggttgcagaagcactacacggggctggggcctgagggtgcagtgctgggtctaggtctccctgagagtccactgacagctgtggaaccaggcctcaggggagctgggtgcaaatcccacccctccacagagcagccgtgtgacccgaggctgttttgccctctctgcctcagtttctctctggcagccgctcctccctgggccccgacctgacccttcaggctcaggaggctgctccaggtccagaacctggtgctgcactgggtccagcctccaggcctttgctaatgttgtggtctctgcctgtgataactcctgcgagagctcctgatctcttatgaccctcccctgcctgggcagatgctcctcctgtcaccgagggtcccattagctggcagctaccctgccacttggtggacccaggtgatgtgggtgggcctcactcttcatccacaagtgggtgagaaaaggcaggaaaggaggtgaagccaaagatggcatgctccccctgcacagggtgactgtatgggggggtcacggcgggggagggaggggaggagagtggtccatctaagggccctgccagggcccaatgcaatgtcccatccttagatccatcttcagtcacatccccacgctagggggagcagcatttccaaaacgcctgccctgggggctctcagaattcaggggttccctttgaggtcacacaggccccactgaggccagacacagcaagtccttgctccttggcctaagcctgcaacccctgagcctcagtttcctgcagtaagtgggacatgatgcctttccactcctctaggcttctgcccatcctgtgtcaccgtcccagcagatgagtagctggtctggtggcctgagaccttgcttcactgggggacagggctgccatcctcgaaggccagggtctgggcctctgggccgggagctcctccatcagcttgcagccctgggggaggcttgcagccctggaggccactccctctagtgacagaacccatacctctgggaactgcttcctctgcctgcatgccccaaacttggacttggaggttgtagatggccgtggcagggcccttgcctggcccctatcctcctgcagcctggcctaggcatgggtgacttacccagtgccagcaggctgcctcagcccgtgcccactaaaaaatttgttcctggccgggcgcagtggctcacgcctgtgatcccagcactttgggaggctgaggcaggtggatcgtctgaggtcaggtgtttgagaccagcctaaccaacatggtgaaaccccgtctctactaaaaatacaaaaattagccgggcgtgatggcaggcgcctgtaatcccagctactcaggaagcttaggcaagagaatcacttgaacctgggaggcggaggttgcagtgagcggagattgcgccgctgcactccatcctggacaatagagcaagactccgtctcaaaaaaaaaaaaattgttcccatgatattccaaatacagtcatataccataatgacatttcagtcaaccatgggccgtgtatatagcggtggttccataagatgagaatactgtatttttactataccttttctatgtttagatacacaataccactgtgttacgatcccctacagtgtccaatagagtaacacgctgcacaggtgtgtagcctaggagcaaaaggccaaaccaaatagcccaggtgtgtagtgggctctgccatctatgcttgcttaagttactctatgatgtttgcacaatgacgaaatcaccaaacaatgcatttctcagaacatagccccatcatgtaatggcatgagaggacacgggcagaattcttggatgcccattttggggacagccaccatagtttggacattaatacatttgggcacatgcacatgagcacacacatgctcacatgcacatggatgcacacgtatgcgcgtaccactcactcccgggcacatgctcattcccgggcacatacacagtggggcggggcaggaaggctggatggggcccaggggagtcaggtgctgtggtgcgctggggctcaggcccttccagcattcaaacagagagtctcctaagaaagcagggagcccacagggcatgggatttggaatctgagtcagggatttgaatcccatcttgtgccctgggcatgctaagtctccctcctagtgcagtgggtgcctgctgcccaggctgcaggagcgtttgaggaggcttgtcagcctatagggaactgcctggcgtcctgctcagtgctgcaggctgcatgaggggccaattgaggaccccctaagcccaggaggggcagaggccagggaccagatgccacaagtatctgtgggtgggcttggctgtgatgagcaggacagggctcagccaatgcccaggggcagagcccccgaggcactgatgaccacagtgaggccagcgtcaggctctgggtcttgggtcttggtgctgctccaggagtggacccacatggcccctcagatgctgctctgtgactccaggcctgggtcaagccgacctctctgcttgtccccccacctccctctaggtaactaggccccaagatgtcacagcatcagaaatacagagaaaaaaaagcatagttaatactgctcctgctgggaaggcccacagcagggcggatggtagtgcacccagcaggtgtgacagcccagtctccccatctgcagggaaaccccatgccccctcaacccttactgcctgtcaccagctggaccccggtctctcctggctgctgtctcacctgccttcacatggtttctggttctttcatcttttcattataatttttgtttggagaaactttaaaagtaaaagaatgtgggccaaaaatatgttaacccattcccaccagacatgcaacactgggggggctgttcctcccaggctccttgggccccccagctgcccatgacccctgggtgtgcccagacagcagggggggtgtagtccacccccaccacgtccacagcccctgactctcgggtgggtctgggggctgctcgccctgggagagaagccatcccctcccggcggggccatctatcaggacctctctgacatcagcattttcctctgtggctctagcttcctgcctcctatctctgtcctcctgagaatgtcccatctgtcccatctttcccattagcagccctgtccttgagcccagtgcaagctccacagtggagaggccactcagcattgtaagtgaatgcttgtcctcgtgcctccctccccgggagctctgcctggagctccttcccggctccggtgaagctgcaggcagcatttcattgctttgacctgtcccagggcaccttccttctagaagggcgacttgaaaccttttcatcacagcacgacatatgcccggtcttgctttggtcatccagttttatgtgtcccattttatactcattttcttcccctcatgttttgtttttttcttttaactaaaacgatccatttattgagttaaaagattgtatattcaagacgttcactcagtatgtgatcctgcatagtaaacctcgggtgaaacaaagacaactatttttatatatttttaaaaatttagtggcatatagacttctaatattttggggggggggatattctttttttctttaattatggtaaaatatccataatataaaactgaccactcgaatcatttctaagtgagcagttcagtggcatttggcatacttacattgttgtgcagccatcacccccatccatccacagaactttttcatcttcccaaactgaaactctgtatccattaaataacaaatccccacccttccccgcccctggcaaccactgtctactttctgtctccatggatttgactacagtgtgtctaagtgggatcattcagcatttgtccttttgtgactggcctatttcacccctctgttttatacctttctgctgcgtggcgctttggctttctatgttctgcggcggtgggtggtaaagtggatgtcctgcttttaattctgagggctcgcttctcagttttcaaaaacacactttaatctctgattctccaattatcaagcatttgccatgaaatgatacttgctgctccccagcactgcagactgtgtaagagacatctcagccagcatttggattaagtcaaaccccaggaatccgcacctcctccacctcatcacccaataaaaaaggtaacgctgaggtattagaacattcacattagttccatgagcatgccctcttatgggcctgagagcacccaggctctggtgcaagccccccacagcccagggaagtgtttcaggactggagccctgctcagtgctgtgggctgcacaaggggtcaactgaggacccctaagcccaggagtggcagaggctggggaccatcccatgggctcccaggatggccttggggccacagggattatggccaggcttgtacttccaaagcccttccagggaggaaggcgctccacttcctgctttggcttaaaaaagtccagggaagcacctgattggcctggctcaggtcacatgacactccctctgtccaatcactgtggccaagagaatgcgctattgtgattggcccagcctgggtcagagccttcccctgctgcctggagcagggtctgtctccaggagagaggagtagggttcagccattccaatggcgctgccgcctgaagagctgtcagtcctactttgcagttgagctggctctgagaagaaagtgctctgcctagccctgtgattgatccacaacttcatggggactcaaacatgggttcttttattccaggtggagaaattgaggccccaagcaggggcagactcactggggtcacatggtgagttggtggcatgaatgggtgctccggtctacactgtaccacctcctccaggaagccttcctggcttggtcaagccaggcctggggtggtcaccacctgatgtcacatccccttgagacaaagccccccccctcccccgccaccaggcacctatccccagtgtccaggacatagctactggattcaggcagcttctgcagatgagctcccagccctatgtccaggaggtttctggaatcgacagctctccatgccacaataccctccatggctatttagggaacacccagtgtgtgccaggttcggctggcctgggagagtgcacagtggacactggtcaccaggagacacagggggccagtccacacccttccgcagtcgggcctggggaatgggttgggtactgacctggaggagggagggacagcaggaagggctggctgggcctcagctctcttgcttaccttccattctctcgatggccctggctagacacatgctggctcgcccaggccctactcatgtttcggcacaacgaccctgctctgcctccgtccccaagaccctgggctgtgcaaccagggccagacctgttcttcagccgcaccagggcctggctgtgcctctgcctgtcagtggccaagccctgagcctggagccatccagagccgcacggaacccacagcctgcagggtggggctagacatggctcctcctgcccgcccgtgggtcgtacaccagctcattagagccaaagcagcatcgattttgtgaatgatgagcatgtgtacgtgtttttggagccctggtgtgatttggcgtgtgcagctgatgattcaggggggtcatgtgcaaacgacacgccttataaatgtgaacccaccagaacgccccgttacggagatttacactgatccttaaacatcgtagattaatttttggaaaacatctataaaataagagatttatacctaaaacaataccctatgctgtgacaggaagggattagagtcaatttattcctgtattagtcaaaaactcaatttcatatattgtgtggaaaaattaaaaccctttctacattttattacaaattatgcatactccatatatggagataaataattgatagcattacaaatacttaatctagaaaatatttattaggaacagacaactcatttttcatgtgttttgttgagaacaatattgcacactttaaaaaattaatgatgactctttgcaaaaataaatgtctacatcctaattcttttgtttagcattgtgtccaagccaggcagacgcagccgggcagtgggcaggtggccatggagctgggatgtccactccctggcccctggctgtggatgggtcagagggctcatgtgctgtggcagttggccagggaaggtgcatttggagagtgtcaacatactgtttgtcttctgctgtgcaaactctcctcgacttgtaatttaaaactaaaagtgtttccgacttaatttctgagaaagcaccaagtaatgggatttgtggatggacttgaagagccaagaaatcaacactgactgcctctcgacctggagaattacggagcccatgaattctctgggcctcagctctggtcccaggctctgtgcacaaagagaggtgggcctggtgggtggtgcggagcttggccttgtacttcgtggctggctcagcctgccctcctgggacaagtggctctgccgggttctgtgtgcctcctggcatctctctgaggggagctcccagcctctgcctagaatacctgggcagcgtgttcagacctggggccccctgcaccatcaccccattccaggctgggaagcttgaggacccaggcagggaagcttgaggacccaggcagggccccagtgtgccacagggcttggccactgtgcaactgcactgcagctctggcctctggccgggccttgcttaccgacctctgccctctgccgtgtgtcctccaccttggccatgcacagcgggggctaggcgggcacatggtggaggctgccaatggtgccctggcaagttctcttcgccctcgtgccagccactccagggagcaccagggattgaataaataactgccacgtttattaaaaaataaatttggtgcctaacggaagtgctgtttctatacatagaaaaaaatgtttaaaataaaaaccaaaacagttctcaaaggcgctgtggcattaattattcatcgcttgctaatgaaaacatggctttgcaggcgtggcccccacctccctccaaataagactcgggctcagggaaagcctggccttaagggcagggagctggtgacccctgaataaaatgggggtggctgtgatatcctccatgggtatttagggagcacccagtgtgtgccaggctcggctggcctgggggagtgcacagtgggcactggtcaccaggcaggcacagggggcagtctgcacccctccttagtcagcctggggaatggcttggggtctgacctggaggagggagggagcagcaggaggggctggctgggcagcagagccacctcttggaggaaagaaatggggacagaggccactctggccagcaccagaggacagtggctacatgtctgggcacccaggccaggggcctggcaaacccccacagggtgggtgggtgaggccctgttctaagtcatttgatgacccagccaccctctcagatgctgctggatcccagacagagggagagagggaggctgcaggccttgccggaacctaggcgtgccatgcatgccccagcagccagaaccagccatgtggtggtgccacaccagaaagggccggcctgccaggcagtcaggggcagatgggagcaacttgggaaacagcagcaggagcctccactccctctgcctccacctctccagcagactatatggcacaccctgcccagctgtgtgcagcagggaaatttgtgccaggcctcgggcacctgagcccacactgggcatcgctgtcctgtcactgatcctgggcactgataggaactgtgaacaaagctcggtccagggccctgtggactgagctccccatcctcagggcccgggagcccctcctcctgcagtcacctggggcagccctatctctgtggggaggcctggagcatttgttcttttgttcattcattcgtttatttatccataaatgcccccgagctggctgcctggtctcctggggagaagggatgctgatcccatcagtcacctgcctgagcagggggtctgggaggctgagaggaagcctctctgagctgctgtgggtgcaggtggtatccagggcgacagctcctgggcaggagatgagctgtgccctgaggtggtcaagtggaaccccagcaggggcctttgaagctccgccagcccctggggcaggtcagggatggggaagaggctgcagggggcggcaggagagtgaggctccatctctgctgggtggctccgtcctggttagcaaggtctctcgcgtcctggcccctgtgctggctcctgggacgtggagtggaacccgcatccctgctgcccatgtgtgaggacccgggctgccagggctccagctgggccccaggctcagggtttgtgtgctggagacccagcaaagctggacagagcctggcgggacctggctctgcgatggcccagcttggtgtactcagaaggcctgatgggagctagcctggacaccttggcctgatttaagcctgggagccgcgtaaggggaggcagttgggcctgccgccgaaccgacgccccgctgcccccacttgcctctcccgccggtgggcctgaccttgctggaagcatccctcagcctggtatggatttcctgtcttcaccgaggccgcagggccagccgggcgcaggagccgagcggtggtcaggcccggggatggttttttgtttgtgggggcaggggctgaggggacccaaaccttccagagctggggggttttcttctcacctgtcactccgtggctccctttggtggctctttgtctggcatgggtgctgggcccaccctgcggtgtgggcagctgtccagcctagagcctgcctctgaccctggtcctatcctcagggccccttccagggctggagcaacagggacacaattgctgagctcagcctgtgtcaggtgcacaagtgacctcacttgggagacagtgcaactgcagtgggcctagagagggctcttcagctcccagtcacacagccaggcctggagaggtacacatcctggtccctgattcccccatcggcactgggtggactgaggagtggagtggggaccctgggtgggggagaggaaggaactgggcacagggggagagccagggaccagagggcatcatggagatgaaaggacaggcgagcccaggagggcacacaccatggcacggcaggcagacagacatagacataatgcccatatggcagcatgatctctcacacacacacatgctcacatgggcagcacactcacacacacgtgcatatggacggcacgctcacatacacacgcacacatgggcagcacgctcacacacacacgcacacataggcagcacacacacacgcacacatggacagcaggctctcacacacgcacacatgggcagcatgctcacacacacacatgcacacatgggcagcatgctctcagatacatgcacacatgaacatgggcagcacacacgtacacataagcagcatgctcacacatgcacacatgggcagcacgctcacacacttgcacacatgggcagcacacacacacgcgagcaacacgctcacacacacaacatgggcagcacacacatgtacacataagcagcacacacaatgcacacatgggcagcacacacatgcacacatgggcagcacacacatgcacacatggacagcacactcacacgtgtacacatgggcagcacgctcacacacatgcacacatgggcagcatgctcacacatgcacagatgggcagcacacacacacatgcacacatggacatcacacacggacatcacacacatgcacacgtggacagcatgctcatacatgcacagatgagcggcacgctcacacactatgagcaacaagctcacacacatgcacacatgagcaacagacacgcacacaggcacaacatgggcagcacacacacatgcatatgagcagcatgcgcacacatatgcacacatgagcagcacgctcacacatgtaaacaggcagcacacacacaagcacacaagagcaacacacacacatgcacaacatgggcagcacacacatgcacacaagcagcatgctcacacatatgaacacatgggcagcacgctgacacacacatgcacacgtgagcagcatgctcacacacgcacacgtgagcagcatgctcacacatatgcacacatgggcagcatgctcacacacacgcacataggagcagcacgttcatacacacatgcatacatgagcagcacactcacatgcacatgtgtgcacatggacagcacacagatacacatgcacatgtgggccacacatacacacacatgcacacatttatgcacatgggaagtatactcacacacatgcatgcacacatgggcagcacattcacatgtgtacatatgtgcatacctaggcagtatgctcacacacacacacactcatgtgggcagcacacacacgcacacctggacagcatatttacacatgcatgtgcagcacacatacacgaggcagcatgctcacagacacacgtgcacacacacaagcacactcagaacaagctgtggggcctgcggtgaggacaccaggcaggcaaggcggctgctgcagaaataattagtcactggtagacaggcctggctcaccttctccaaagccaaaggggggctaccagcccccagctctgggaaagggctctgagggcccgcccccaccttgcagtggttcctgggacctgcagggagcatcccaagcacggcccgtggggtgcgggactctgccatgtgatccctgaggctgggcctggccggacgtgccttggcccctgcaaaccgtgcacatccccaggtcccccagcacagcagcagtgcagggagtggagacgtgaagatggggagtggagacgtgaagatggggaagaaggaggttggaggtgcagggccgccctgtgttcttgttggagtgggggtaggagcactccaggtctggttgggccctgtgagggtgttggggaccccaggccaggcctgggtcggatccatcactccctggaggaggcatctgagtccagggatgccggacaggctggtcccaggtccccaggctgactgggcctcaggcatatgggcatctgcagctgtctggggccaggcccaggctgaggggcagccagcagggtgcaggaactcccaggccctcagcttgcagcgcagagaagggtgactgctctgctgttaaaacaatttattttgctcttcaaaaagctaacagctgtttacagtcagcatgtgggagctgccccctgggtgatggattctgccaatccagccctcccttgccttccggcgaggaggggtcatcccaggcttcgggtcaggatgggcagagcagaccactgggggccaggccatgatgttcctggccactccacgtcccctcggctgccgtcctgtgtgctgccctgggagagtgcaaggaagggtggccccctgaggctgatacgaaatggtacggtgatgtgagggggtcaggagggaggaccactgtgggaggcgtgaggtgcagtggaaaggtcagggagaccttctgagaaggccagcagggagggctgcccagggcctggagagcgtgcatagctgggggcagggtgggggcagccggcaagggcaaagcccagtgggtgtggcgatgccctgggggatgggccccgatgcccctaaactggttcggctctctagaccagactagtgtgctatgtcggagccgagcaacagtccccctcaactgtatgcatgtacagtaggcgctcaacagacacttgctggatttgacaatagccctggacggaggactgaggcctgggctgcacacattctgggctcctgcaagcccctggcagccctgagctggtttctgagtgcagagggaggggctgtcaagggtggaacccacacatgccaaagcctggaggccagtgcaggggcagggcacctgctgcctcgggacagcgctgaggttcaaagccacctgctggttcccacctgcctggcacaggaccctgtgtcggtgggggtggccagatagggcagctccttgtctccctggaacctgtaccctcagaggtccaggatccctgggggaggttccggggctggagagacggcccctgtggcagggcagggacagacgggctgattctatctaggatgggggcacacaaagacttcctgaggggcgcttcaaggccacagcaatctaggtgggacagggacatcagtcagaggtgccctgtggagacccccaggtccagctcctggtactgtgagaagccagttgttccctcgcaggccgccaaggcaccgcacagtcctggcctgagtcgttgtggggtcttggggaggagggttctctggaaggacactgagcctggactttggggcaagagacccagagcccctggatgcttgcggcctcaaggcccaacatgcagccaagcaaaagctgggggcacaggcaggggatcccctctggggaggatgcagaagccgagccaggctgggccgaagctccttacctgatctggtgtcctcctgtgcgatggtacaagagcctcagggcacatctggtctctgtgacaccccccgagacacccggggaatgttcccaatgaccactgttgggccactgcccgaccacgtcacggttgcccctgccaggactcaggcaaaacccagctgtccctggcgctgtctcccaacagccctgcagggcccagtgctggaccagggccttgtctccagcctctcccccatgggactctggggcctttgggggcccttgggggccttcctgcaccctcacacctactcatctctggactcagcctcagtgtgaatgctcacctcgggctgagccaacccctccagacacgttctgcagctcgaggaaggaactgccctttgcagctgggatctgcccgagtttcagcagcagccttgaattgtaatcccgagcggctggcgaataacacagcacacagcactcgagagcccaggtgagtcctaagtggggctgggctatgggatctctggcttctgggcctttctcagaacagaccctccaggccactctcccctacatccccggttgctgcactgggtgcaggggtccagagccaggtcagctgctgcccagggagagggccaagactgcagaccccgccaagcctgggggcagccttcctgacaacagcaccatttgctgcttgggatcagccaggccggctccccgcagatgggagggctgtgaggtgagcaccagcgagcccctggaggtgccagaaaatgccagtgtgggcaccagggggcttccttgggctggcatgtcaggggaagcccactggggcggctcagtgcccatgatggaagctcaagtcccacggtgctgccccaggagctataccccagtgagggtcgttggctggcgatgtgtctggctggcatgggctgcctggtaacgaggggggcccatgtgtgaggagccttaggtaaggatccagctggcacaccgaagaccccaggccaggggacacaggctgggggagggggctacagagacatgaacccaaaagagaatgtctgctgacatcccaaccctgacagataaccagctgggtgacaggtgggggctgtgctcagatcaccctcctctgtcctgtgcacatgtgtgggtgcatgggagtccatgcgttgctcctggcttgccccctcctctcctcggcccagcttgtggtgctgcgctgtgcatggagctcggtttcttagcaagttcatgccatgagccgccagctaggctgaggaggagtgggtctgggtgccactggggcggtctgggcttccctcagctccagggctcttgcccttgctagcattgctgtgattctcaccattgcgccctgttacagaagagacaactgaggcatggggaggtgatgggacccccagggccacccgcaggaggtggccagcccagcagccctgcccagtcccccgccggccttgtgctcccatctgggcccctatctgtagtttccccagttaacaaaatcacaacagtcattcctggttgttcttgctgaattctctccatttgaggagcagcattttggggtctgtgtcctaaatggacccaatcacaggagtcacccagggcactggctcagcccaagacaacaccttcccccatgtggacacacacacatgggggaaagaaaaccttgccaacccgccctctagcaaaggggcctggactcgcatttttaacaagaaccaagagatcccgtggaggaggtagtccacagggggaaaaacacccttgagtctcaagtcccccgtggctccccagctctgccagtggctgcatggcgggtgagatgatggtggctcttgggtccctctgagtcttgctgcccaggctggcaccggcacattttgtcttggctccatgctgtcgggccctgagctgggcactgggctccctgagtctcgtgggagctgtctgggtcctgaagcaagtggtggcccgagcaggggaggcggtccccaccctcggggacactgtctgctccggctgtgggctccgggggctgagagctatttcggctgcactggcctctccactcctgccaggcttcagtgagctaagattgtgccaaagtcaacagaacagaaaagagaggctatggcgctctgtcagggagaaagcccaattaggaggggcttgtgggggcagggcgggagtgcagagggagccccggaacctagccagcccactgtgatgacagggccttcgacagcagcccagcacttggactgtgcagaactgcggagatggtgctgtgagcctggggagggtgcctttctccccaggggcccgcatggggccaagtctaccagacttctgagccggcatgtctgggtacaggacctggccctgcagaactagcctgggcatcagagcccaccagaggtgactgccagcggccaggacccaccacggagtctcagggagcagcacacgggtggggagcgggtggagggcacacaacgctggtggggcatgggcctgggcacctctccagctggacactgcacatgacaccccaggccaggccagggtcccctgactcacagaccccaggcacagggacatgctgttttccttttagtccaagtgtacggggtgaggagctgcagcccccaccctgagggcctgctctgtttagagggggtgccagggtcctgggtccctccctctgttagagctgtctggaaatcctgagtcgggtaggtgaggtaggaaagggagacctccccacccactgccctgcctgagcggctcccacggtctaaaccctgtcttgggggtggttcccaggaggaggcagcagagcctggtgaaaagagaccagacagtgtggacctccctggccctgggatcaacagcctctcctgggcccagcttccccaggcctgagcttggggttggaggatcggcaggagagtgagtccatgaaggcaccatccccacccctcagcaccctttccctccatgtcatctcggccacccatctcagagcccagctcagcacccgggccctactgggccaccccgtcaggccctgagtccccatggagggtttggaggctggaggccggtcagctggggaggggaagggcagaggagcaggggtgagccacttggctcagggctgaggacctctcgcactctggccactgcagagggtgtccggctggggcaggagggctgtgggagagagatcacatcgtgtgtgggaggggacagtcccctcctgcccagtcccctcctgcccagtcccctccccacaaggccttagggaagggtgggggtgccacacaccatgggctggtgcccccatcctggctttgcctacctaaggctctgggattggcaggcatggagttccccagccctgagcgtggcaggggcaggatgacagacccacggtcccctaagccctccctcctccacttacaccctcgcccgccagaccccagtcattctcctgccctcagggcctggattcagccccacccccagcctccttgtaagcccggccttattagtgctgcttcaccccgactttgcaagtcaaattccgcattactgcgctcctgctctgtttccaccttgatgcatggagagctggagagcagctggagcagagaaggcactgcaatgaggcggcaacccgtgctggccaggggccccagggcccagagccaggtggggtggaccccgaggccctgtctttccacaggtgtccagggtcactcccaccccacccttggcctcctgctggctcagccccacacccccaccaaagggccaggctccgggtgagtgatcctcagggcccccgcacaggctgttccctctgcacacaggctatccctgccttcctgtccagccagtgggtggggagaagcgagtccctcctttcagggattctcaggaaccgagtggctatcagggtatgcagctgtgatgcacgtggcaggagaagacctcagacgccacagcctagctctctgtggggcaagtgtgtctcagcctctctctgaggagaggagagcccctggactggagggtgccctgctcagctctgcctgggtattctgtggcttgcagggtggaaggtgaagggctgcaggcgctggccttcccaggccccccactgtctgcccagcttttccttctttggcagccccagttccttccttatacccagtgggacagcagggcccagccctaggggccgcaggagacagacatgccccaactgagacagacaatggccagcatggcaggtggcccagtctcggccaccaggacgtcctaggaggtacggcccctcagctaagctggctgtccttagtggcccagctctggctctggctggtcctgtgaactcaagatggcagacactgttcctggtctcaggccaggtcttgggtgaagaacgttgggtgtaggaccctgtacctctcctcctggaacacccccagtggatggcgaggtcactgaggctccatccaacgggcagcctccagggcagccctcgctcctcccttgccctggaggtgggcacgggtcagtggaaggatgggactgaggggctgggcccttcaccgaccctggaaggtggctccctgtggccttccctgcagtttcctggtccagtgtggttcagcctaagacacaggtgaaggcctggttatcacttggctgcttttgccaaaagagtggcttccagtgaaatcctttggctgccgaaaggcaaagtcaccctccctccctgtggccccaacacctgcagggtttgtcagcagaaggttttcacggtccactgggcattcgcgggcctttggcatcctcgagggcctgcctttgattagcacacaccctttgcttgacccagagggtccagatggcactggctccacggcatggccttgagaattgaggccggcttcggcgaggatggtcccacctactctggccttcaggccttcaccaggagagattcaggctgctggcccagccagtctctgcagggacaccccggtgggcccagggagggactggggtcagctggggccctggacttacagtggatcccacttcccccacgtcttgcttggttctgggcataagggtcctagttcttagggcctggcctggccctctcactgctcccgggaaacctcgggaaacatggcaggctgtgttccccatcctcaggctcccaagtcgcttctgtccagtcctctgctggtatctgtgactcagcaccatgacggggccctgtccagggcgtcctgggcagaaggctgctccgagtgcacagcgggcacccccatggacaggctgcgtccatgtgccactccttggccgccctctcttcatctgtagtgatgacacagtgacccccacctgcaggcctggtggcactgctgtcaccaggcacagggagcctgcccccaacctgggtggtgttgtgggagtggctgggcaaggaacgctgctatccctgctgagctgggtgggcactgatgggcatggggacctggagtgctgacccctagccctactgtcggcaggccacgcctgcccctctggggaactgctgtgtcccccttggctggcctagaagtgcctagaaatgtcttttatgtggggagtcggtgggtgagggccccactgtcccatcccttgaggaagggagggctctgggcagggtctgcaccaattccccagtgcctgctgaggcctgtggctgcctcagggacagtgtcagtcaccccttcaccctggcataggtgtcctatttccagagtgtagtgctggatgcttctgtttggctgtgttaattgagaccagcttttacagaatgagcctcttggggtgggaaaatctgcacagccttggtgtttagggtaacctgaaagtggagagtgagcctggggtgcagtctcactcccccatgcccctgggcacagctacccacaggcccacagcaggcaggcaggactgatgccatcctccagatcccccgaccaggcccagaggtggggccaggagagatctggggagttggtgccaccagatttcccaaccatgacaggatgtcggggggtggggggcaacagcaggactgccccaggctgggtccccacccaagtgaggcttggtcgtggcctcatggccagtttgtccctctgcggatctggaggggtcctcggctgcagcagggggcccagatgatcctgacctggggatgggaaggcctctgtccgtggttccccagcagagcggggcctgttgagaggagcaggggatggtctgttgaaggagtcggtgaacggagaggcatgcagggatggatatggacagggcgggtgctcagaccctacagtctgaggtggaggggtggggttggaggctggaatggccgcgggggagcctagaggggtagggctgtggctccaccactgttggctaagggacctcagggagggcttcagaggctggggccctggctcccaaggcctcaagaccctcctgctccccctgaaggtagcagtgaccgcctctcagaaacccctggcatccctggaggctgcagtcccccgccccgcctccactctttctctctgctctgtcatttttcaaaaataattgtgcagcagcaccaggctgtctctgtgcccctcctgtaggttgccctaccccaccaggtccctggctcggcgtccccagactctgccaggctggcctcaccgtgtgtatcgaggtgttctccctgcaaggtcttcatcattccccaattgctcgcatttatttttctccttccttggtgagtggccctgccagcctcagccttgtctctccttggtgagcgtcattaatgcagcttccgcgccacgatcagagggggctgcccccaccctgccggccctgccgcttctcctctgcccgcctcgggatggatgttcatttattgcccataaatctctgcacagccctttgtaaagacaaattggaggcctcctgttccccggtgttggttgggccgatcggtggtgggtttaattggcccttcccgtggaggctgcccctgcaggagaggctcgttgtgggctgggccagatgcactgcgtctgcagaaggggccattctctgcccctcattttgtctagcgtctgaggctgggccatgtgcagggacaaagtgtggatcctccctcgggcttccaaaacatggcctccccgcattcacgtggcctggcagcagcccaggcccaggcagggccctctctcacccagggggtgatgcctgcagcttcaacagcaacctccaggaaggaggcgcatgggttcgttgaggtgatacaggagtggaagagcttggtcccttgaaatgaatgatagggaaaaggggaagtgctgcgtagaggagggtgtgatccctggctggggctccatcccacagacctaggtgaggacaggcatttttgcatttcccaagaccaccctggcctgccacacccccatcctatgactataaaaactcgcgagaccctggcaggcacgcacaagctgctggacgtggagaggagcggattggcagaggagcactcaggcggctggacgtcgagaggaacgcactgacgggcgccggcaccccggcaggctaccaaccggcagcagaatgacctggagtttggctggggcagccagaggagagcccgggcccgactccaggggaaaaccgtcccactccatcttcttctgccttcccccatctgctacctccactcaataaaaccttgcactcattctccgagcccacgtgtggtccaattcttacaccaaggcaagaaccttgggatgcagaaagccatctgtccttgcgataaggcagggctctaactggggtttaattgagctgagtaacagaagccaccgatagagttaaactaaaacagcaaaactaaaagagcaccctgtaacacgctcactggggcttcagctataaacattcacccctagacactgccgtggggttggagctccacagcctgcccgtctgtatgttcccctagagatttgagcagcagggcactgaagcaagccacaaccccattgcatgtactgtgaggggaacaaggggacttttcctgtttcaccagcacacagcaggtgcctaataaacgcacagcgaactggtcagagagagagggaccctccaccgagcccagccactgcacaggctgggagggcaggactcctgccgagcttggcaccctttcctgcacccaggtggctgtgagcctggccctgccccggtcagcaggcctgtgctgaccccacatgcaatctgctgttggtgccaaggaagtgctacctgtgcagctctcagaatgtcaggctgggtgctcctccactgaggtcagggtcaagagaccctaggccagctctggggggcccacagggcgtgaggggggtccaggcagccagcccggcccagcctggttccactgcttactgtgtggccttggggggctcccttggctttctggggcctggggaaccaggcgcgagcttggtcctgtggtctgaatccaagaagacaggttgtgggtggggacatttggagggagggacagcctcggcctcagctttgggaccgtgtggcagaagcaccctgtctggccctctatgagctcctccagggctgggcccaagcagggacctcttcttccatgagggtttactcattcctcaaaacaggcacaaaagcagagggctgttgaggggtagtgacctgcccctggctctggccatgcgggtctgggcactgtggatccactccatggccacctggctgggtgaggaccagcctggaggatcaggaagagcttcttggagaagggagtggtgtcagaactgaatactgagcaaagaggaaggaccaagaagaagatcctaaggagttctggggctgggggctggggattgggagcaaaaggagagatgaggctggacaggtgcctgttcctccacccactggctcaggactccaggcatggcccagcaagggtcccctgcccctgggagcaggactcccctgcagcagacagaggcaggtggggagtgcgacgcacctggaaggggcttccggagaggtgtgccctggcagagccccacctcccccaggaaaagacagtagcaccaggccccagccctggagaagcctgaccaaccagagaagtcccacggcctcctccatggagtttggggctcctcctctagacctgggattggcactttggggtcaggccagctgctggggagccctgggccccgacacatgcaccctcccaacaggagtggggctccgggggccactgggctcatgcccatcgcagccactctccaaggccttggcataatgggatccttgagctgctgtgcccggcggggtggggggggatgggctgagatacaccctttgctgacagtggccattgcacttttcccacccaggcctcatgtggggagccctgccaagcccaggctgtggtgtacacaggggctgggctgcagggcagggctccggagcggcctagcccagagcagggtgggaaaggagccagctggggtccaggcagaacagaggccaaggccaccagtgagaaatctgggcatgagggtggccaccaggccggcaacgtgggggaaattgagttgagggctgggcctcctcactgtggctggaggcggcccaaaggccagctgaccagacacagagctgcctcagtcacagaggtgccacagctcagggtgccaccccgagtgacatccctaggctgactgacacagtggagggaattgacacccagggtcttgtgatgtccccgggcactgggatggagaagcagagcagcactctggagcacaaacacagttggcagcgaagggtctgctcccgcgtggcctcgggcccaatcctgcctgacatgttgcttcatgtctctgggcctccgtttcctcatctgtgccctggggacattagcagtgtcttcctgcggggatgtgagtgtgaggtgccctaccaccccagggaggctgtgagctgcaggcagcccggcagtgaggagcccccacccctgccgccgccgcagtggcccgccccgggccccagctcacaccacaaacacttgcctccctctcaacttgtttccggcatgttctcagtctcgctggatgttagtttaccatcggctgctgaacattcggcagcttctattatttcagaactaatttaaggattaaaaagtaattctcccaattactaggcaaagccctgggcagccagataaacagggggcaggcgctcccatccaaggacagggctgctcctgcagccctgggcagacaggtgtgcagggcagctctggtgcagctcagcccccagggccgcaggggtggagtcggggtggttgagaggaatccccaggagcagcccagcctgggcccgacatctgagggttgcttgcccctatcccccacccaggtcggctacagccacctagtggtgagcccagccccagctgtcacctccaccaattgtgctgggtggtgctgccctggctaggcctgcaacacagggacaggcccatgagctgtgaaggattcggtccacagggccccctggggctggccaggcatctttggacggggccaggagagtctgtggtagaccagcagcccgcatggggtgggggccaggatttgataccctcaaggctgattcacgcagctttaattagctttctgcacctgctctggggtctgggtgatcaaggctggacaccagctgccacccccaacccctgcctggtccagcacctgacctcaggggcccagccggccggggctggtcaggcagagctggggagtgccggggtcggcgcaggaaggagctgagtccctgggccctggcccaacgccccgcccactccgggcccctcgtcagcagcggccggccggtgagctcatctcttcctgggctgtaaatatcacccaagtgctcacgactcccaaatgtgtcctccagccgggcccctctgctgagctcagcctgcacagcccacgcgacacccccgcccagatgtctcctgggcctcgacaaagcggccgctcctctcggcgcccccacctcagggacgggcgccccgtgccggctgctcaggcctgggagccctgcctgccgcctccaccccatgggagcgtccatgcatcctgctgagtccaacttaaaactcgtccacttccttccggatcctctcaccccgtcctcaggtctggttggactgtgcccaactccccacccctgccactgcacaggcccccactgtggcctggaggggagggtgcagagccctgagggcagctggtggtgacagtcagccccgaagctggcctgagggcgacaggtgcctgcttcttagttaggagtgggcccagcagaggtaatgaactccttgtcctgggaggtgtgcaagctgaggcaggatctgctgtccttccacaagccattgagggcgccagcatccactgcagttgggtcactcaggtggggctcaaggctctttggaaatgggtggcttcggtttcctggctctgactgcaaggagcccccagcctcagctgagagcactagcccagatccagcagtttagctgcctcttctcaggcatgacaggggccacttgggagaaaaactgaataaaaccctgcctatgccagtgcccaggcacagcctggcagaatcctgggcctggctgtggggtcacagagactgggggtgccaggggtgctgatggtagagctccaggcacaggacagagactgcacaacattttgacatcaggccatccatggagaggcctctgctggggctgccaagggtctcctgggcccagaggggctgcagagggagccctgggcaaacagcaccccaccccggcagggctgccctgcctgagctgcccccagccttggggcaaggctgccggccctggatctcaggtgagcagaggggcaaactgcaggtggaggtgtgcgcagccacacggggggcctcagcacctgtgggcacaggcacagggtctctcaggagagacaggacatgtgggaggaccctgaggagggtacaggccagacaggaccactgcatcctggctctgccctgtgcttgatgggaggggtctgagccttgggccgcagcacacgcacagagaagcgggcggaggagctggggccttggctgctaagcgcgtcctccccgcttcttctccctccttctcctccccccaggcttctggagccccggccgcccccacgaccatctggcttcaccagcaacgctcccccacaccctcccccacgtcactgtttttctccctctccccctccccagccactgccctggcggggagggggccctttcctgggaaggcttcctggccacgtggcccttcccttttgtttctgagtcctcttcggcccaggccgtgggaaagcgtgcctgtgcatatttctgcctgtgcatatttttgcctggatgcgtgtgctgctctcgagcccccggtgcctgcatgtgtgtggacatgtgttccctgccctgctgtgtgtgcatgcgtgtatgcatacatgggtgcagggacatgcagacccaccacggcctatgtttggggtgtgggcatgctgtaagtgggggtgccccagacacgcatgtggggtctagtgtgaccaccagcagcggtgtgagggtgcatacagcccccactgggccttgaggccaggcctgacccgcccaactctccttcagggccttcctctcctgccacccaccaggggtaggaacagggtccctcatcctcagcctcctcctgggggctgcccgggcagcctgattggggtggggggcccgagagcaactgtccccacaggggctgctatgtccagacccatggacctggcatgtgctccatcagccaggctcaacgacgtcagccaccaagcatgctccatctgtgcggctggggggccaggggcacctgacattggagctgcccttggccaaggctgtcccacctgtggtgccaggcaactcccttcctctgggggccttgtgatgggggagaggctgcccgtccagcacccacccctgcttctcaccgcccacagcaccctagcctgagaggccacagcttaagaaaagagctctttattccacgtcgtccgatatttttacacaagtaaaataaaatgcatatctctatataccgcgatctgggtgggaggcggcgttctggaacaaacgctgccgccgaaccctgtaaacatgatggggtggagatgggggtggcgggcggcaggcgtccatcagggaggacctggcctggcctgccccacgggtcggccgcccggctggcttggcggcgtggagagagaccccgtatgtacacacacctggctgctgagcacgctcttgtgtccgctgggggtcagcagggcccaagcactgtccacagcaccagcgccaggcccaggggggtgaggctgcaggtgaggctgggtagggcacctgagccttctgagtcaccagtcccgccacccccgctgcctgcctggcccagacggcagtggctgcgggtgcggttcttgcgtgaacagcctggcctccggcgagggcccgaggtggggaaccctggtggctcggagccctcgggccgcactgcagtgagcgggggctcagcagagccaggcagagtcccaaagggtgagtcattgatgtgccgtgggccagagccgttgcccggcgggctgtcaccgggcggcacgcgtcccttcagcgcattgcctgccgaagctggtcttccaggctccagtactgaggccttgtcagcggcatctggctggcagcacttgggaagccccagcggctcctcatcggtggccctgccggtccagatgggatggtaagggccggtggccacagcgcagccctgcaggtcattggcagctaggcgtttgaggtcacggccagccaggcgttgcgggaggctgcagggcacctcggaggaggagccgcggaacttctgcagccaggcccagagtgggcgtgcccggcagtcacacacccaggggttgtcgttgagcctcaggtactgcagggcacgcaggggggccagggcctcagtgggcagcgctgatagattgttggcaaacagatagagtgtcatgaggcggccaaggtcacggaaggcatgcgggtgcacatgggccacgcggttctggtgcagtaggagacggtcgaggctgtgcagcccacggaaggcgcgctcgggcacgctggagatgcggttgccgtgcaggaagaggtgtgtgaggttgcccaggtcgcggaaggtgtcatcaggcagtgcctgcagcgcgttgtcctgcaggtagaggtactgcagggcagccaggccgcggaacagccccgggcccagctcctgcaggccgcagcggtccaggtgcagcgtgtgtaggcggcccaggccgtggaatgtggcagggtccacagaccggagctgtgcattatcgctgaggtccagctgctccaggagggccaggccagtgaaggcagccgcatcaattcgggccagcacattcgagtgcagccacaggatggtgaggttgcggcaggcacggaagctggcagctggcacatgcgagatgcggttgccgtgcaggaagatgcgctggctggcagcagggatgcccacgggcacagcctgcaggccctgctgggggcagcttgtcgtcaccttgggctcattgtagcatacgcaggcacctgggcatggggctgccacctgccaggcctgcagccacagcacccatgccagcagccggctccctgtgggcagaagacagagtggttagcaggaagggcaggggtactggagaagctggaggttttgctagagccaggtgggccccggagattgggtctcaggaggacctggggctgggtccaagatgtggccaccacccccgggaatcgcagtgttgggatccctgcttcacaggcctcatggacgatgctgggctagaacatgccttggagccatgcactccaccctggaagccacatctgcagactccccataccacacccaggagcagcccactgggtcaccaggggcactcacttgaaggcctcctggaatggacactggtgactgcaggtacctcctcaggactccagtgaacacagagcccgcattgcaggagtccccggggggtcccagtgggggttccacccacagggcctaggaaacactgcaatggggctggggtccctctgggcacgtctatctcaaaaacgggcgcctggatgcccgagggcgggggtggagggcaagtgtgtccagggcttaggaggagtcgcgtcccacaaccacccaggcagcctgctccctcctccacacatcctcctttcaagcacttcctgacttggcaggaaccctcctgaagcctccgccccctggcctcattctctgctccatctcctccctgggaggagttcactcctccccagccaacccctgcagtgccagctgcctgcacccctcccacccagacgccatcagcagggatagcctcccagtgggttctcccccagccccaggtgcctgcaacccctcctccattacagggccagatacacctggggcttcaccaaggccctacatgggcagtagtccctcccggggtgccgcatccagagctggtctcaccagcggggtcacccactccggagtaagctttcctgcctctcattccaccattgagcccccacccctttggaatgctgaagattctttctgccttcagcagtgagtctattaaaatgtgaatccccctgggaaggttatggcttatcagctaacacttgagttatcagctaacacctgcgttgacagctaacaccttccacggcagctggctaagagcaggattctgcagacatgaggccggctaagtgctggggttggagccgggcaggaggaaggagtggaccacaggccagcttccccaacctagaactgtgaccctggggccctcctacccacatggggcccctgccccactgggtcctctctacttgggcagacagtgcagtcgccctaaacgcagagcccagcaagcccagcacgcgcagtgaccgctgggcatgtgcgtcctcccagactcaggttcataggtcctcagaccccctccccacagcctgggggcctcctctgccaaaccccctgccccagggccatttgttggctaccagggagatggcagcccagggatgggggtccggaggcccctccctgggtgggctgggtgaggaaagcacctggcctcgtgttctgtttaaactgcggacaccctctctgctctctttctacacactcttcctaggaaggtggggcctgaccatgtcagctccccactgctgtctcacctgctgtcaccagagggaaaactgtgctatgtaaatggcacttcctgtcctggggccaggtggggtggaggccccacatgctcatggggcagggtcaggactcactgccacattatcgaccacaccacaccactgactgtgggggtcaccaactgagccttgtcaccaaccataccatgcggctgactgcacccaccaagactagccacccatggtggccacgcccgccacattaccactgagccatgccaccatcccaccactgtcctgtggctccaggcccgaagctgtgggctgtgagtctggctgtggtcagggctcagctcactcgccttgaaccgagccctgtgctcatggatctccctcccgaagcagctgtgtgtccactctaaacatgcccccagtgaggtgccagaactgagccacacggtggtgcggggtcgggggagacaggggaggacatgggggagtggccacgtggcgctcagttctgccaggaagtgggtattgggcgcaaagacacggctcggttcctgccgagacaactgcttttcgtaaaccaacttctgagagtcgggtgaggtgggctctctcctcgctgcagccatggtaattggctccagcctggccccccttggggcctgcccgctggtctccatggcaacccctctgctgagcgagcaggagggggcatctttttatgagataatcaaacccaactttgcagcatgggtttgtcttcacagccggggccctgggatgagggagacgcagccaggtggggggagggtgtcctctgaccccatcccaggggccagactggtgactcaccagcctcctccctggccccatggtggactgcagcccctccccaccccaaaagacctccctggcccgtggcccctgacctgtcccctgggctctgcagcctcaaggccacaaggcctctctggccctctcgcccacctttctctctcctctatctgcctggccaactctaataggatgctctactgtccttctggagatagcatggcctccctgcctgccatcaccccactttccactctcacccagtctcaccctggccccagttctcacggagcctccagtatgagctctgtccttcctgccccttgcacacggggtgagcaaccagccctgccatggccccagctctcacagagaaaccatggatagcgtgcctgtccaccgtccccacccaggttggccctgcggccacctgagcctgcgagggccccagagggctctcctcagcctccaagctgcacacaaactggtacatctgtgcctctcccaccctcccaggccaattaacatctcttctttcctccagggtctcctcctgggacctccccggaggatggccctgctggctgtcagggctgggtcatagctaggagctcctgtctcagcccaggcctggctcaggagccacagtcaggggagggctggctctcctgcctggaaggctctgagctttcccagcggggacagtgaccggatactgacccagagcctctccctgcggcagccagactgggcagggtaggacccaggatcaccaggctgaaggcccaggaggctgggcagcaaacagtccaggacgcatccccctgacgggagcaacaggcagcccaggtgggcacctgcaccatcagttctggtgagtggagggctgttcacgttcactgcaggagggagtgtggcggggggaggaggaggtgggaggagagcgaggagggcaggagcagaggggaggggtggagaagggggatggggaggtggcggtgggaggctctggggatatgcccagccattgggcaggcaggcggctgctgaggtcagcagctcaccccagcagcccagggagctgagccgagccgagcagggatggccttcttcatgtggtccctggcccccactgttcctggggccccgcccacctccgtgccctcccaagcttgggctgaagttccacagggatgcctttgcctctgcccagcgatgccaggaggcagcacagggcaggcagctgtggaggcgccgagcaccggctttcatccacgcacagcttggtgccctcgggccccaatgccgcccctgggctgggatcaccggagggtcccatcacctgctataaaaagtgagacagcaatacatttacagattaggaaactgaggcagtgagtggttaagccctgccctgctcccactccagactacccaggtggagaggcggccaagggagacactcacagtgctgcccggaggggccacgaggcatgtcctgcccaagcaggaaggctggcggcctggctagtaatgggggagggtgtggaggggctgggctgcaggccacgtgcagaggggcaggcagcgccctcctgtgtcatgggtggccgggaggggaatctccagggaggctctgagctgctgcttcccagggctggggtaagaggctgcagagggctggggctgggggtgggaccagctgtagcacagccgggacatcagtcagctcaggatcctctcggacaccagccatgtccccgtcaggcggtcacgtcacagaccacagttatgaggcagaacaggaggccacagctcagtgcaccaaggccagaaatagctccaggcgggggtggcgggcctatgtcatccccacaccacagagggtcagggcacccctcccacgcctgctccccactcctggccctccaccactgactcactccccccgccccccacccatctgtcccccgatcctcgcttgcttctcacatgtacacccacccgccatccatcctcaggcccacagacacgtgcaggggcagccagaattcccatggtgtttcctgtgcccttccagggctccaggtgctgcggcaggagattggcagcagcttctggtgggggcagtctgcccttgaggggtcctgagtctcctagggaagtgagtaccagcccctgatgccctggccctggcccctgctccttgttgatcttggctgcaggggcagggtaggcagaccaggtcaataacaggcaaggacacctgccatggtgagaggtcactggacccagactgaagcagctccaggcctagctagctacatgctgtgggggaaactgaggcccagtgtgggcagagccttcaggactggcctcctgagtgtgcctagtgcttcctcagccccctcggctccactctttgccctggccggcagggctcgtccctgccccgtgatgctgggctcaccagagacaacgagatgtaggtaggtccagggccagcaggccaggccagaggctgggcccttcaatccagcaaattctcttggagggggtgtcaagtttattgacccattttacaaatgaggaacataagaactggtgtgggtataatcaatagcaaacacaatccaaggtcaaatccaaccatatgctacttacaagaaacatgcctaaaagtacacaaaatcttgcaattaaagatattatcagaaaaataataacaagtaaagcaggagaagccacagccccagggctagcgggcttcccagtctcatggccccaggggtgcgaaaaggtcttgctgggcagtaaaggctcagccacccccgctcctaacctgagctccacagtcctgtttccagccagcagggcacctgagagggtacacctttcaagtcacagacactgaagctagcagaggatggcctggcccaggtgagagctggcagccctggatggcaccctcaccccaaggacacatcaacgtgggccacaccgtgcaggatcatccactcgcttggccctccctccgtaccttggcaaggtgtgaagtggcccctgtcccaggtgctgtgctgagtgccgcccatacaagaccaggccgaggagccgggtcccaggcactcacggtccagggccagctgaccacgggcagccaccctgctgcatggcaggtgccctatgggagagttaggagccacagaggcctgagccagccccaggcagcatgaggatgttggcaggagcccaggagcccactaccagccaaagggtcttggcagagccccaagtgggcaggatccttggcctagcacctaggcctcgaggattcatctttggtcaatgctgggctgcctgcgtggagggctccagaaccttgccccatccagcccatacacccctcactggaggtgcaccctcctcggctcccaccccagtgagccccacactgggggcccctggaggctctgcccagtggaggcctcgcccagcccagggcacagccagtgcccccttgccccacaggaggcttgagcccacctgctcctccatgctccaccaggagccaacaaacacctgctgcctaattatctggagaatcctgtctccaccaagggctcatcttggtcctgcagctaattcaatccagcagccagagcaagctgagtccccagaggacactaatgagcaagtgaccggtggccggcctgctcccaccctggggacgcactctgagccaggtctgggcccagcactgccatacacctgcctcccatgcccatctgcctgcctgaccctgcccgctacctggtgcctagccctgcagggcccacatccactcccatgggctagcatccagacctaagccccagccctcccacactcccccaggaccctggatctgctgcatgcacaaggctgaccactgcctgtgagcccagagtgtcggccttgacagggcaggaggaagtacaagagcacatgctcagggtgcacgagccaggagcacagactcagtgcatgcaatgggacccctgggggtgcacacgataggcgtgcataccggaaacacacaataagagcccccagggctggtcagggctcaggcagagtccactgagcagtagagggttgctgggatgcgagcccctcccaggagccagggcccggctggagggtctgcatgccgctgcggcagaggaagatgtgtaggcacatccccatgtgttctcttgccctcagcatttgtaaaacatgatcaaccaggcaggcgagcggcctctgtccgagcagaatttattctgctgtgaaaagacacgtgtgggtcctgaggctcttgccggcttgttctcagcagccttggatcagcctcagtcagcagaacagcagctggacaggctcccattggagccatcccagggactgcccagcccttcacattagaaactgagctgggggcagcagctggcccacggcacataagcagtgcctgctaagaccacagagaagctcagccaggcagggccagtgggatccagcactccccaggggatgaggaatctaagaggcaggagaggatcctcctcagcctgggatgttcccattggaattcccccagccaaggccagagctccgtgtccgggggccagagtggaacccttgtcagagccgacaggccttggcctcctattctactggcacctggcaaactggcccaagggctggctgctgcttctgtaaaggatgtgctattggcagccagccacacctatgtgttcacgcattgtccatggctgctttcccgcaacaacagcagagctgagttgttatgacacactgtgtggcccacaaagctggaattatttagtatcacaccattcacacaaacagtttgccgacctggtttgtgagcaagccgagtgtgggtgctgccaccttcaccctcacaatggccccagcagttcactcagacccccactaatgaaaaggaaaccaagggtcagagaagaccacggtcctgctgaagtcacatagccaggtgaacagagcccagcaacctcagtgcaggctcagctctgtggagacctgggcaaggtcagcatctcacggaggcctagggtgaggggttctaggcaagaaagagactcagaaatactgaaatactctgcaggtcaaaacagaaatgatcatttttctaaagaggctgtcaggagtctcacagtcaaatatgcataaaataggacaacctaacacaaataagttgggaggggtggctcacacctcagcctcctgagtagctgggattacacacacacacatgcatgcacacacacacacacacatacacacaaagagaacaaaatggttgtaaggagagggggacagcagaggaagtgctgaatgacacagtccggcttcggaggaaaggacttgggtggcacttcagaggagacaaatccagtgcaggtagttttgaagagggcagccgtttaactgaggtagggggtctctggggacagggcccctccatgccagtccacccaccttggaaccctgcagaggctgggccgaggcctctccctgcaccttgtatcagggactctggccaggtcacaccaaggtggcttatgacccattaacatcaagctgcctccctgggctggacagggcctggaaagaggtgacctgggcagatccgtgtcgatgtacttcccaggacatcaggattccagcctctgctaaagggatcttcacagttaataacaaagaaatattaaagatgagaacacttggtgcaggaaacaagagaggaaagggagtgcggtccctccttgcaaacaggatgccctggaccaccctccacggcctcaggcctggatgctcctgcagacccatagccaagattgtgaaggaaaagtaggctgtggaggcattttctgtccttgttatcatcattgtaaacatactcatcatcaccatcaccatcctcatcaccatcaccaccactatcaccaccataatcatcagcagcagcatcatcaccatcatcaccaccactatcatcattaccatcctcattaccatcactatcaccaccatcatcttcatcaccatcctcatcaccatcaccatcctcaacaccatcctcaacaccatcatcaccatcactatcatcatcaccatcaccatcctcaacaccatcatcaccatcactatcaccaccactatcatcctcatcaccatcctcatcaccatcaccagcctcaacaccatcatcaccaacactatcaccatcattatcatcatcaccatcctcatcaccctcaccatcctcatcaccatcatcactatcactatcaccaccatcatcatcaccactatccttatcaccatcatcatccccaggcgaccagagcagcaccatccttatcctcatcactatcaccatcaccatcaccatcatcaccatcctcatcctcatcaccatcatcccatcactatcatcaccatcctcatcacaatcactatcatcaccatcaccatcctcatcatcaccatcgtcctcatcaccatcaccgccatcagcatcctcatcactatcatcatcaccatcctcatccctgtcaccatcatcgtcttcatcatcatcaccgtcatcatcactatcatcacaccagctctgtgcaaggcccttagataaagggcagcctggggctgacctcacacaaggataggaagccccaggtgagcaatgggtcagtactgggtcgacaccagatatccctgggcagaggccctggcccaaggatggggaagggaagaggacaagggatggggagtaagaaatgagggcccctcgcctccctgggacagcccaaggtgcagcctttcctcattcctggaggtttcaggatatccctgtgctgcatcctcccattgtacggtgagggggtgactgccaacccactcctcagatgaggcactgactgaggcaagtgccttgctggccaccttgcaaggccaggagacagtgcacacaatctggactccaagatctctgcccacccccatcttcatcaccactatccttatcaccatcatcatccccaggcgaccagagcagaccctgagccccagggatgacacagcagggaggggcagccactctgggctccccagtcccccatggcacctcaacctcagcccaggaggctgccctcccagggatggctgaaagtgggccctggggtcttgcagccctgggctcagatgtagcctctgcaccccctcacagagtaggcagagaatctgccagccccctccaaatctgtccccacaccagtgatgtgaggacaatgagaggccagcacctacctccccccaggaccccaaagaaaccccacccaggcccccacccagcatcctgcctccccagaggcctgccaatgtgacctgggtcagcctcgtctcaggtgaggagtccagggaggcaaggtacagctcacagcgtcccagagccacacggacccctctgctccagcggtcttgcaaggccactctggcctggcctggcagtagccctgctttattgaggagatatggcaggcaggatcctggctgcatctgggctggaagagggggcagcagccaggctgtgctacaaacccacctggagccacttcctcgctgcttctgcccatctcagcctcagcagagaaagaaggcttgaggacaggcctggtgcagcctgactcatctcatgagagacccggcctgtgctcagagtcgagttgctgtggcttctcatgcaacactgatggtccccctcccctgctcacccaccatgtgttagacacggggatctgcatgaaagacacgtgttcctccccttccagagacccaccgaaatgagggtgatgcagagtgaggagtggggagcacagtggcaggctgctcccctggagaaacacccagagaaaggggttccaccactggtatccaggagcacccagggccgatgggcagaagaaaagctccatctcagcagagcagccaaccagcttccctcataaaagtgaccagaaaaccagtgaccaccaggcatccggaaaacatatcaatgcagaaaaagagggagaatgatgctagaggaagccgacagtgtgggaaaaagacaaaaattaggagaaacatctaatttgtgtcttcctaggcatagatggggatttaaaacaagaacaggctgctatgaacaaggaggcatcagacaaaaagaaagagtgcctggaaattaaaaatagaatcactaaaattaaaaaaaaaatcaatacaagtgttagaaaacaaggtcaaagaaatcttccagaaagaaaaacaaaggagaaagacaaatgaatgagatttgggagacaaatataggttgaacatccaaggggagttccagaagagaaaacaaaaaaactgagaaaagctagcaaagaaacaataccagaaaacttcccaaagctgagtacccagtcctccactgggcattcacagtgcactttcaggcccccaggggtcaagggaagtctgaagctccaggaggagaagctggtcacaaagaggcaacacgaagccatgagcagcagtgcacgccggtaatcccagcactttgggagactgaggtgggaggactgcttgaggccaggagtttgagaccagcctgggtaacacagtaagaccctgtctctacaaaaaattaaaaagttagccgggtgtggtgatgcatgcctgtaatcccagctacttgggaggttgaggtggaaggattgcttgagcccagaagtttgaggctgcagtgagccatgatcatgccactgcactccagcctgggtgacagagtgagactttctccaaaaaaacacacaacaaagaagatgcactatggtattggcctccttcatagcacactagatgccaggaaacaacaacactgcaacagcttcatagctctgaggggaaactaatttcaacatggaattctagaccgaaacaatccagcttgaacatacttgtaaatacaggaagacttccggaatgattcttcaccatatcttctttagagagtgagtcaggcttatgtttcagccaaaatgaggtgcaaacccagaaagaggaaaacgtggggcccaggaagcattaactgaaatttcaacaggtggtaaagggaagttatggggcagcaggacaagtgcttggggtgaatctttatccagggaaaaaaatgagaccccaatagaagccctgatgtggggaagagtaagcccatgagggtggtggatgggtaaaaaacatcaactgtaagccccaaggaaaacaaaaggccatgaaagagaaggaaggtcacccatcccacggcaggattgagaagaacatttatgggacctgggttgggaaacactggctgtgaatttaactgatggcagcgagacagccatgctggggagtgtgctggaggagacagagctggagtagaagctgaggaaatgtggcggcaaccactggcaaagccagggaacagaggcgacagtggctgcctcccaggaggacgcggggcaggggcagattgagcccattctccagaccagcctccgaggctgggtgcaggtgttaactctgcaatatgttgttgaccgaatgttattattttttaaaacaactgcatatgtggcactaaaatctcagaaaacagataaataaaaagaaaaaaaagaaagtgtatcttccagaaggtggagacaaatgtaggttagaagcaggtgtctccaaggtgcaggaggagagcgagggacagtgagagctcaagagcacctggacatacagccccagggcagctggcatctggccagggaggatccacatgctgctttttggtcccctgctcggccaagggtggctgaggatacatctgggtctcccaggacactatgggctcttggccccagagactctgcaatccagacacccgaaggggcagcttctggcctaaaagcccaactctgtgcttgggccttccctgcaggccaggcagctgcttccctgaaccagcctcagagttcctgcctgcccacccagcccagccctcacactgtgatgaagccccacccctggattccccttacccctgcccgctcctgtcccctccttgtcacagatctgagccccccactccaggctggggcccctcaggagccgggggtaggggtgtgcggtcaacacccagcaggggtcgcctagcactggggtgggtgtgcagcccccagcctcctttctgaccgtgcacacgggcttctctcagctgctatgagagcccccaatgcgtctccacaaccaaaccgaggcacgcacgcagcggcgacgtgaataagtaattgctcttttattaacaagtgataaattattcctatatgattgtgtgtgataactcttccttatttgaaatcaatttgggatggaaactgttgtcggcttctcatccacgagggtgggaggcccaggtgccgctgcctcttggaaaacgaggtcagtgtatttcagctacttcctgaggctgatgcgccgccccactgcgcagggccagtggaagggggtcagctgccctccgggaggcggggcagtccggccttatttcctcagcatctctgtctgggacccacgccactgagcccagggcacagaggggtccctcaagtccaaggccacactgggcgtcaccacagggtcatcaggggtcagggggccatgcacaggccatactgcattcatccccccatgtaagccccaaagactgggcagcctgacctttcatcccacagaggacactccagcacccagctggtctcctggcctgcccgggccaccccacggtggcttctcaaacctgcaaaggcataagccattctcctaaaattgtcctgatgattttacaacagccctggccccatccccttttcttcctcccccagcctcacagaggagggttcagggactcagcctgttcagggcagcccctgggccaggcctcagcacctcttctgttaatgcatatttaaaaccttgcaacccaccgggcagccagccagccggtgcctccctcccaggccaggcctgcaggaagccatgccccgtcccgctcactcctccactggctgcttctccgaccccgatcatggctgcagcaggcctggaggcccggtcacccccaggcccagtcacatggccctactcaggcaccacctgtgcttcttggctgggtttctcatctgagaaatgggaaggctgggtctgggtgaggcacttctgtgggcccactcccacggtctccttgacacccctccaccttctgcccactgccagggtgcccattccactccacacctcgctggcccacttagcaggcttctgtgtagcttgtttctgtcggttgaggcaccctgggctttgggctccacaggggctggtgacccgcatacaggaggtgctccataaatgttagtcatgtgaatgcactaaatgctcaccactaagggcaagtggcaggctttgtgcagctatagagacagcattccccaggatgtccagccctgggagagagccttggcccacagcccatgaggcaacggatgttcctgggttgggggcatggctccagcaccccagtgccaagggcacggtctctaagtagcaacatggatagctttacttctgttacagctccatgtctgcgtctcccccagattcacgtgtcgaagccctaacccccagtgtgatggtatttggaggcggggcctttgggaggtgattacggttagataaggtcacaaggctggggccctcaccatggcattagtggcctggaagagaaagagacctcagagagtacatgccctcctctctctccacccttccatcccctaccacgtgagggcacggtaaggaggtggctacctgcaagccaggaagggaacttccaccagaaccagcccatgctggcaccctgatctcagacttccagcctccagaactgtcaggaaatgtgcttccgttgtttaggacaccttgtctatcgtattttgtcatggcagcttgatcagactaatacaacttctttcttaaaactttggtgtatttttccagattttctacaatgaacatgacctcataaaatcaagagtgtttttcgtttgttctgtttggtcttatgctgacactgggccaggtggaagggtgggtgagtccgtcttgcaggtggcaggagccccctccatgagcccccacaccccagggtccctgcccaacgtgatcggccctgcagggcagtcctggaaccagttcagggcttggggccctggctctgcctagggaggtctcaggcaggccccccaacgtctcagaactgcttccctcagttggaaatggagataataaggcccacctcatggcacccacaaagaatggggcagcctgcacctggcctctccctggaggaccttctcacatcacccccggagggaccaccatccccaccccacagaggagaaagcccagctccaaggccaagttgcagccaggaagtgctctgctggcatcctacctggccctgacgccaggcctgaagccagcaccacccggggctctgttgctccaaggccattgcccctgctggcgtttgctcaaggagctccccctccagaatgccctgccctattcccagacacacttcctctggggggctcttctcccccagccccacccctgccacccctaaggaggctggccccttcccaatcccttcctcgtctgcaccactgccttgcccaaggtgtccatcctcagacccaatggggccaccatgggagcccggctgggtaatggcccataagctcctgcccatggagtactcaggcagggaggggcacaagcttggctgagcatgagtgacaggctgggtgggtctcaacctcaccctgggcctggggtagccccttgcaagtgaggatgttgaacacggtggacccccaggcagaaagtgagccacggggggctatgcaggactgcagccctcccctcccctcaattcactggtgagtagcctgctactcccctggctcccagggcagggccctcatcacctcgagacccagaagcagtgatggagaccgtcctgcaacatcaagctccctgtgatctgggggccaggggatcctgagtaccctgcctcctggagtgctctgcctgcagggggcagtagcagcaccttcaggtggggtggttggggtggcttcccggaggaagtgataactcagctaggagtggggcgtgggggtggtcctgacatgtaccaaggctgggggtcaagtgtgcactgtctctcagccaggagggtggaggcgctggaccaaggctgggggtcaagtgtgcaccgtctctcagccaggagggtagaggcactggaccactggggcctcaggtgtccaggtcacttgtccctggagtccctggctatgacagaggccctggtgggcagctcggggttggggacaggccaaggcataggggagggcacaaagggaggttggtgccccacccatcacccatcatccgcctcaggccaccccaggggaccggcctccgctccggcagcgggtgaagaatggactccattagggccgccatctgtctcagccatgacgggtcctcgcggtgacatccgggaggtatgtagatggaatatctttatggggagagtttttcttttgccagttttcaaataggaagccagacacttgtcacacctgtccctgtgtcagcctctgcctgacataaattggggccgaggcagggagatgaaagacagcctggaggcagccgggtgcgcagggcccatgtgtcaggccgagggagcaccagagctgcaggcagcctcctgctggggccaaggagagctcgccccgcagtccacctccgcagcctctgcccctccctccactcccctctggacccacaagttcttcacctgccctcccccaacccagagccctccaagcatctcacccgggcagtggcctgtcctgcagccactgggcttctgttaggggacactggagcctcctcagcccccaggccagcagctccagctcctcttccagacctggggccagtgtggctttcatgagcggtcaatgtgggaggctcagagtcctcaacctcacccccgctgccactcctagggaccttgtgggcttcagcatgtttccctggaatctgggggacttgggggtagagcatgtcaagaacctcaaggtccctgccgcccagcatgggactatcttagaactgatgccaggaagaatttgctaagagaatgaagggagaagcaagtgacccctgtgggcctcccctgcatcggggactggaccagggcccactgggagtgcatcttggtgcctgaaactgcaccaaggatgaggaggggaggaccctccccaggggacacttggggttcacctggcaggccacactcaagtccacagtcccccatggccccagcgggtggggcaggggacgcacccagctgagggaactgtggcagtcctgctgttgtctcacgtggccctagggggctcatctgtagcccccacgggagccccaagaagccaatccctgctgggctcatgggctaccacctcatacagccccatccctcgggaggccctgaggagaccctggggctgggcagggcgtgaccggccagctccatgcttcctgacaagggggcctggatgtccagggagagccaggagggaagcggagactcaagtggagagtgtgtgggagggaacgttgctgggctccacaaaggagggggcaccagggctgactcccaggttcctggtggcatgcgtggaggcaggtggggccaggagcaccagcgcagcacatcctgcgtgaccttgggccagctcctcagccctccctcgacagccgtgctggtagctggccaggcccgggtgagtgagttccccaggtaggtggaaggggcttctggggtaggggccacgcccgggggcaggtggcccaccctcccaatacccagtcccaccccgccctaccacaactgaggactctgcccaaggaccagtcagggacgaggcatcctctccaactgcactgcaaggccagcacaagtgaagggcgggacagaagcctccacacaacaaaggcagaggaccccatacttctctctgagtcagtgcagaggtcctgcggcagagctcctgctggaacccaaactgcgccgtaggctcctcactgagaactagggacttctccacatgcacccagcctcccctccggactccacagctgctagccctgcccggaccctgtgcaccccactcccaccccgtcatagcctctcagccccactgtcatttgggctcccctggcatgaactaacgtgtctctcaggatgtcctacgaggaccctcacggcagaaggaccgatggggaggagtggccccagagagcagttccttctctgtacccaccagggttcagcagaggctcctgctccaggcagtacagtggggcccacatgcccatcctcactggccacatgggctggtcagagtccagcctggatccccccagggcaggacaggacaggtaagaagggctgaaaacctgggaggcctccaggaggtgagggacctgccaccccttcccacaaggccctaaggccccaatcactagtctcgatttccacagctagtttagtccaggccaggaaagggcgtgcaaggggcctggcctggaagaaggggtccctggagccaggtgcaccaggagcctccagcttgcccaaatcaagctgccactatggccgggtcctgtgggcagtgctcactcaccaccgctccagcttcacgatagccacgtgcggacagggaggctcagagggtaggtggctccccgggggaaacagagcaacccttgtgcagccggctgggccaactgatctgcacctaacagccagtcttgaaggccaccaaccctggggtctcccggagctgacccagggacagaagggcaccaggcactgcccacaaaggtgcaactgatcctcctcaccggcgcctgggccctccctccctgccagtgtggctgtcccacccttcatggctttctgcatcctcaagctaggcctgggctcttcaagtggagaggggtaggcagacacaggtgccaggcactgggaactagggacgggggcttccctggtgaggatggaaaagaaggttcctacatgagaccctctagcccaggccctgagaacgaaggggccaaagcttcacctaggggcagccatgggggagtttaggcaggcagtgcctggctggaaacatgtcttagggaagcacttgaatcccggggtggggaacaagatggtaggcagggagccggggccggctgtggccacaggccggggacagaggccaggtctgaggatggccctcagtgaggagtaaaggggatggaccgggagacagggtgcaggtttgacactgattttgcctttggggatgggtcgagggaagaggctgagactctgggcttggacgttgggtacggaggatgtgacactagcagacaggctggatctggaggcccaaggtgtgtagtgtggggagctgtgtgtgcaggagagatgcagggcactagggagcctgaacccctgctccagtgcacaggccgggcacacggcagggaggaggcagtcaccattccctcacttgccgggacctgggaggcagggcagagtgggtgatgggccaggctggggccttggaatgacatctggcatgtggcagcggaggggggacatgtaactggggactgtggactcccagctggaatccacctccaccttccacatccacgcactgcattttggtctttactgagcacctgctgtgtgcaggggctgctctagcccctgggaccaccaagggccagccctccacaaccccagacctgcactcagcccccacccacttcctccagagccccacaccccacacactgaggactctaggcattttcccactcttgaagacactgagctgggaacaccacctctggctaccagccgtggactgcagagaggcctacggtgaccaggaagggtggagctgcccaaggtcacacagcaagccagcactgcacaagcttacccatggctgcccagccttggggaatgggggacttctggcatgtccccgagctgggccctggcagaaggcaaataaaggcaacatctcaacaaggttgtgatagccggggatccaggcaagcaagggacaatccaggaaggctcccaggaggaggtgaggggcctggagcccaccctggcctgagcccctccttggcactccagcctgcctagccctgcccccttccttgacgggcccctcacccagcctcagccttggcctgacatttcccgtgacatttgctgcaaagaaatagagtcataaatccaaaggttaaatttgcacatcgcctcaaattgctgggagaagcagtggtccctccacccactgggcgccccgtgggtgcggggtttgtgtggcagggtctacccatcccagggcccttgctggaggcccacaggtctcctcctctggtcctccggggcacttcaaccactgtttcccaaaacaggttcctgggcacaccaggccctgaggtacatcgcataggggtgcctctcagagaaggtgctgcccacccctctccaaaacagggcccaagacgccctgcgggaaaggagcaccatcagcaccatttattccagcaggtcccacatttgaccacaaagcccttatgtgatacccccaacattccaaagaatttcaactccatggaccgtgacccgtgacagccagctaagaatgccagggtgctgactggagagccaagaggcacccgggggcccagggcaggctgctctgagtgaggctgggtcagcacccgacacctcactcccagatcagcccagctccatgtgccagggccctgaatggggctttccacctgccaggcctgtgtagacctacatggggaccctggcctgtgcccactcagcccctcctaaggccactctcgaggtgtgccaactgccctgcctttcttctccacctcctggtctggctgctgtgggttgcctccatcggacaggacacagctgcggaacagtgtcagcatcaccccatgccccgctgccctgctgccccgcagaagaggccccgcaggccatagcaggcaagaccagaggctgtatgaaagaggcaggggagaggtggccccaaggcacccactgcacaaatggctgcccagactctactcactcaccatcacctacccggccagcccacggttgtcaaagcctcagtgggctaggaggggcaggatctggccctgctgccgagtcccctgaaatcagcccaagcatcgggggagaggcacgtgaccagaccccagacctggtgggtgccagctgaggacatggtggggtgggtgtgcagagctgcatctcccagtgtccagctccacggctgcaggcagtgcaggaggccggtgcaggtttggataaataaatgatggtgcattctcaggaagggattccacacacaccagaaaacccatgatgcacaagaatagttcccgatgtgcaaaatgtttaaaatacagcgataaaagaagaaacggcagcacagaacacctggtgtgggggagcccagctgggccccagggacagtgcagggagatttgtggggtggggcagcatgcccgccgctccgatcgggcttccctgggccactctgtgacctcctatcctttaaagcatttaatcctagagatgcccgatgccaaggatcacaccccttgatttgcctggctcagaagagaatctgacaggctaggaacgaacgagtgaatgaatgaacaaatgagaaagtgaatggatggttggggcaaatgcagcatctgggatctggctttgaggagggtgcctgtgaccttggcctgggtgcagccagaccgcagagcagggacactgaggggtgcagagagggacccgagagggcatctgcacagctgcagaggcagcaggcggccaagccagctcccgcagaccctgaggcccaggccctgggtggctgcagagggtcaggcagaccagcctgggggtcagaggtcaggctcaccagaatgggggcgggacggcatgaacctcattgatcagatagtagccaagtgtcaggagccctcactaaccctgtgccagggccgggcggggcgcctggctcacacacgcatttgttcatttccaggtcatcctgaaactccccgtgtgcttcctgctcttgacccctttcccaggtgcacagaccaaggctcccggtgagaggttccgggccacaggcccaggacagcaggagggctcctctgcctcccgcccgtcctgtcctcaccagctggaccctcctggtgttgcaccggctgcacagggccgtccgtgccacaaagcatgaattcaaggctggggcagggacgaggagagggcaatgctacaaggctgcactgttcctgggcagagggagggggagagcacggtcccacacaccctggccctcacagcctgcctgtcactcacagcaacagcaaacaaaccctggcccctccacaggctgtgggccagttcccagcctcccaggacagcaggaccttcccccaccttccagggccccagcccctgtaggggtgtcctccatggaccctccacaagccctctggctttcagagacgtgctgggccaggccctccctcagcctctcccctgcttctcactccatgcaaacctacgtttctgccagtcccagcagaaggaccctggcacggggaaactgaggctcaggggttccacagacccccaggtgaggaacagggggagggcagggagggagtgaaggtactatgggagggtctcccaagctgggcagcatccctgccctgtcccctctccactcacctgtggcccgagttgcctgactaggggcttttattgtcccttctgcacatggatggggtgaggggccagctggcagtgcaaaggtcccaggaggactctgctgagtgggggtgtggggaggtgttgtgggcattctgaggcagaagcaccagagtcagaactccacagggaaagccgggccaattccgcccagcctcagcctggaagtgccccgataatccctgaccactggcccatggtgcaggtgaggaagactgaggcagagaggcgacctgtcacacccaaggtcacaccgccagcaggtggctgagccaggacccaaatccaggtcacggttctgccacggcaggccctgcacgtgcccctctgccaggtggcgtctaggtgctgatggccacccattcccacccccggcatgggagctcacttcctcctcacctcagtagagaagaacagggaacagtaccccctttatagatgggaagactgaggcttagaaaaagagactggccagccccactgcttcagctgcccctctgctagtatgtttcaccctcacacaacctacaaggataacctgctggtccccactctatagatgagcctctggtggtggccaggggagcaggaggtgtggcctgccaatccaagccccagcccagggcccttgccacagtgctagtgggccacccttgcccatcatgcagcatggcatccatctgctcagcaccctacacaacaccggaggtaggggagcccaccacagaacccctcaccaagaaggtcctcaccatggagaaactgaggcactggaggcggggcctctgcagtcacgctgggtcacgtgctccagtcagccaagctgcagcggccaccaagggtgcccagggtctggcctgttggtcacagtgttgacctcatggcctgaaatgggtcttccctgcccagacaggttccagcccaccatcatctatctgcctcagccctggtgggtagggagtggctgggagaccctgcccctcacaccctgggctttgcggtattcaacgagcccccaacacacattccagggcctctgctccagattaggccacagcctgtctaggcacacaaggggcacccacaccctggaggcaaagagacatgcctatgtgcccgcaggcacacatgatcacgcgcacagacacacgtgcagatgcataccaagttacacacacgcacacaagcccgaggcggggacccccaggacacggaggcaggcaggcagaggtggggcccaggatgtcttgcccctgtctgtgggcctggcctccccactcaacagacgagcatgtgggtgcgggagtggttattgcgaaaggggccccagcatgtgccacccgtggagaccacagcaggcatgccgcgtgcatgcatgtgtggccgtgggtgtgcaggcgggggcgaggacacagatatgcaccctcagagtccgtgtgtgcacccagtgtttgtgcatgtgcacactggggcggcgttggcttgcatgtgcaccagaggtgtgcaagtgtgcagtccgtgtagacaagtgcacgtgcaaggaaacgtgtgtgcagcctgcggcaccatggacatcagcagggcagcctgggtgggcacctggggagcaccctccaggcggggcatgcccaactcacatggagcccaccctcccttgcccgcaccgcgggacctcacagccggtggggcgggggagtcccacgagggctgctagggaggggttgctgattgccccaccgcccctgattcccccagccaagcctctcaatgtccctcgggctgcagatggtgggcgttgctgcctcctctcaccgcccgccctggaggcagcgctgggacaaccctgtcccccacgccctctactgccgccaacgcccccattcatcccactgtggactgacctcggagaaacgggaggttctgagcccagaccgtgaggctggggtggaggcggcccgacacccccacccaccctcggtacccacgtttctgcaaaaacccgctcgttaaccccttggtggccggggcgctccgaggccgggccccgcccttccagcccacggcccccgccctcgacttggcccagcatcggggaccctcggaccgccaccctcggccctgccgaagccgtcaactttcccgggaagcggcaacttttcctgccgcctccggctccgccctcccggggccggggcgccagcggccccagcctggcgcggcactgcggtggctttccctgccgcccggctacgcttccctcgcctcggcagcccgggacgggccctgcggctccggggagggggcgagccgcccccctccgcgccccgccgccggccgggctcgggtgcagcgcggacactcacctccagcggacgccctcttcatcgtaggggttgggcggggcgcgtcggggactgaaagtcgtttcggggcgggcgcccgtctccccgcggccgggtccgcatccaggcgccgccgctacggcccggccccggcccggccgcgggacgaggctcggcgcgctccgctccgcccggctctggctgggctcgggccgcgggtgcgcagggcgcgcagggcgcacagggcgagggcggcggcggcgcgggggttggggcgtgggcggcgcggcgggccggggcgcgcaggccgggccgcaggaggcgctcagcccgcccggtgcaccggcgccgcgcggtcccagacaaaggcggcgcattcctgaagaggcggcggcccctgcaggcggcggaggggatggcggcccgggccggagccggccggggacgcgggcccgagggtgtggcggcctaggctggcccggtccccaagcgggcaagggctttgtcccgaggcctaggaatggcctctgcctgacccactcccttcctggcctcacgaaacccatgaatcccccgccccctgcacagaagccccttgctgcagcacgatcgcccccatttttcagtaagaaacaggctcagggcttaagagagttctgggggccctcctgggcctttgtggccctctctgcaccatcctagagaagggacctaggcctgatgttacccgtaaccctgcaggggtcccccacctcttcccttctgcggaatgggggctccaaacccagaagacgctctccgaggtcacctgcttagtatccccccactctaccaagccagccccccacgggcggtgtgaggcatggggccagagaatccagtgacgcccctgcacacaccacacaggggtgcaggtgtcccttctcaatcttctgctcggggcacctaccgggcctcaccgatgagctcctaagtgcatcccggggtcttcagacaactgccaggctgcccctgcacctggagaagtgctgggagtcagctcagccgggctgggtcctccccaggcccaccctgcatgagaggaccatgcagatgagggtcttgcaggcccacctggtgtcagtctgtaggaccctgactcaaggacggagtgggccagcctgatgccttgatggcccccctcagagcccaggtccactgatatgaagcagagagacctggtgactgggcacccctgtgccctctgcctgcccctggccatggaggtggccctgagggagatgagcagggcgcagggccggtgacctgcctgccttgtgcagaggaagtgaggacctcccagagccctggtgctcccatctgatcccagtggcaggcagcttcgcagggtggagccatgctgggtgggccctctgcctggtgtggaggctgcactgcccacatgcctctggctgccgctctgtggccctcatcactttggcctgctttatccctatcacccttgtcccagcctaggcttatgagggcattgtggagtgcatgccattcccagccacacagaaggtgaggtggggcccagacacccccagccactctgtcccctggcctcctgaaggggtgggctgtgcacacactgccacctccccagagggtgctggctgccgagtgccaccagctcagcccctgaggtggctcaacaggtcctcccagagccacaccaagacgtcatcacccattgcacagatagggaacctcaggcgaagctcacagagccagtgggaggctgaggcctgacccccagacaagcattcttctccagggtccctgcacacagcagcccccaggctaggaactgagctctctccacagggatgtatcagaccctagatgagtcacgtggcactgaccatcagtctgaggacagcgctggggtggaccaggctccagtctcgggctgctctgtgcttgcagaaaggccttgagaggacacttgcttgcttactccgcaggcgtctcttcaattaccagtgacccagagcagcccactatagctgaagattgtgaccccacaccctatctcataggtttaaagcccctcccacccctcctgccgcagccgaagtgaccattctggggcatgggatgggcatggggtgaaatggggagcaggggtggccctggaggcttctggcaccagcaccctctccagccaccaacctggctgttcccggttgctctgcgctgggacctgggcctccacctccccacaggtctctgcatgggagcagggctgaggcctgcagagggagcgctgggggatgggctggtttcctgtgtccgccacctcggtcagcacgttggccagcaccctccccactggaagctgggcccactcctgggtgctagctgggatggttaggcgtcggccagcgctgatagggagttatgggggtgcagaggcagagttgagcagggctaggcagccggtgggtctgctaccagcaaggcacagcccacttctcaggctgcgcatgtgggagggtttggtaagccacatttttcagggtgtagccgggtgaggggtagcatggggagtggtgtactctttgggcaggcgaccacggagccatcaccccccagggcccaacgggcaagaaggggagcagctgacggctggtgaggggctagcagggagggcttgacaagggctggagcccctggtcaaggggcacaaccagttctatcgggtcaccttgtgggaggagccagggaccctgtgggcagagcctggccgtctgctgcccggagtctacaccagtcagttcctaggaagccccatcaggggtgctgggaggacaggccatctgtgcccagctgatgcaagctcccaggctttctggacacgtggccctggggatcaggagtgagctggagactgcagacagctgtgccctcagggccacacagacctgtcacaccctgcctggactgggtcagcagggccacacgggcatctgcccgaatcgttccccacctcacacccaccatgtggggcacattctttgccagcttccccagcccaccacccctctacagtgaggccaggggctgtctcacctcccacccacacccacacccaaaatgtggggctcagcctccacgaccagcatgccggtcatgagggccctgcccagctgtgtgacctcagcccagtcccttggcctcgctgagcttgcacagcatgtggacgaggcagacgctaatgcctcaggtcctggtcagctggtcaccatccctcctttgttcacctcgcctgtcccctgagaggatcatgcagggttttcactcaaaactccaggactgcccatagaagccagcttgagatgaggggaactttcgcggtggcctgtcttgggctgacagggacacggttcagcctccttggaaggtcactgcttcccagggcttgggaagactcatctcctgcctggagagataggcgtgccatggctttccttggcatgcctgtgcggtactcacggacatccaggccctcagtgtctcctggggagggatggggcagcaaggaaactgggtctttgctccacacattctgggccactccaggccaatgcaaggagagaccaagaaggaagctagaaggtcatgtggcaagcacatgcctgctgcccaagtgtgtcaatgtgactgaccttccctgcactctgagtgggcggctggggatgtggtcccagtgccagggagctggggggtgttggcctgccatctgctctcaccatggagggcggctgcatgcccaaggcctaagaggactctgtgccaggcctgctgagtgagtcatcccattcaatcctacagtgtagacactactaccactacccattttccagaccagagaaggaggtctggggagcttaggtggacccacatcttggcagcccctttctgccctctctttgtccacagcctccgcctcctccagaagcctctcaccatcccccatccccggggctgcagagggtgtcctggccttcccctatcagctctgcacccctgaggactcccatccctaggagtccctctgcccaactttggtgcatgttaagccataattaatctgcttcctcatctcttattcatcaaagccacagcagcagcaaagggggctggcacaaggaagggaccgacaaccaaaccctggcagtggccccaagaatcccactgggcctgcccatctccaaatgcctctgacccttcactagcgagggcctcctcccacagaatggcatcctggattgtgccacactaggcaggccccctgacggaccatgcgcacctcccaccacctggaggctgctggggaccgtcaatgggacgtatgcattgcacagtgatggcccttacctctgcgtcccccagccctggactggatcccttgtggcccatctccaggatgggagcctgaacggagatgaaaggacactcggccaagtgggacatgccaggctggcacctggaccctggtccgccactcttcctggtgcctagaggaaggggtgagtccccagggctcctggaccttgagatgagcctcgggccacttgtgtttgccagcagatgggctcagggtcttctctcagtgggcacaaccgagttggtggcctctctctggggaggccggctggtgggggctggggagtaggcggcttctggtccctgaaggcccaaatctggtgcaggggcagagctccggaaggcgggggtccctgggctgtgcccaaggcatccgctgtggcttcacgcccctcccccgcccctgcagggagtgtggatccttctagagccacccacctggcagtgacagctaaattgggagccgctgttcacaccaggagcccagcgggcagtcaaaaccgggtcgggggggaggggcacccgctgaaaacacccacaagctcccagtggggcagggaaggcagggaaggcatggtgatagctgtcagcaggagtgggtggggagtggaaggcagggtagaccgccaaacccatcttggggccatagtgagatggcccctgggatgcttcggctggccagtgcccagccttgctcttgtaggagctccctgggcccctgggttccccactctgggccaccacaatccatgcagcatgcaggtttgttccgtttcccagatggagaggctgagggcttaccacagggttccgtcaaggacgcaaaagggccagcctgactctgagctcagtagccccaccctccacagcctcccttgccgccttcatctgctcacttcctcagtcactcaacaaacactctgggaggcagactgtaacaccctgcatacctctgctggacccccattccacatatccccactggttacaggtggggaaactgagtgcctgggaggcgggccttggcctgagtcccccagtcagtgattccaggataaagggcatagccatgccatttggtcacttgaagcccacaggggtgactgggaagagcccacctagcaccccacattctgctagggtgactcagaccaagtccttggggctctgccccccagccagtggctctgcctctgagagccatgggacagggagctgtgcagggtggggccagcagagcctgtgcccctgcctgagctagtcgtgatggggcctgccctgaccccttcccaggctcatgggtgcggagcagggcggggccttacagtgagatgggggcctctgtgggcagtcctggaggccaggccctggggctgggactcactggcacagggcctaagtttcctcctgtgtccgcaggccttattgcctgcaagggaggtggaggggcacaggggcggtgcccagcgtgaggagggggctctgaggaggctgcagcagccggcaggcctctgagactgggatatttttagccaggattcctgctgacggtccaggctggccggggtttgctgccagccttagaggcgcttctcctagtctgtgtccggacatctggggtctgctggccccacccaccctctgctcaatgcccccgccccactggcccatccagccaggcgaggggctcccaggaggccggccatggtgggagcagagcctggggccctcggggtgtggctgagaagaggccacatgggctgctgggggctgcctgtgtcctgggtctccagctcccagctgccactcttagccgacccgcttaaggggcaggtttctggaggctccggttcatgcccaggctcgagttctgaactgagcattctcagtccgctgcctgctgcctgctggaacggatggctcagcagagcggccacagcttggctccctcctgggcactcctgcctgcccttgccgcttaggtgctctggtcatcaggcctctctggctggctctaccaaggtgcatgtgtgcagggcctgggcttgcagggccttgtggctcagccaggaccacctcccttcccatgggcaagtgaggacatccagaaagagggtcctctgcctcggccactcccttgggacacccctccaccccaaggcctctcgtggaaacagagtccagcactcagcgtcatgcctatgcactccaccggcaggactggctgagtcccgaggagccaggccctggggcacaggccaatcggatggaacccagatgaaagcccagtgctgggacccacggcccattctctggcctggctgaagcctgatggcttgttccttgaatgaatcaggaggcccatccagagcaattgtgaagttcacatgaaagaatgaacgtacggagagagatgggccatgtcgcatcctgaaacgccttatattctaagaccatgataattaacacagaccctggacagtcacacgatgggaaagagtccagaaagaggctcaaatgcaaatatgagaagaggcaggtcaaatccaagaggagagatggaatattcaacaaataatcccacatatacaatcaacacttggccttaagacaacggaattgacatatggaggaaacatttggattcctacctcactccttgacgctaaaacaagttccaagtggaactaagatttaaaaagtaaaaatgaaaccataaaactcctagaagaaagcatggatggcaaaaaaccaatcttgagtcactctaagaattatacaaaacccagaagccatgaagtaaaagatgggtatattcaacctcgtgaaaataaaaggcagatgcatggagagaaaaaaaccaccataaaatgataaccaacaaagggtaaaaacatcggcaactcagttcacaaagggccgtttttggttctcaatacaaatcagtaagaaaaagagcaacagcccaagagaaaaatgggcaaaggcatgaaaggaacctcccatcaccccctgctgaccttcactcagagtgagaaacatgcggatctaagctgcagtgagatgctgcccctcacccacagggatggcagccgcatcaggctgggggttccctaggggggctgcttaggggctcccacaggtctggctgttggagggcagggagaggcctgcgggtctggtggggccggggtgaggcactcacagatatgtctagtgggggtgaggagggggaccgcctgcaggtacagctgggggtgtcaggtcgctggggatggggtggaaggagaggatacccattcaaaacaggaaatatatatattttaaagtaaaacaggctaagtgcagtgactcacacctgtgatcccagcagagcggggagaatcccttgaggctagaagttcgggactagcctggggaacatagtgagtcccagtctctataaaaattaaaaaataaaattatctggctgttacgatgcacgcctgtagtctccgctacttgggagctgaggcgggaggatcacgttagcccaggagttcgaggctgcagtgagccatgattgtgccactgcacttcagcctgggcaacagagcaagaccctctagaaaaataattaaaaaaaaataaaaataaatataaaataaaataaaaaccagctgacatccatcctctccttgccaccactgacatggccgtgggccgagttctcatggccatcccaccgcgagtccccaagcgctcctgatgcctgctcacccttcttgtctttgttagcgccccgttagcagaggcctgcttaacttgtctctggtcttgcttctcaggagccgtgtcacattcaacagtggcagcacagaggccctgctcagccccagtccctcaccctaggcctccactgccagatgtggtcctggtggtcctgcggactcaagctgtccccccctgcccaaccttcacaggccaccagcaagtcccaggcctcccacaggcatggctctgggcagtatctttaccttcccagcctcagtttccctgatggtgaaacagggtgagatctacttcctagcagagaatccgggggaatggaggccgtgggaggaagaggacttgaggaaaggagcattcctgaggggtcccagagcgggctggggctgacaggactgagtttgcagggcctggggacattccctggggaggtgctaagatgccggtcagctagagcagcggggagtgatccaggatggctgcccggatgaggggctgggtcgctggtccctgagtgccaaggtggtctgtccatgtctgcaggaacacacccaccctgctgcctccaggaggggtgctggacaggcctgagctccaggatcataggaggcaagagccactctcaccaaagaacagcaagtgtgcctcccctgccagcaatctgtccggtccagcccctgcccagctatctggggaaaaggccaccttttcagtggaggctgagctcagggcaggaagaggttgagaggggagaaatggagtgagaactggaaggtgagaggtgtgagtgagaggtaggggtgtgaattgggggtgagatgtggtaggtgagagcggcaggtgagaggtagggatgagaggtgggggtgagaagtggaggtgggcagtcatggtgatagcttgtggggtgagaagtggagggtgagaattggggtgggagttggggtgtcacctcccaaaccctctcaccctcagattaagaagcccctcctatgggccctggaggaacaggcctttgacccaccccaaccccactggtgtcttgggcagggagatctcgaggtgggggcctcagctccccgtaggaccgtctagccctggaccacctgaccacagctacagtgggacaaggcccctgttgcctgtctgctgggggccgagcgtggtatggaggagccagcagcccccgccttcatcacagaggaggaatccgaggcccaggagggtgtctctggcacccaacacgtgagaccctttgaaaatcccccgagtgtgtggggggctgggatgaacatctgggggcggcagcagcaggtggcccacctggccaaacacactcctgtgtccccttgtttttggcaatttcaatgaccaaaatcagatcctggtatggagaaaaagacatcggtaaggacgaaggaaatgtgaacactgcatggacgatggctgataatagtgtgccgctattggctcagcaactctaacctaccaatgccagatgctcacaacggtgaaactggtgtgtggtagatgcgatctctctgtactgtcttctcaatttttcagcaaagataaaactgttctaaagttgaaaagtttattaaaaaaaaaaaaagaaaaaagacgggcttattagcaaaaatctgagatagaaccaagcagtagggcccagcccaccccccgctcagggcgcaccagcagtacccctctctcagggacatggccaggcctgggccactccgaagagctcttcctggtgctggggggcctggtgggtttattccacctgtcagtctcactgcaaagtgtggcagtggagtctgagttaggctgactcttaccctgccaaggacacccctgcactcaggacccagccccggcccccttgccctgtgggctggaggcgaccctgtgtgcagatggcagatggaggggcatggtgctgttgctctcaggtcaggggcagcagcctcagccctgaccagccctctcctgcgtggttgtggttgggtctcctggtctctggcctcctttccattccaacctgtagaaaacagtgtggtgggggatgctcggcctgcagatcagacaggccggggtcaaagccccgaactaccacctgaactagtcctggccgagtggcgctgatgctctaggccgagggcccccttgacagaacagccatcatctagctccgccgcagggtaggggaggtggcagtgtgggccgcagccctcggctgaagcgggggccaagcggggctctgcctggtgcagggggtttcctctatggggcaggggctcccaaattagccctggtgacatctggagctcacctctgggggctctgggggctgagagagcaggcggggcccagttctatcaatcatctgccttgttcctgggggatcgcggtcagtcccagcctccccacaagtcctggggcggggcaggcctgctggaaacccaagatgcagagaagagcgccaagcacctgagacagggctctgagcacggaaggcaaggacgcctccctcagcctcagctggggagccagtggccctgcatgcactttctcccgtctggggagcctgagccctgacccagtcccgaggcccatgtgtgcacaaaagccccctgctttctcacccaggacactggcgatcagtgggtaggcgagccggagcccagctgctgcgctcccttccctgccaggaccgggccagctgcatcctcatgcctgggtttcagggcttctcgggggatgtgatggcactgcctgaggatgtgggatccttccactgaaaagggccacacggctgtccccagcacccttccagaagggacaacccactcctgggaggtcttaatgtagacatcgaggtcccccgagcttcctccatggcctggccacttcacaaccatatttctttatgttccacgcgccttgcctgctccacggccaggaccagggccaccatctttgcagccggtgaagggacagctgccgtgggctgggctgctgaggcaggacaggggtccgggccagggaggggtggatggaggccaaggatgggccccttggagacagccttggggtgcagccggctctgccacctctccctggcttccttccctccaacctgtgactcctgggaagtccctgatgggccagccacttggggccgggaagtaactgtggtgtgtggtggtcaccctcaccagagttcatggggtggagcaagggggaagaatctcccccaaaatcaggtgtcttgttcccaggcccagcacagagacctggcccccagacatctctggacatttgttaagagtggacaactgcttccattacacaggagaggaaaccgaggctctaaggggtcccagacttgcctggctgccacagtgagcaggcaacaaataccaagtggctgccgcaatggggtaggtgggaggcagtggctgaaccagaaagtgctgctgtcgattctgctggttgcatgagtcttaggagatcatcaaagggcagattgtggggagataaaaagtatgagtggggaacaggattggggggagcagaagagcctcaaagaccctgcgacattctcaacgtctcgatggtgactcagagatagctccaacccgcatggcgggcagagtgcggaggggacggctttgtggctggattagtcatcccggtgcagctcaccccaaatcccggcttccagccctgggccgtccatgctgggatggaggaagggcagcctctccgcagggccacgtcctggagcctgataacctggccagcacactgtgcaaatggtgcatgagacagggagttggctctgtgttccccacggtggccaagggaccagctgtgcctcagtttcccttattctatcaaactttgaagaaggtcccgtaaaagcgcatctgtttccagggtaggggccagagtcagccacccacaccagagtgagaattggtgggtgccctagccctggcaggatctggcattttgctggacggagagaggaggcagcacccactggggctcgggcaaccatcccggctacccccgccccggcccgccaggagaggagggaagccttgaagtgccaggcctttgaatcgcccatctccatggcaacgcgtgggcacaaagggccgggccggcgagcaggcggcggctgcgcaagctggaaggaggaagggaatcttttatttatggggagggagagtcggggagccaggctgcgcccacgctcagggccaggccgcagtcttgaggctgggccccctgccccatagccagggcctctgagcagcacctgcccacacacccctgaccctccgtgcctggctgggtggacggagcatgggcaaatggagggcagaatggagtgagtgtccagcatgcacccaacctggagatcggcccagagggtccctgggagcctgccatcctccataccccagtctctgtgatgcgggcacccgggcagataccatgctgagagccagctgggcctgcagtgaggaaacgtagcccaaagcagactgcagagctggaactcaggtggggctgctgccataggctctgaagacagcgcaggagaccgggaggggtcaccagtgccaaggccctgaggcaagccagagctgggagcatctgaggatgggcattagcgtggggctccagggtacagccggtccactgcaggcagcctggcctccccagagacccagccacggctcctcaccttggacagggggccctgggccttgggcatcaaatgacctgcttgccgcggtggaggctgccataccaggacgccggcccacggcctccagcggcccgtccccaccttcccaagcccctcccctcatggctcacaccctgttccctgagcccccaaacatgggaaatggcacctgttgtgccccagcgggggaattctgaccccagaccctggggccagtgcagaaaccaccactgtatcagattttatttcatctaaaaaatatctgagccagattgaaagcagcggggaaagggtcccatggctgcttcccccagccccaccctccacaggccctgggccctcccagcccccatttcctttccttgagaaagtctaaagtggggcaatattttgtgaaattggaggcaccacgttggaaattccaaacccgtgtgtacgatgagctgcacgcgcgttttgaacctgccctggttttgagctgagggaagcggagggtgcaggagttgcccactccagaggccctgggtgtgcatgaggagccctgaggctgggccgagagccgcttgtgggaggcactgtgccccctgcccccgagatcagggcctgggtgcccaggacactacagaccttttggggatcctgggggttgggaagcctagagctggaacccacaggccagagtctgagctttcatcccccacccccgaagacgctcccccagccactgcctgcgcatcgggggagacaagctccccccacgcccaccttgcctccagcagggctgttcctcccctcatctgctggcatcagttttttctttaactgagccccatgctggggaagggagagctccaggggaccaggcagcagagaggggaggagagaagccatcaaacaggccgggggctgggaggccatgcactcagcatagagccccacatggcagcagggggctggatggccggcttagagcccattctctcctggacactgttctggaatggcccctggcccctccgttccaaagatgggaccctccggtccccggggacccgggatgatgtcccccaaaccacctctcttcccagacttcatcaatggcaatgaatggtgcatcctggctggggccgccgcccctcactgtgagacttcagcccagacgagcgcccagcccctcctggggtctcagatagtcagaaagaaaggctcacggctgccatgcacttccacaggactttgtggttcctcctgcacccccggtgatgctttcatccctctccagcaccattccagaggccagaaaaccatgatgtttggggtcaaacagctgggagaggcagttggaactcaggccaggcctgtctgactggacagtgcagagactgggaccatgctcccctacaagtgctgtcagtgcaccctcgatgccccccagagcttgccatgccccgacagtcccttcatggccaaagtgttccctggcacaggataccctggggtgccatgtctgcaagagctcacacccttctctccccagctgctgctaactgctgccagaggtgggagtgtggagggctcggggcctcttcaccctccctgcaccaactcagctccagaacattcccagcagtgagaagagggtggccactgtgctgcagccccaagggatgggcaaggccatgccagctggagtcatccatgtccccttggacatggtggcctcattcagagggcagcatggaggaaggtgcaatgagggtggctaccagagacagtggagatgaggcagtcaggaagcccagggacaggactggaggggacacacggccagcctgggacagggcatgaggcctttgttctgcgtgctgtggcatacggtgttggctctggccctggcccatcttttgttagtggtaggagggtgctcctttaatcagccaactctttgtttcaaattgcccctgtccttgaaaacactgcttcagggaagcgtgagacaaagccagttcagtggggtgcctacctggccagcagccctcatccgcaggggctgctcctggggcacgtgccagaatcagacagtcccaccgtcatgcaggtgctggggccttcagtcagcaggaccaggcagcccatgtcctggggacccttggggaggtgtgggcatttgctgagttgggctgtcatttgctagacaggcgcttggcgaaggggcccttttgtgcatggatgccctgggcaggtgtcagtcctgagtcctggagaggaaggcaagctttggagttgatgctgggtcctaggagggagcgtgtggtttcgccagcttctcaaaagtcacctgagaccctgccaagggacctccagacattcggtgcaggctcctggaggctggacagagggcaccaaagggcgacgggccccgaggacagaggtgtgcagccaggtggggccatggccaggctgggacctgctggagctcttgtgtgtgagcctggaggagctgccaggctgggggagatcggggctggggctgggggcggggctgggcgtcagcagggtctgcagctcccatcttcccagcttatagacctgaatatccaggttgagaataaaccattctcccagggcaccatagcctccaggaagcacctcctccttccaccatccgcctttcaggaggggcctccctggggggctgtctctgggactgcagaggctgcttggtgtatctggggctctgacatgagtgagattgttccggggcctgtgctgcccagcctcttccccaacagcttcctctggaggcaaggggcttggcaggagctgcagggagccaattatccctgaggcaagctggctgcagataattgggaagacaggcttttcaccagcagccaagctctggggcgcactcgccacaccaggacttgggacttgaggatccagaggtctgccaaaccccacgcctgattgggagccccatgtgctgccatctaccaggggaggtggcattttcttggcaactgaggggggaagccaggtgctgaggtgtggcccacgggacgcctcgcctggggacctcccagcccttctcctctgcctcctaggggcctcctctccttacacatgaaaacctccaatgtctagcccagggctccagattaggggtcagtgccgcccccagcccaacttcctctgggaagtgtggggttctccccggggcactcaggcctctttcttacagggcttcccaaggggaggcatccagaggaaggcaaaggctgtgatcaggtagaacccgctggacgcccccaccatctccctccatcaacatcaaaagacaagctgaccacccccaatgcaaggtggacattagggttaaaccctgagtgaccagcactcagctcccagcctggccgggatgcagtggggtggggtgtggtgggctcatggggctggtgagagcccggtggggtgggtttcaggtgctgcttgtccagggctcagctctgttccttggggctccctcagcccaagggcccacctcccctctgggcagccccgatcggcgtgttctgcctcggccagctgtcagccacctgcagctcctccctcattgcaccaccctggagcatcacggtgcccagggcaggccgtggagacctggctagcccatggtctgctcagtcctcaccagctgttgtgacagaaacaagtctgtgctgatgagctgagccgaccaggctgcagccctcacttcaggagagggtcaggcccagccaggcctggtgagcaggtgtggggaaggatgggtgctcatgtgcgggaagtttctcaagagtggtggaaggaggatagacaacgagggcccagtggatagggcggggaggcaggaagaggggacagagaggggaccagtgaaggagagtggagggtactgcccccctgggggaaggatggggtggggctggtgttagctgggttgggtgtgtgggtctggcagggagccgggcatgggagtgggtcccgaggaatgctaggttggagccaggaccatgggcctcaccagtcatagaagcctcacctcagggcagagggggctgacagactgggctgacgggaaggggggcttcctgtcaccagagaacataaagggaccactagtggcctgggccatgaggctctgtggccctcaaggtgctgagctcaaggtgggcccagcccatggctgcctttgtggggaccccacaaggagatgctggcctctgaggatgctcagacctggttcagcatggccaggccctggcctagcccaaggtcagcactggccactaccctgggggctgagtctccgtctcgccctgtgacatggtgcccacactatgagccagtgtcaaccctttgcccatacaccgggagccttgtgtgtccatactcatggctgagggcctgtttgggggtctctgtgttgggggaggtgggtccagggtgcgtggcccctgggattgttcatcatgagtgccacctggaaggtgctggagcctcacccgtcctccagagtgttttggggagatcctgtgctggcatcttggctgggccaggatggtgtctaggagggacccttgggagggaagcaggggcatcagggggcctggtgctggggtgggtggcaggagaggcctggagggcggcggcccaagccagtggctgggcaggtgtcaggagggagaggggtgaggcctggcctccctgccacagcttagccagggcctggggtgtcttggggtgggacaaggcccagggcagaggcagggctgcttgcatgcagggtggccacatcccggcctggtgagtgccggccactcagttctgtggccctctgctgccctctgccggccgcctctgtccctgcaggcccagccatctacctgcaggtctggacagaccctcagagcctaggctgggaggtctcaggagtcaagacagggttgaatcccatttgagggcatctgaaggagtgagagcctatgtcaatcccctgcccagccttgcctcggccagtggctcccaggggactctggtgggcagtggctaaagatgacagaggggctcagagaggctgagctgctctgtaaggttgcacagtgagcaggggccgagtggccttgggagaggcaacagcaggagggtcctcgtcatggccacagcccagggacaggaaacccctgctgggttcccccaccaagtagctcccattcccagcccttagggtgtctcaggagaggttccgggggaggtcccacctgcctcctgccttctcccccaaccacaccctaaatgggtcccagctccccagcccctcccacaagggctcacccgccagagctcggggagaggccctgcagggcggctgttcctccgtgtgctgcagtcctctggacactgaaagccaatcccatccatcttaatggcatttaatatgcacagtgaaagtcagcagccacagccacgggcgtgtgctcagggcaaggtttacacgcggatgccaccaggcttagcccatgagtggcctcctgggtcccaggagacctgtggggtgggggtgcagctgggtgggccatggtagcagagacctggggaggggatgtgggaggtaggaactgggctaggcagggactcaggggaggctgaggcctggaacagggagactgagacctcaaggaggctgggacattgggagtcaagacttggggaagctggaacatgggcaggccgagacgcaggggtttaagaatgagggtctggtgcagacctgagttggagcccagccgctgctggccccacgtagctggagagtgtgctgaccccatggtggctagagaatgtgctgttggtagggaaggcaagtgctgggaagggaaaagtgtggtccatttaaatgatacggaagcaggggagggaagtgctgggtagaggagggcatggtcccagactagggctccaaccccacggacctaggtgagaacaggcacttcctacccaaatgttgcatttctcacgaccaccctagcctgccacgcccccatcctgtgcttataaaatcccccgagaccttagcaggcagacacaggcagctggacgtggagaggaacacatcagcggagacacacacgggcggctggatgtcgagatgaacgcactgataggcaccggcatgctggcaggccactgactggcagaaccacacggagtttggctggggcagttggaggacagcccgggtgcacagcggccccactccaggggaaaaccttcccactccacccccttctagcttcccctatctgctgggagccacctcccctcaataaaaccttgcactcattctccaagtccacgtgtgatctgactcttctggtacacaaaggcaagaaccccaggatccagaaagccctctgactaacacaagccaccctacagacgacaaactaaaaaagcccccgtgacacacgcccactggggcttcagctgtaaaccttcacccctagacactgctgtggggtcggagctccacagcctgcccgtctgtaagctcccctagaggtttgggcagcagagcactgaagaagcgagccactccccttctcacacaccctgctagggcaacaagggaactttttccgtttcactggcccaaggtggctggacagtgtgctggccccacggtagctggagagtgtgtcgcgctccctggctttcctcctgatgtataaaatgagttagcgggtcctgggggctgttcccacagtgacgtggtggaggctgaccctgacacccacccctgctgaatgctcagtgaatggtggttgctgtcaggaagcatcattgctgtcctccatcagtgtctgtggggctaggtgactcttggaggatgcttccagcaacgttgcactgccaagacagaggccgtccacctgcctctgggcttcctggtgtgaacagatggatggatgcgtgggcctgctgcgtgcagggagctgaggctgggtcttcacctatgggcaggaggctacacagggctctgggagagacagcactgtggctgggacagagcccatgtgatgagatgccctcggtgcccctggcctccctcctcgctcctgcccctctggaacatcacccagagccccccttgctcttttgggggatgtctgggtgtctgcggttgctgtcactcttgatcccacccacccacccctgcaggttgctggcaggacaagtgcaggagtcatctcatggctttccctgggatctctgtacccgctgagagccgggagctgcacacagcctgtccaccatcctgggaactcaccctgttgctgccgcttgtcctgggtcatcctggggctcactccttgccattcagacccctgtgaggagagcactggctgtgagttgctctgtggctagtgatggcaaggcagggcctggagtagatccatcacgaatagttcttttttttttttttttttttgagatggagtctcgctctgtcaccaggctggagtgtgcgatctcggctcactgcaacctccgactccctggttcaagcaattctcctgcctcagcctcctgagtagctgggattaaaggcacatgtccctatgcccagctaatttttgtatttttagtagagatggggtttcaccatgttggccaggacggtttcgatctcctgacctcgtgatccacctgcctcagcctcccaaagtgctgggattacaggtgtgagccacggtgcccagctgagaattcttaatgaaatgggaacatgcctcccacgaaatgcacaggggcctgcagtgatagagtggcctcaggtatgtgcacaggtgtgaacacgccttccacagagggcagtggacgtgcacatgcctcacacacactgtggcgcagggcaagtgtcccacatgtgttcatgcttgcgcacatgtcagtgggctggatgtgtgtgtgcacacctgtgtcatgcctgcagagaagacagtggagagaaatatgcccaaatctcccctctgggtccctgccctgggtgctgggatgtcagaacaggtcgatgtccttttatccttccccatatccaccacgctgtctaccaaagcacgctttagttttataatcagaaatgaaatgcaccgtttcaagaaagccatgggccagcccctctgtgccctggtgttggcgggggcagaggggtggggtgtgtagggggagattagcctcatgcagccgtggggccagggaggccaaggtcagcttgctcagcacctggaggtacagcgagtaccaacaacacagcctagcttgaccgcggaaggaaaatcaatgctgggcgcaaggactgacggcagactcactgggaacactgtccaccgacgtcagagctgctcacagggcaccgggagcttgccagcgagcttggctgcctgtgtttggaacaaccctggtgggcgagcacgggcccctcacctgactccactcagtgcccttcccagaggggagacaaaggctgtgaacagctctggaggccctccctgccagtgccccccaggcctggctaaagaaatctcaaataccccgaagggcctggctccagcggcccctgctatgggtcagcctcagggggatgctcatcttcaattgaccctgactgttccacattacaagataaactgtggggttaactcaaggcggtattactttgtaaagactgctctttatacaagagcggtggatgcaaaaacaaaaacattgccatgtaagacgggagtcctccgagtcctgtcttcctccattccgtgtccttgcaccccatccatgtgtggcctgcatggacagacagcttcacacactcagactcttccctccccacgcatcagagatgtgtgtccctgttactgacatgcagggaggggctcatcatcttgggcacaccccatggtgctctgagcccatcatcacctatggtggacgttgaaggagttcccaggttttccttttcaggagccatggctcgggccagtgcctaggaggtcagaggttgggggcccagggagaggtcactgcccaaccgtgccaccttggactcagagtgccggcccagggaaccaggcaggcccggctctgaccgtgccgctgggcgaccgctggctgagacctggggctgaaacacatcccacatcagccaaggaaacaggctctgcatgaggcctgaagcccctgaagggctctgggacaggaggagagcccaagccttcagctgtgatgtgcacagcaccgtctgtcctccacccaagggaactcaccttggtgaccctgctggaaggcacaggttgctgacattctgacccctgacattcggacctccagcagagcctgcagtttgagacctctggttcaggagctgggactgatggggcccttggggattcccgtgctgctggaggaagatgggggcatgggggtgtccacagcaaagaagtgagaagtagaggccgccagccccccgccccgacccttccctggctagagtggggcaggcttgggggtgagtctggggtgctgatttcaccctcctgggccaaagtctccccgtgactttatggactgtctccctgtgctccctgagaccctggttctccctcaccagcctgggtccttcttgtctcagctcagctgtcacctcctccgggaagcccccaagcccttgagtgggtgcccagcaggcatggtcagtgctgaggctacaagccctgccggcacccggcagggaacacaaggccaggtcaggctctggggacagtagacaagcttatccctgcacactggggactgcccacctgggggagagagctaggtcaggctggggagacgtcaggggatggccgggcacccctccctgaggagagctccacctgagcaagagtgtcaccaggcccactccagacacatgcactgcctcagacgggctggagagagggtgtggccgggccatgggatgaaccattctgggcggttgtcctggcatcaccagacatgtggctctattaagcatctcgactccacaggagcccatgtggcatgtcctctgacctcctgttcacttctgaaaggggcggccctctgagattctgcctggaacctgtcagccctcctgacaaggtctctggttcccggccatcacaggcacccagccaccctacagagaggctctgggaggctcagccttgcctggggccccaagactgatgccagctggggcatctcacagggagcacccctacctgtaaaccgcccagctcaagccctgcctcgacctctccaagtcagcagccgaccttccccagggcccctcccagcctgcagggggtctgaggctctgaggcttttctgcagcctctcagtcccccaccctgctacctgctcaggcagagagatcatggctctgggttattgtgtgcttagtgggtgctggagctcgtgctaaacaacttgggtgccccctgaatcttgacaataatctgagggggcattattattactattctcacttccccgaggaagaagtcccaaaccccgtctggcacaaagccagcgccccgagtctccctctgcagtccatgtgctcccacgtggggcatgcctgggacatcacaacatctggggtcaatgcggctgctgttgtcactgtggcattcagctttcccaaggctcacatctgctccatccagcaaaggggtcttgcaccccaagcctgcctccctcttcacacacacaatcccacttcgtcaaccacaaagatgcatgggtttacccagcctcaaccccatcggcccctccccttccagttgccggagggctcgggccccttcagctgggctcccacattcctgacccctggcctgcaggccctcaagactatgccagcccgggctcacctggtgccagacacctgcatctccctggggtgggggttgggggcagtaggctccgtggacctagcacacgtatgattcttggaaaatgtaaatgtctctgaggacagcgatcccagcttcaaatattgctgtgggctctcgggcaagtccctcctcctctctgagcttcagtttcccccgcataaaatggagcagtgatcgtagctcctgcatgggaaggttgtgaacaccatgcttgtcagcagaatataccctaattttgcaaggaaacaatatggcaggggtgggggggatctaaatacctttccttatacacgcattgaaaatgattatataaagtggtgaagtgtgattgcattcacataaacagtggcatgttctgggatctagcagacaatcttaacttcaggaaatgcaatcatattttactagctttgagaaaagtgaataaaatgtcatagctaaatagaactcaagtaggatctgtgaacggcagcatggagtggataaggggataacgtaccgatgagggaatttatatacccagcagcccaggtttggtgcaggctgataacggaaagacaaactccaaattaaatgaatgtgaatgaattcctttgcctgcggacagaccaaaaatatcggtaaaagtggctacagggcaagcagaaaaatgcaacaaattagaatgaacgcagggaaccatgtttctggcagagaaacaaatatttcagagtacaggtaagaggcacatggcaaaaaaaacaacaacctgactttgccagagctccaatgtcatgctcacggctgaggagaaacaattatctcgctgggaatgagtgcaagtgagagaacggaaggagtcctgagcacggttgactgcatgtgcccaggggcccggacaggcagcacagcggcctctctaccctcgaaggtctgtttcttgtctgcttcctccttgagagtggcaggccctggtaactggcccaacctcgggggcgcccagcagctgggtccccaccacatgcccaagtctggccctctcagatctgcctgtctcctgagctggagaacggagcccacccctccatccccgacactcatctcccatccagttgatctccctgaggacccccccaccgacaactcccacctggatcccctggccctggtggggcatcattctttcaaaataatccatgactgtgttcagtggctcacgcctgaatcccagcactttgaaaggccaaggtgggaggattgcttgagcccaggagtttcagatcagcctggggtaacacagccagaccctgtctccacaaaaaactattttttaaaaattagctgggtgcagtccagcctatagtcccagctacttgggaggctgaggcagggggatcacaagcccaggagttcaaggctacagtgagctgtgatcacatcactgcactccagcctgggcaacagagaccttgtctcttaaaaaaaaaaaaaaaaaaaaagccatcagctggctcagggtagccacctgccaagggtccccagctgagcgtaagacctgcttcctaggatttacagagctcctgtgaaactcggttgtttcattgattgtcacatggagccagtgactttcaggccagccttgttcccacaggtgggctctcccgtgggcctgggcacccagcgctaggcctgccctgctatggtctggatgtgagcagagatctctgtgatccctgtacccctcgcttctccccctgccctctctgcagccctgcccctggcagcccctgcccaccttcgcctctgtgcagggccacaggcttccttgaagcaaatgctagaactttgagctctttgctttttaaaaaaagataacagctttattgagatataattcattatactattcatttattaccttttgcattataccatgcaattttttccatttcaatggcacaatcgaatggttttttagtctatacacaaggttgagcagacatcaacactctgtagccccagagtatttccagaccccaaagaaactccgtgggccttggcagcccctcccactccccctgtcctccacctccaggcccttaccagtgccacagtcaccaggctacattatgggcttgtcttcgtgtgacttctgtctctatgggtttgcctattctgaactcttcatataaactgaaccataaaacttgtggccgtctgtgtctggcatctttctttcttttcttaaaaaaatttcacttttattttagagacagggtctccttccattgcccaggctggagtgcagtggcacgatcatagctcactgcagcctcaacctcctgggctcaagcaatcccctcacctcagcctcctgagtagctgggataacagacatagaccaccatgcctggttaattttgtatttttttatagagatgaggtcttattatgttgcccagactggtctagaactcttgggctcaagtgatcctcctgccttggcctcccaaattgctgggattacaggtgtgagccaccacacctggctatttttattttttaattgacacataataattgtacatattcgtggggtacgtagtgatgtttctatacatgcaatgtatggtgatcagatgagggtaattagcacacctatcatctcaaacatttatcatttctttgcattacgaacactcaatattctctttctagctagctgaaaatacataatttttgttttggtttggattttggtttttgttttttgtttttgagacagggcctcactctgttgcccaggctggagtgcagtagcaccatcacgactcactgtagcctctacctcccaaggctcaggtgatcctcctgcctcagcaacccgagtagctgggactacaggcatgtaccaccacacctggctaacttttgtatgttctgtagtgatgggatttgaccatgttgcctaggctggttgtgaactgctgggctcaagcaattctacccctctaggcctcccaaagtgctgggattacaggcgtgagccgtgacacctgacccataatatgttgttgttaactagagtcatcctacattggtgtagaacactagaacttattcctgccatgtagctataattttgtatccttcaacacatctctccctccctctccctcccttctttccacccttcccagcctctactatcctctgttctacttttgacttctatgaggccagctttttttagcttccgcatatgagcaagaacatgcggtgtttaactttctgttctgtctcatttcacttaacataagtttctccagttccatgcatgtgactggcttcttcgattttgcatactttcaaagttcatccatgtcatggcatgcattagtacttcattcctttttatagcttaatagtattccactgtatggatggatcacgttttgtttgcaccgttttgctgttgtgaatagtgctactgtgcaccagggttgtattcctctgtgtgccactgggttgagggttgggggatggtaggtgctcccataaagggggaaattgactgatactggctgaaatggaccaggctcttcattaagctggcctctgaatgttgcaaaagcattctgttggtttccaggatcactgcttaagacggttcctttcagtaccactgttgtccaggggagggatgggttcccggagcttcctgatctgccaccttctctgatgtcaccctcagaccctctgcttttgagccccaggctacagagtaaaagtctgatggtaggatgtgaggtgagggaccttccttgacccggcacccacatgaggcaggactgagaacaccctgaggactgcccgggtggctggggtgctgaagccaggcttggcccctccacaggccatgcatgacaaggaccaccctgtctctgagctttgccttggccttgccgtgacattttcaggtgtgtttcagcttagattctgctctggggtttcccgtgtaagaacagggatgacgtctaagcccttgtctggcatttgtcaggaatattgggagaggcaatgtggcagtgtgagaaacaagctcacccatccaaacctgaagaatggactcagaggcacgagcagtgaaagtgagacttttttttttttttttttgagacggagtctcgctctgtcgcccaggctggagtgcagaggcgccatctcggctcactgcaagctccgcctcccgggttcacgccattctcctgcctcagcctcccgagtagctgggactacaggtgcccaccaccacacctggctaattttttgtatttttagtagagacggggtttcaccgtgttagccaggatggtctggatctcctgacctggtgatccgcccgcctccgcctcccaaagtgctgggattacaggcgtgagccaccatgcccgggaaagtgagacttttaatagtggtcttgcgagattggtgtctggtggataggcgcactcagggcagtcacagcaagtaacttatgccctagcacacaagtccctcctcctcattggtcgagtactatggggttacaatcttccaggacattgcctaagtttcattatccaccttataaggttataccccgtcgccttccccgcttaagtttcaattttccaataacgaaactttcttcccttttatgggctgaccctttttctacattctgtctgcttattgtgatcttctacgtgcatgagccgtgcggtttgttacattctcaggctggctgccagtacttagatttatcatgccttgaaaatgggccatttaaaatgttttctcatggcggtaaatcggtgagctgactgtcatacactcagtcattttgcccaaagtgtgtgtgatgtggagggctgacagccttctccattaccagtgcagtgagaggtggcacagctggtgggaccccctctctctcatggatatgagtgcgttagaggggaggtcttgggccaggagcagatcagatcaacaggattatccagaaaatggcagtcatggcgagtattggctccagatggggagggttagggtcagggtcggctcttctcaccttcctgagcgagtcaccagcgtcgacaagttactcccaacatacagggcctgggtggaggctgagtgctaggaacccaggctccaattctggtaaccaggtgcagatgctcaggagaagaatgcagcccagacaagcgtggtgtgccctccagaggagaggacgtggcatcaaagggctgtcttcatggagagcaggaacagagactttgggaagccagggggccttggcctcagccctgctggcagagggtccccaccatgtagctgaagtgccagggtgcttgtgaggactgggtgtggtccagggtgactcagggcaaggcctgggggatgcatctcaaatccacagtcaccagcctagaaactggggtcacacttcccacatgggttcccacatgtggaaatttcattcactaaataacgacacatcaaggcagcagtatggatggggcacagctgtcaaagtcaccagcaacaagtgcaagaagagaagagggagttgcagccacataggtgcccaggtgggccctgggggtcagagagggcctgccaggggtagcacccaccatgctgaccctgatgaggagaggaaggagggtgtgggatgcaggggagggaaaggtgcctgagagcagcatgcaaacagcctgggctcaggaagagccgatggcatgacaggtgctggggagaaaggcgtgataggtgtggacaggggccacaggaggagggatggtcctcaggaaggggagactggtggctatggccggctgccgaggctagcctctctccagcaaaatgagcctggattcatccactccttttgtctctcccctttgctctgtggtgccggcaggaggaagaggagcagaaaaactgttgctccattcatcaggaagcctctctctctctcgagtggtggtgatggtgtcccccaggggcacctggcaatgtctggagacatttacggctgtcccgactgtgtatgtctgtgtgtgtgtgtactacaggcctctggttcctggaggccagggatgctgatacacaacctgcaatgcacagggcagctcccacaaggaaattattcagcctcaaatttcaacattgcagaacaggtcagggagtgcaaggtacctcctgctctttccagcaggtgcaaggtgcacagggagaagcaggtgggtgaggtgggaggaggctggagccagacccagcgtctgtggggtgcaggaatatcgtgaggtgacgaggggcccagcggtgagtgatggggaggggtgcactacggcaggccgccaggggcggttccaccaagaaagtgacatctgggaggggcattgaggcaaaggggccgcgagagggtaggtgctctagaggtggcccacgggcgggcggcactgaggccgggcctgcaggggaggcggtgtggccagcggactcttgttgggtggcaagggaagggaagaaccacagggctgcacaggttccgagggggcctagtggtccgcatttgcccttgggtgggcggtgggactgggaggacaggagaggagcgcggggcaagcccctaagaggcctgaggggtgggagggagaggacggcttcccatacgcccatttagaccagaggagaagcggacccactttgagggctggattctcagccgatccggcctcagctgtgggtccacgcggctcaaggaccagggaggaacccaggtgtgcggctgcgctgatcggcgggctccggacccacctggctggcctggggacctgggaaacccggtgtggtggggagaccgcaagcctggtcaggggtcccgctcccaatggggcgggtctcctgtgaggaaggcggagctcagggcgggtagccccggggaccgggtctctcgcgggggtgtggccacggcccggtgggcggggcctgctgtggacgcacagaggtctgcagcgcgcggggcggaacctcccgaggagagggcgcggctgggagcgcggggcggggccttccgaggagagggcgagactgggagtgtgaggcagggcttcccacggaatgggggcgcggagccggtcctcccgaggagcgggcgcggctgggaaggcgggtcgggtcctctcgaggagcgggcgcggctgggagcgcggggcgcggcctcaagaggagaaggggcggtgggtcctggggcgtgccagaacccttgaggaagaagcgctggtgttctggagtatgaccaccggagccggccgggcctcgggttggggcggggcctcaggggtggggttgggacttcgggatgggttctccagaggtgagagctggggtcgtagggtggaccggcgtctgctgaggaaagggagctgcttggagcgcggggcgagggactcacgtggagaaggcgtgggccctacggcgggcggggcggggcctcaagaggagcgggtgcagatgctagggaggggcggggcccctgggatggggcggtgtctcccgaggagtgggcgcggctcggagcgtgggacttctaaggagagagcgcggctagggggcatgcggggcggggaggggcggggcgggaccaatagcgcatacttaagcggcccgggcgggtaccggcgtcccgccatggctctgcggcgcgtcttgcccgcgctgcgcccctacattccccgcttcgcgccgctgtccacggcgccggccgccagcgagcagcccgccgcgggcccaggggccgtgccaggacgtgggtcggccagggcagtgcggccgctggtgcccgccgtggacttcggcaacgcgtaggaggcgtactgcagctggcgaacctgggagctggcgcgcagcctgctggtgctgcgcttctgcgcctggcccgcgctgctggcgcgccacgagcaggtgcgcggggtgcagccggggcgcggggcttctgcccgtcccgggagcctttacggagtttcctggcgtgaaacgggtgcctcccaagcatctcctggagcaagggaagccaggaagggaggcgtttcctgcagtccctttctgatatcgcgaattttcctacttctcgatgtctaccaactaaaaacaatggtcgttttaatatttacgatatataccacttgtgggaatacagagttatcacttggaatttaaaatggagtattcttcatgttgacacaagagaagcctggtgtagggctcatagcctggaaccccagagttcaatccccgggacccagccgcttcccagacacggccactctgagaacactgttggggaaaaatgggaagcccctcaaacgcccagctttgaactcacccatggtaactttaaaaagtgtcagggcttttggtggcggtggtggggggcaacaagcagaacactgttttagccgcatcagcctaggggtactagagatgacggttatctccaggtgaccctgggaagagtttgcaaggttccgctttttggcgccagggtatctggtggtgttgatttctcaggtgagactgtacagaggtcgggggctgcacccctggcctcaacaggaggcgggggaaggcgggggacggtgtgagatgagaagcaccgagccacacttgagcttaggtgaggcctcggcgggtgcgaggtgagggcagggatccacgaactcagagtcagatgctgttggcccgaatcccatggggagcgccaaggtcagcctaggacccgtggtggcgggagtgcggaggatggtggaggaagaaggagctgaactggacagatggagggctctgggagggcactgctgtgcttgtgcacacaaggatgtcttaaggtcaagttttggccatagagagccccggccaaggagacaggagggcgagaagggacatcccaggtagaggaactggcaaggtgagggacggcgatgtggaggctttggggagtgcccacatctaaggggcatcccaaaagaggagccagtgctggtggtgctgcaataggaggaggaggcagcagggcaggaatgccaggggagggagtggccagccacagggcaaggacgggcattctaggtggcagctgagtgggacagagactagccatgcagaagccatgcccaccttgtggccaggatgtagtgggggctaggaaggcaccaggtcaggtttcttttttcttttttttctttttcttttcttttcttttccttccttccttttcttttctttttttttttttttatggaattcgctctgtcaccaggctggagtgcagtggcgcgatctctgctcactgtgacctccacctccctggttcaagcgattcacctgcctcagtctcccgagtggctgggattacaggcacgcgccaccacacccagctaatttttgtattttcagtagagacagggtttcatcatgttggccaggatggtctcaatctcctgacctcatgatctgctcaccttggcctcccaaagtgctgggattacaggcatgagccactgtgcccagggagctggtgccgcatcttctgcctgggaatcccttcctgacacagcctctgggggccagagatggggggagcagggctccaggggtagagaagccagaggtcactaaggcccagtgtccttccgtgttagaaacacccgaccctgcacagccccatgctggccccagcagccctccgtcaggggcagcgggtcccaggcctgtttatgtttttgtttgtttgtttcaaatgagactgggtcttgctctgttgcccatgctggagtgcagtggtgtgatcatagctcactgcagcctagacctcctgagctcaagccatcctcccacctcagccacttgagtagctgggtctacaggtgcatgccgccacacatggccaagtttttttttttttaatttttgtaaagaggaggtctcacagttgggcgtggtggctcatgcctgtaattccagcactttgggaggtgaggctggtggattgtctgaactcaggagttcaagaccagcccgggcaacagggtgaaatcctgtctctaataaaatacaaaacattagccaggcatggcggcaggtgcctgtaatcccagccactcgggaggctgagacagaattgcttgaacccgggaggcagaggttgcagtgagccgagatcactccactgcactccagcctgggtgacagagtgagactccgtctcaaaaaaaaaaaaaaaaaagaaaaaagatgaggtgtcactatgttaccctggttggcctggaactcctgggctcaagtgatccccccaccttggcctcccaaagtgctggaattacaggcgcacactaccacacccagctaattttcatattttttgtagagatggtatttcaccatgttgcccaggctggtatcaaactcgtggcctcaagtgaaccttccactttggcctcccaaagtgctgggatgacagggcataccactgcatctggcccttctgagcagtgcttggaagccacctcctgacgggggctgggggtcagagtggccagctgaatgctgggccatcagggtgaggggcgttttctcctcatccattgcctgttctcctggggcagatgtaaggggaaggccctgcactggggtggtgttaaacaagatgagatggtaagatctgctttcactttaaaggaacatttctggttgttgcttggaaagaagtgtcaggggcaagaatgctgcaggagggctggcctggagggcagggtgggactgcaggctggctgcacgggggcaggagcctgcgcttgcgtcagaggttcctgagagacttgggctctggggcagaggcctgagcaagggggcctcgctggggtgtctctgtcttagccacactcggtgtttctgggtcctgtgacccatgtgtgagcagcctgtggtgctggtggcacaggggaggaaaccgaggcagggagcctgtgggggctgctcggcaggggacaggcagctcctgtgcccactgctgtcccacacctgcatggaaacacaaaccccaccacggagccccctctcatctctacagggcctccagagcgccatgtgcaagaacttcatgggcggggtggggtggggtcaggagcctgctgtgggctggccaggcatgaacaccaagctggaggtggcggtgctgcaggtggggcagccttccccttccccactcctgtggcttgtgagggggtgggcaccgtgggggcgcacagggggcatggtgggcagtggtcggaggtggttttgggaactcacccagggcacgtggctcactctgcagctgctggggttggcctggtggggaggaggaggtcggagggactctgaacagagaggggagatgctggcaggagggctggagacccagccctgcagggcgtgggcgtgcatcagcagcggggtgggaatagacctgtctatgcagtagaaacaaaccagacatggatcctgttcttactaacgatgtaataaagccagaaacagcaccagaggccaatgggtggggggaagaataaaatgtgagcgaatggggctgatccaggccttctcacttctcaaggaaagtgtcgcaaagatgggcatcgcatccagggctgagattgaggactggttcacggcagagaccctgggagtgtctgggtgagagcagcccccaggctgagaggacacgagcatcagccatggttccagccaagccccagtgacgtctcccagtcctggctgccctgcctgagagggtgggccttgggatgacagtgctgaaggaactgcttttcacacagcaggacttgatggcctcaggagtccctgaggctggggctgggctgggcaggggagacacagggccagcacagaccccatagagggctctttatagaattatctgggtccagagcaaaggtggcactctcagccctccctggagtccacgccggcaggtgaaggatcagagccccatgccccatccttggggccaggggctgggacccaggtcaccaggagcctccagttgaagtggggaggtgactggggtggtgcagtagtgagccatcccctcacacactgccagccttgcccactgtgtcctccctggccgcccggagctgtgtccgcctcctgcctggctgcctgtgctcggcccctccacaagcccaaaacagccctagggtactcagtgttttcagagccgcctagatgcaggactgtttgtgttttggttttaaatttttttaattaatttattttttatagagaccaggtctcaccatgttgcccaggctggtttcaaacccctgggctcaagtgacctgcccgccgcagcctcccaaagtgctgggattacaggtttgagctactgcacgccactggttttaaatttttaaacagaaaacaatatttacatttcctctgtctttttttttttttttttttttgagacggagtctcgctctgtcacccaggctggagtacagtggcgcgatctctgctcactgcaagctccgcctcctgggttcatgccattctcctgcctcagccttctcgtcttttaaaactgaacactgaggtgggttttgtggtggttggtgaacggacaggtttgggcctggatcccccacccgaccctagcacccacaggtggggtcgccaactctgctgatgtgcctcctccctcagcactgtggacctgctggactggagcagcctcatcgacagcaggaccaagctgtccaagcacctggtagtccccaatggacaggtaacacctccgctcctcagtgaggcccagctcagcagggcgctgcgctaagaagggaattcagcctgccacatgtttctcttgttgcctaccctgggaacttaacatgaccaagatcactgcacactatggccccacagaccccctatggtccagggggaaaagaagacaaacccactagtgtccacagagtgcttggtgggacagagacccacgcggagccttaaaacaccacaaggagagggggtctgggggccttccccaagtcatctgtcttgtgcatcaggtcaccccaaacttcagaggcctaaaacggcagcagccactctgcttctgcctcatggttctggggttgacagggctcagctgggcagtcctcgcttggggtctcctgggtagctgtactcacagagtggtggcgctgggacctgggggaggcgcccactcacatgtctgggagttggtgctggctgtggcttgggctttttcccaacatggcagctgggctctaagggccagtgtcccctgagacgtgagagccaggcagaagctgggtgaccttttcctgcctcacctcagaagtcacacggtgtcttttctggcaagttctgtttgttagaagcatgtcaccaggccagcctgtatactgcggggagaggaatgagactcatctgcctgtgggaggggggcccaggacctggctgactgcttgaaaccacaacctaaactggaattcgaagaaagaacagaagcaccttcagaaaacatcctgcagaggcagctttccatgacacatctagccccagtccactaagggcccagcctcaaactcagagcccccgacccagagcctcggggcgcagtgcgtacagtgtggctgtgcaccaaggccaccagctgttggagactttagcatggtgtagcaagggatagagtggtactgcttgtgcccagtgaggcaaggctgctggggccagcaaaggggtgagcgggaggccctgcgggatgggtccccacggcctctgagcaccagctccttgaaggcctcatcctggcggttgccctggtccctggctacgtgtcagcacgtgctgcacaactgccctgtctgcctgtagccaggggtcttcctcctgggccctcttcctgctctgggtggagcccttctgtttgacgattgggtggtcagtgttcacttcctcagtgtcacatgggagctgcagggggccctcccacaatggtggggcctctgtgagaactggggaggctgttagagtacacacttcggagtgcaggcctggactgagcctggggcccactgacatgggcactgagctccctcctggtacccccagggcccgcgtagggcagtgcactggctgcgttggaggttccggggctctgtgctgcttgtccaggtggccctccctcccggccctgcatgagagggttcccgtgggctgggaacactaagagaggtttagcctgggcctcagggtggcacttcctggcccttgctgtggcctgaccatgtgctgtacccccagacaggacagctggagcccctgctgtcccggtttgctgaggaggaggagctacagatgacgaggatgctacagcggatggatgtcctgcccaaggcgagctgtcccgctcgggcagagggctggggccttggggacccgggactcatgcagaagagggcacctgcctcacttgagcaatagttgctcccactctcccaccccctgcgcctctcagaaagccacagagatgggcgtgcggctgatggtggatgccgagcagacctacttccagccggccatcagtcgcctgacgctggagatgcagcggaagttcaatgtggagaagctgctcatcttcaacacataccagtgctacctcaaggcaagcccccgctcagcccctccctgcctgccttggggcttggagaccccacaggaggggctcctctcatctgagctccctggcatttgcctggttttatactcagcacccaccagggagctcacgggatggaggagggagtgggccgtgcccccaaggggttgttggggtcttctgcagcacagctcacccagcgggccccagggtccaggaaagagccccttaggtggtggccacagccaggcctgcagaggaggccgaggccagggtgactgcctcagagtagcaagaaaggcccgctgcccgcagcctctcccctggttctcagaaccagccaagagtgtctaaggagcaagaggaagacaacgatctttatgagggtccactagatgtacccgacaccccaaacttggaaggtgtcacatgaccatttcctccagcgtgttttcagttcagcgcccctaagaacctcatgaaagctttgggccctccccggaaagactcacccaggatgtcacatgtattcagggagcccatcctagcctgtgggccccaaactgctcagggatgttagcaggtccagagctctcaggggtgagccgggtgcccagaggacacagggtggcatggggagggggtccaggcaggagcatgcagtatgcacccctcctggtcggcctgggagtctggagcacatgatggctgctggcgcctgggctgcccccatagggctgtccacaggccacagaggaagctgcagatgtccccactgccattgctccctggagacagaggttggagaaccatcctcacccacacctggtccaggtgccttgagctgcacctccccaggcagctgctgcccagccctggtgactgcacctgggcccaggaaggccccatcctgctgtcacttgggcttgcccaggctccctgtgacttttggccctggccccacaggatgcctatgacaatgtgaccctggacatggagctggctcaccgtgagggctggtgttttggggccaagccggtgcggggcgcatacctggcccaggagcgagcctgtgcagcagagatcggatatgaggaccccatcaaccccatgtacgaggccaccaacaccatgtaccacaggtgcgcagctctcccacccctctgtcttctcagggcagggcgccaagaaaccaggcctgagggagaggcttggagactgaacttgtcagccacatgtgtccccaggtcagaactggtatttcctcagcttttatgtcatgtgttactttttcaaaagcattaaggttattcttttataaatatagaaaagcctattgaacaaagtaaaattggccacagttccctgagcctgctcctgcagacacttagatccagagatgtgcatgaacactcggtcctccccaccctgcaggctcagcctgtttgcttttcagttcacacagtgggatcgcccatcagctgttctgcacctgcttttactgctctagtttcttggtgatcttttcatgtagcacaggctggccaaccatgggcttttcctcttagaggcgtgtgtgcatgctgcaaattcagagagaccccaagtgcctcctggttggctccagctcccctcctgcagccgctgtgcatgtcgtgccacagcgcacacatctccgccattgttgtttgcgctgtagcgtgtcctctgcccgatgtgtttttcatttcgcgttccatctgggtcctcttgtgtgggcttgcagagtggtgctgtcaacagccagcatggagtgcccggggctatgtgtccagcatctttgatcttactggttttcagtctggttattgtaacagggactcgctggacataccgtcaccctctgtggtacacacgggccgtcaggggttttgtgtctgaggatgcagctgtcctaggttgctggaaatggaattgctgggtcagagagaacgtgcgcgtggtcaagcctgctgagtgtcctcgctgcaggagggccgtactgctcgggcttcctggtgcaccgggatgcccacccccactgtgccctacagggacctgcttcccttttatttcctttcagggccaggggtgcactgtacgatccctccccagacgcaaagctgtgtctgtcatgaggcttatgggcatgtttgggctggtccccagagtcacggcatgtttgatgcagggacgctgtgccccagctggttctgtgtgaattgtctggtcccagacatcgcttttgcttggttgctggtctttctttttcatgaggtgctgggaggggcagatgctgctcctgttcctcctgatcctgtggatacccttggaaagagccagctcactggatggatctgggtctgccttcggcctcctctctgtgcagctggtaatgagaggtgcaggcgaccacaggcctggaactgggctcacatggcactcttcacaggtgcctggactacgtgctggaggagctgaagcacaacgccaaggccaaggtgatggtggcctcccacaatgaggacacagtgcgcttcgcactgcgcaggtaggtgtgccccaccctgcaccgaaaccccaacctgagccgttgtctcctccagctggggagaggtggcagcagtgcagagctcagggtgggcagagtgacctgctgggtggtcgggcatttgtggggaaaggctggtgaaatgagctggagggtggcttcagtgggcaggcccaggcccgctggcattctggacatcggactgtgagagcacaatggctctttgcagttacgttggtttttaaaattaacttttttttttagatagaatctcgctgtcacctatgctggagtgcagtggcgtggtctcagctcactgcaacctccgcttcccaagttcaagcaattcttcatgcctcagcctcccaagtagctgggattacaggcatgtgccaccacgcctggctaatgttttgtatttttagcagagacagggtttcaccatgttggccaggctggtctcaaactcctggcctcaagtgatcctcccttcttggcctcccaaagtgctgggattacaagcatcagccactgtacccagccttttaaaaattaacatttgacttattaaacttcacaattaaaaaactaaatttcatcagggtattcggatggctcctgaaaggtacaaatgtagtgttggagcccagtccctcaggaggcctccacagcgctgcctcatttataagcagttcccttaacattttaactacatctggaatgtaacggtttgttttctctttaaacatttgtcccatggagcacaacttcggtagaattctaacaagtcaaatgcagaagttaggtgaagtcagttcttggatactcctgtactgtcaccctggtcttatctcatgccttagcccaagctatgcacacaatggggtcctaggtccccctcccctcccagattccgccttcccagggatgggaccccctagaaccctcggaggcctgggcagtggcctcgctggctctcgccttcctaggagctgagcaggagctccactctcagcagggcagggtgccccagatccatgacttgtggcacgaaggggctccccaagaagctgtgaagccacagggccaggcttggggccagggctgcagccaacaggacacatcctggtgctgctcgggagctgactcacggctctgaaatcattcagtgatgtccacattcagcctttgtttacgatgctgctactttttcatggcctgaaattgcagcacacccatttttgtgccctgatcctctgctaattgtcatagatgtgtcggtgatgggacagactcactttctccacacgcacaggcctggtggccagcactgcccagcactcgggagctggtgggggttcctctcagcttgtaatcaggactcccagcctctgggtggactctcaatgctggtggactcacagcctgactagacacatcaccatccaactccgaaaggacagcccgccctcagcagggcttcctctctccagcttagccccggcacctgtctgtccctactatcttgctgtggcagtggcttccccagtggacacagcttccccctcccgagtggcagccgggctctctcctcttggccccaagggccctgtgccgggctcccccagtaccatgctcacatccctgcctgagaggctggacccctgcaggcttcagctctgcccctgctgtgggtggctggggagctctggggagctggggtcccctcccatgggtaagtggttctagactatggcagctgctctgtcctgtgctgggcccagactgccacaccacccaccctcaaacaacccgagttggctttggccaaggaacaaaccagccccaaacttagaggctggaacagtggcatgttctgtaggccaggggtgggctggctcagctgatgcttctgctgctggctgtgcctgtgtccctcctgcgtctgtgatctggggccggtggggcctaatgagctcattcatggctggtgtagtaaaggagactacatcctgggtccagcgtcccacaggccagcccaggcttgggcacgtggtgggctcaggcttccagaaggcctggagagggcaagcctctgcttgtgtcacctttggtacctccctgttggccaaagtgcctcacgaggccaagcccagatgccaggtggagtgagccactgtcctgtgctgggaggagccgcagtcacatggcagaggctgtgcacaccagcaggggagggggcagccagcagtggcacccggctctcgggttcatgtcctggggttgaggaagacacaagatggaagccagggcgatgtggcagagatgggtgcctgctttagactgggtggtcccgacactggagcccagcccagggatggagggaaagggcctctggccgatgggtactctgggagccagggctggggcagatggagaacaggggaggtgaggccctcggggagggagtgggaagcacagcacaggcactgccagtcacccgggtgatgcgtgagcagcaggcggaactcgccccaggctgggggacccagtgctgtgcagaccagcgaagtcgggatacctggatatagtaagctggagatgaaacttgagaactgtcactgcgtggatatttcaaaccctgagaatctttgtaagaccctatacggggtggtgtgaagacaggacagagtggaggccccaccccagtatctgagcagtgctaatagatgtataatgcaagccacatctgtaatttaaagttttttggtagctacgttaaaagataaaatgaatttcaagaatacattttaattaacccaaaatatacaaaatattacttcaaattgtattcaagttgattttagaaaagcaatgcggcatcgtgcatttttctagaaagtctcctaaatcccgtgtgtatttgacatttgcaacacatctcgattcagagcagccgccttccgaggactcgggggctggtggcagctgtgtgggacacagcagctgtggggatggggcagagcagcagcccacagagggcgagggcaggggccggagaccagtcataccacagaaccctggaggggcttgaggaagggatggcaggagagctgaggagcttctctgccctgtggggcaggctgctgggtgggtcaaagccccagaagggctgcacctccaagaagggaggtagaggagaggtgggagagaggagggtagggaaggcaggaggggggccttgttggctaagggctgaggcctccccagggagaagagtagggcagcccagcagagtcctgctgggaagaggcctcactgggagagggccggacagagcctatatcccaaccccacttcaaaggggataaagtctggagagtgtagatgggggacctggggtggcaggacagggtcagagctgggacaggggccctgtacccctgcaccggggacagtgtcctggaattagccctcagctcctggctttacctgcacaggatggaggagctgcgcttgcatcctactgtactttggacagctgctaggcatgtgtgaccagatcagcttcccgctgggtgaatggggccctccctggtgcgatggagtgtggtgctgggcctgggcctcatggcattatctgcccccatgcaggccaggctggctaccctgtgtacaagtatagggctgtaggtgctgtcatacgtgtcctgccacgccctggagaacagcagcctcgtgaagggtgcccgtcgggagcggcagctgctgtggctggagctcttgaggtggctccgaactggcaacctcttccattgccccacctagcacccccccgcccccgcccaggccatcaccacagctgcagccaaccccatcctcacacagattcaccttttttcaccccacacttgcagagctgctggaggtggagtcaggtgcctcccagccctgccaatggtgggggcactcaggtgtgggctgaccctgatacctgcctgggatagccgctggtaactgttaggaactttcctcggatgtgtgggcccaaggcccccacctctgtgacccccatgtccttggacctagaggattgtccaccttctcccaaggccagcccacatagcccgagcccctcggggagcagtggccgggctggggaggcctgcctggtcaataaaccactgttcctgcagctgagagccctttgccctcacacagggtcagctctgggcaacaaagagggagtggctcagacagggtcagagaagtctcatcccaaactctggcttccagcatcatctgttcctggaggccaggccctgcgcagacctggccacccagggtgctggacacccccaaccctgactccacaaggacccagcagggcccatgggcccaggccagcacggaggggactcatgcagatgcagaagccaagctccccaggtggccctggcatgcctccccgcagggctcctcctcaggccattcctgccaccctgagtcctctatcccagtgacctgcatcaggctcctcctagtggttcccacaggacactgaccaggctgcggcaggcgcatacttgcactccgggccttctcccatgctctccagcccccagccccacaaagcaggctggatgtggtcctcatgccctggggcttggatgggggcccctgtacagatggcagtgacagcatcctgggaccagggctggggcaggaaaggctggagggtcccagtctccaggcagggggaggggtggtgggctgggcacacagcccaggaaggggcccccaggtagaggcctctgctgcaacagaggtgggggccctaccagggccccggttatggcagaacctgcagctatcacacaagccacatttgggccacactgaggcatctttatttctctgggtcacacagagcttgggcctgggagcctcttctgcatgggggctgcagctgccaagggagcggctgagaccagaacaagcgctcgggtgggccccagtgcaggttgggatgtgcccggtggagtaaggtgtgagaacccccagcctcactctctgcctggtcctgaagcagacagcagcaggctggcccagcctcccctttatgagactatcctagggtttgacagcaagtcccagatgaagggtgacaggcagctggggtccacctggtctctcctcagcagggggaaccccctgcgggcagctgggaaggcagtggccaaaggtcaagaagatgaactctgcccagacttctgctgcctgtggctatggtgggacagggctgcctttctggtcacactgggcagcaggcgactgccagggacctcccagtcccagggctgcattccctgcccggcagcccctctgctgcagctttcggatgagttccagcaggttcatctgcagcatcagctcctgggatacagaggggccccatgaaggccagagtgacccccaggcccctttcatcccggcccaagggtgccaggcagtgagcccacgggggcgaccatcctgtgaagcctggtcatggcctgccaggacagggtggaatctgagcttctgcccccaacagggccactcggaatctgagcctctgcccccagcagggccactcggaatctgagcctctgcccccagcagggccactcggaatggcatgcgggaggggagcagaagagggccctgtgtggcacagcaggcctggagagggtgggcagtgcccatggctggctggctcaccctcctgtagggaatgggcctggcctccgtgctgggaatggcacagaaatcctttccagagcctcaatccttccacttcacccccataccctgagcctggctccccagggaccagcagtaaaaccccagatggaatggggccccggggcactcgggctagggcagagcaggcccaggcactgacctgtgggttggtggtcacgtagaagccagccacccccgccttctccagtgtgctctgctggtcagccaccttccggtccagctccaggatgatcttctggtccatcgcccgctgctcctcacggatccggtgttccacggcctgccatggggccagggcgcggagggggagaggtgagggcagctctgccatcagggggcggggaggtgagggcagctcaaacacatgctcctgctgccgtccccagtggcagcagctctgacaccaccggtgcatcctcaccacacccaggcctctcctcggccatgtgaacccctgaagggggccccaaggggcttccacgaatgccctggcttgggactgccttaggaccacacacacatctccacaggcacaccctgccccacggcttgttggttacatgccagtctctggttgtccctgtgctccctgggagaaggatgggccccttcctggccccaacaccctaccattgcctttgtacccccctgaggccacctgctctgtggaggcccaaacccacgaggagctgctatccaggggagcactggtgggttctcaacctccacccagccccagcacacttggtatccgcaaagaggagccacctggtgggactcactaggcctccagtgtcccactcaggcccaggacagccacccatgcctgagcccccacaccccttcagctcagcccagtcagcagagccaggtggtgcccacaggagagctgggccggccaccctgcctgcgcccccagtacctctagttctcgctgctgagccgcctgaaccacaggcaggttgtggggccggcaggcctgctgggcttcctggtgcttctgccgcagcgcctgcctgagcactgggagggatgagagcccgtcagcaggcggtgggactcggcagcagccctcacccatgggcacctgccttgccagcccagcagagcagccaggccaaaggggtgtctgcagtggggaggatgccagcctcctccatcctcccaccccactgtcacccagggccgggcccttatctggtggcaagtctccaggggactccagaaggtgcggggcactgaaagagtggggtggggaagactggccaggtggggccaaagctgcagccccagacccagggcagctggaggaggcaggcgggagggaggctgcagtctgagggcttcagggcccccatggccacaggccatgagacatctactcaagtgtcagagaccacctcaggcaaaggcatgggaaaggagcaggaggagcggggtcgctgaccctgagcgtggggcctctgcctaccaggggtgtggtcgggccctccaccctcagtgctgcccttcagggtagacagcccctccctcatttgcagctcccagcccccgcacagcgccagagggagaagggtgggcagacctgggaggcccaagtttgggatgagcttggggtgccataagcctgtgtggctctgaggggctcaccctcagccatcaagtaaagctccacggtccttgctaaactgtgcacaaacacagatgtgtgcaaactgtctggtctgaagggaatgtacagaggaagcgatcatgggacataaaccaccatgaaacagaacatgcagcaccccacagctggcgccagtgaccagtaagtgccaaatggctacagctccccaggagggaggggtccctggccaaaagaaaaggtgaaacccaacactctgttcctgggaagagccctgatgttgcagctcttctctggtggccagtccccagggaactccagggcccctgaggctcccctgcaggtagcctggctcccgctgtgcctacagccttccccgatctcctgtctcttcacattctgtacacacctcgacgatggtatttaccaaaagcccccctcaagacagctccataacacagggaagcagggaaatgtcatctccttcactctactgatcaaacattgctacaagtgccaggtccactaccagattccactagatagacaaccaaaaggcaagaagagagccacgctggctgcctgggcagaaggggcctggccttagacatgaccagggaacacaaaggaggcaggagcagccagtcgcccctgccaaatcagcaggagaagcagaaagtcaatgcaggcatgcctgctgctggtggaaccagggcctggcccaaaccttctgaagcacaaacagcattgggcccaggcagttactaaaactccccatcctgctataaggaactatagctctgtggaaaaatggccgattccaggactgagacacggagaaaacaagaaaagatgagcctgaacacatacctgaaccagaaagcaagaaagtgctcacagaatgatggggcggcatctaaaggtgcctggagcgcccccaactggccacacatggcacagtctgggcattaaggaataatgagccatgcgcttgggattagtaaactacatacatcttacagctcaataaaaaattttaaaaagacaatcgcccagacatttaggggaagaagtaatgccaattctacacaaactcttctggaaaactgaagaggagagaacacttcgaaactcatcctataaggctggcaaaaaccctgatacccaaaccagatattacatgaaaactatagaccacagtttatcatgaacatagaccaaaaaattcttaagattttagcaaatcaaatccagcatacataaaaaggatactacagcacgacccagtaggatggaattcaagtgactgtaattcactgtagtaatagaaaatgattcaccacgtgatcatctcaagagctgccgaaaagggaactgccaaaatccaacatccattcttgataaaaacacaccaatcctggagcagatggacactgcctgccttctggggaagggggccttgcactgctaggagaaatttttgccacattaaacctgcttctaatcaggcttctaccagcagtccagtgtacaggaaacccagagagtggagaagcaggttaaatgcaagaggaagcatttcgtctgatagatcaagagcagggcattctataaaattagaatgccctggactctacaaaaaagtcaatgccacaataaatgttggggactgtttcagaagcaaagagaccaaagtaaccaattgtagtacatgaacttggactggatccttacttataaagcaacaatttgccacaagttaggtaccatgatgtggccgtgcactgaaagtcaggagacacccggaacagttaatttctcagggggctaccttctgcagctgtgtaggagaccagttttgttctagagcacttgctcccaatccaaggccaaggttgaccccaccacccaggttgtctggaggcattcttggttttcaggactagggagggtacccctgccatcctgcaatgcgcaagacagcatctcaccaaaaagacttacccagccacaaatgtcagcatggctgggttgaaaatcctggtctccaggaatgctgaagactcttggtgaatgctatgctgtcacatgtatatattttgggatgtcaagaactagagcaaaacgttaactattgaactttagtgaagagcacaagcgtatgcactatactatcttttcagcttttctaaatgttttaacttctaaaataagaagtttgggaaaaataacaaaggtggaaactgatggtgcagggggacctgccctatataatttgcaggaaagggctcccaagcccaccaagcaggcctggctcaagtgggaagctcttcgggtttgggagggcgccacaggagacagtgcttaggaatttgatgtgcaactggaatgaggccctgcgaggcctgagagggaactgaccctgaaagacgcttgctgcacaactgtcaacagacttccaactactgaggggcaatgctgctgcagtcagcgccaccaccagagtctgcctgcaggccaatcaggcaccgaggcctagggccatcctgtctggaagcgcgtggggcacagggaagcccgaacagggagtttctgctaagaaggtgggtgctgcgcaactgaaaacaaaactggttggacccactgatcaccaaaaaggcgctgtctcagtctctgcgcccgttgattttgtcaatcttagagacctcttccgaacacttccaaggaaggagctgatctgcacagataccaagagctgcccggaggcgccgacccggaggaggcggcacctcatcccgctgcccccgcgcacctcggtgctcgttctgtaggcgcaggcgctggttgtacaggctcttttcggtgaggtgctggatctccagtagcccctgcacgatttcgaacacggtgccgtcgagaagcgccagggccaggtcgctgagcgtggtgtaggacaggcgctgctggaaagagctgcgggtaggggggcgcggtgagccccggcgggaaacgaagccgcctccgcaggcctccgcccgccccgcctgcgtacctgggcaactccttcaccaggctctgtagcgccgacagcaactggtagtgtcgctcctgctgccgggcaccgtccgccacctcctccaaggcggccgcgtagcgctccatggcgcggacgcccgctagccgccggcggcggcgacgagctcccccagcttcacgacatcccgagcgcggcgcgtcccgccccttttacgattgtcccacgcgcggcgcgctccgcccccttttacgacagtcccgagagggcctggccgcctgccccgccctgccccgcgccccgccgcctgcttattcaggaggcgcgccccgctcctctgcggagactccaaggagggttttgctcagcccaggctcgcacctgcctgctccccgcgcgacattaaaggcgagactccgccgtctggatatcgcaggaccacggagaatcccaccggcccttgctgagtcattgcgggccgaggtccgggctccgcgccggcgcgcctgcgaggtggactgtcccggtcaccggcctccccagaggcaggggtctcgggccagagcccacaggacctgggtctaaggcaccatccgcggccgagcagtggcgctggggtctgtctgcgtcctccccgcccccggggtgagacagacaggaccgccctagagcctctgggtcaggacagtcggagccagagtccccatctgggcctccgtggcccccagcccgtgagcccagactgcgctctccccgctccacaggccagctgctgggccggggctggggggcttctggtggctggggctgaaccgtctaggaacaggctttaataggaggggctcgggtggaggaatggctcctgcaaaggccctgccagagtcaggtcaggtgggtgggcgagaggaccagtgtggccaggctgcggaagccagcacaggagacaagggcgggtgctgtgcattacagaggctgctgggggcttgtccatagagcagcagggggcacggaagggcttggggacgcagacacgatcagacttgcatttcatcaggcactctttagctgcctgctgggtggctgggctgtgtgagatgaccctgctttgaccaggttaggaattatgactggtttccagagagaacattggttagtaattggctatggggaagagggggcgttgagccaaccaactggggtccccctgaagtgccagcaaagtgtctggttttctccaggatctgtttcctcagtccctggcaggattggctcccctgcacgccatgtccttgtggtcccttccagacagaaaccaggcatgaataaagtgaataatgacaagcgctcaggccactgccgtggagggcggtccacaacccagagctggtcatgcgccgggcaccctggcctccaggtccctcagaatggcaggagctggaggtgggactcgagattgtgggagctgagtctgtagtgagtgaccaggagccagctggggctgggcttggtcactgtcacctcccccggaggtggtgagtgggatgattagctgggtgaagacgcctgcctgtttcaccagtgtccctgccctcagtcccccagtccatgaagagtgtctgtgtggagactgggaggatatagggcagccccacgtgatgatatgtctgtggccagctgggcaacactgtcgccagctccggggtctgccaggtggggtgggggctgtgagccacagcaggagcaggccaggcctgggtttggacacctgctcctctgccttgtccgggtgctgatgcaggaaggccccttctccaacccttggtgcaacgtctgacctgaaccagcttccccagcccagcaacactgctcccctaatgtggatgtcaacctaaagaaacaaactgaaccacagttcatatagagagtttgtctgggccaaggctgagagagctgcccaggacacaccaagttgccctgggagtgcttcattcagccttattacaagcaagtttttaaagactgaaggggacaaggagtgggctgatatgaagtcagcaggaattctgactgctttccagagagaacccttagtgactggctataaggtgttggactactgggtaagagttatggtgtccagcgtatggctttttatgcctacttggtgtcagtctggaacccacagagcaattggcttcaagaggtcgttagctcaagtaggagtgggatgtgactgctgtttcattccagtgcctctctgggccagataattaaagggagctcacattcctcagataaaaaagttcctttcgcattaggagaaatacgtaatgtagatgataggttcatgggcacagcaaaccaccatggcacgtgtatacctatgtaacaaacctgcacgttctgcacatgtaccccagaacttaaaagaatatatatatgaatatatatatatactttatacatatatatataaacttccattgtgcgcgcgcgcacacacacacacacacacacacacacacaaagttccttttctttttcatggacatgagcagtatgtcactcaggcatggggactcctgggccacctctgggtcttcagggagggcctggtctggaaggaggggtctcatcctccagagccccagggatgggtgatatatgtgtaggaatgggggagctggttcgcagacgtgcgtttcccctgtgtgtgtggacacgatgggccccatggctcttcccgtcgggtggtatccaccgaaggcctttgctctgcggccactgtccacctccacttggcctcccgagtccaccaggctggctggtgacaccttgggttagtgtggggtgactggtgtgtgttggggagctgcaggtcccctgtctctgacacagctgtgtctgggcaaacaccaaggtttgaaggagtgggtgcctgtgtgtgtgtgtgtgtgtgtgtgtgtgtgtgtgcgcgcacgtgtgtcaaaaggctttgctgcatgccttttgtgtggctctttgtcacatgtgcctttctgtgtttctctgtgagttttcatgtgtcaggttgtatgtctgttgtgtgggcggagaaacagctctgctgtggggccctgagccattgcaggatccccataggccatgcagaggtgcacacagcacctgacctaagcctgctcctcccagaacatcaggctgcacccaggccaccgctcactccgtctgtctcccgagactgttcctcacttcctgcctcactggccctggtgagggtgaggctccctgcccccggccctcaaaacagagctgcagatgaggacgccacccagctgcagtgtcaaggggctcctccacagtgggtgtcccgcaacgcatgctctctgaccccttttgtttcagtgttgtcctttttagtgtgtggcaccaggacagcagggagctgccacctcaggcttctcttattttcactctgtgagtaataaggtctgaatgagaggggctcattgtgtctttactgtcaaatcagtcaggccttggccttggcatgtcttgcgtgtgcttgacaaatgtattgctcatggggtctggtggaggcacagcacccttttagaagacagggtctgtgcggaccagttacgggtgacatttcctaggcacagctcttgcctaagtggtgtgggatgggaggagggcggggcttcccactgtcccaccagcaaaatgggctgtgtggccagctcctcaggacccgagagcatttgctccaggttgataaaatgttgcggtgttgggtggcaagagtaggattgaaaccagccacccagttggtgctttgttaccatcagaagtgtttgctgagtcaaagcaaatggccactcaaaactgagtgggctgagtgtggtgactcacacctgtaatcccagcactttgggaggccaagatgggcagatggcttgaggccaggagttcaagaccagcctgggcaacagggtgagagcctgtctctacaaaaagtttaaaaaattcgctggcatagtggcatgtgcctgaagtcccagctacttgccacttgggagactgaggtgggatcacttgagcccaggaggtccaggctgcagtgagctgagatcacaccactgtactgcagcctgggcaacagaacaagaatcaaataataaataagtaagtaagtgagtaaatccatccatccaccccagagtgagtcagctggggctgctgcattgctcctccctcacccacaggattccctggttccagccaggagacgatggtcaacagccactgctgtagtggtgcctagttaaaactctttggtttctgtctctgtaaaaaaaagtgtctaattgcatttgggcaaaaaacttgcagtgaagagagaaaaagagatgaaagcaacctgtgagggaggctcgggttgacgtgcggcatgtgctgtttgagtgtgatgagtgtgtcggtttgcactgtagatgctcaggaagtgaggatatgtggagtgctgactgtatacatgatgcctccactggctggctgagtagagtttcatgaaacaatgttggtggactcagccctgaatccctcaggcattcagagagcaacctctgtcttttttttttttttttttttttttgagatggaggctcgctctgttgcccaggctggagtgcagtggtgcaatctcggctcgctgcaacctctgccttccgggttcaaatgtcctggctttaatttcacagattctttcttctgtttcttctgtttgatcaagtctgcaattgaaattctctattgcattttcatttcattcatttatttatttttatatatttttgagacagagtctgtgtcacccaggcttgaatgcagtggtgccatcttggctcactccaacttccacctcccggttcaagcgattctcctgcctcagcctccctagtagctaggattacaggcatatgccaccatgcctggctaatttttgtatttttaatacagatggggttttggcatgttggccaggctggtcttgaactcttgacctcaagtgatccgcctgcctcggcctcccaaagtgctgggattacaggagtccgccacggcacccagcttgcattttcattttattcattgtattcttcagttctagaatttctgtttggttcttattatttctgtatctttattgaacttttagttttgttcatctactattttcttgatattattgagttgatatatacattctagtaaatttcactgagctgtcttaaatcaattattttgaattgtcagacaatttgtagatctctatttttggggggttgattacaggagatttatgagtttattttggtagtgtcatatttgctgattcttcatgatctacagactttcattaatgtctatgaagaagcaaatacctcttcttttttttttttttttttttttgagacagagtcttgctctgtcactcagctggagtgcagtggcgtgatctcagctcactgtaacctccacctcccaggttcaaatgattctcctgcctcagcctcccaagcagctgggatcacaggcatgtgccaccacgcctggctaatttttttgtattttttgtagagacagagtttcaccgtgttgtccaggctggtctcaaactcctggcctcaagtggtctgcccgccttggcctcccaaagtgctgggattacaggtgtgagccaccatgcccaatctctttctgtctttatagattggtttcagcaggtacaaaccttttcctgctggatcccttgactggatcacagtcaagtgggcctggagccatatcacatggctgctgcctggtctgcagctgaatctctgattggcaggcctgctatcaaggcataggttagtgatgcagtttctgctggatcctcaggagaactggactgcctctgataccctgattgaacaggactggagccaggtcatggggccacttctagttctacagtcaagtcttcagatatcaggcctattaccaagggcatggactggtatagctccctgtgggtcccagattgagctcctgctggtttactaggtaggtccatgggaagacaggactgcctccagaccacagtagagcagggctagagccaagtcacaggacagctttggtgaccacatttgggttcaagattggtggtcctcttattaggagaatggatggtatgtctttcaccaggtcccaggatgggctggactgtgcccagacgggcaaagcaagactggaatggagtcacagggctactttagtgtccatagctgacactgagatcagcaggcctgttaccaagggcatgtaaaggcatcactgaattcctgggcaggcaagactgactgtggtagagtggggctgaagccaggtcagggctgctttagtttctgcagtcaggaccatggttagaaggcctgttactgggggcataaatggtcatggttcctcctaggtgcttagtggatggggctagttgcaagaacatgatctagtggagctggacccaagtccataggaggacaaagctgctttcagtctgcaactgggaacctgtcactggtgtgtggacctgccttctcaaagcagctctccttggttttgggctttgctagagttttgccacctcctgcctggatattaaaactcttgcaaaggcagttttgtccatgaatggctccagatcattgtttgtgtggggagaggtgagtggagggcctcctgttctgccatcttgctgatgtcaccctaagatgattatttgaattctttgtcaggcaatttgtagatcttcatgtctttggagtcagccactggagtttcattttgtttctttggtggtgtcatattttctcatgcttcctgttctttgaagacttagattgctttcttcatgtttgaagaaggagtcatcttttccactctttactaacttcaggagagaaagaccatcaattagctaagctatagattctgggggtctctcagtccttttctgtgggtggtccttcccttttaagggggatgtcttaggattttgtcccttgtcttcatttcacaaatgaataaaacaaccagaccagacataagtaaaggaatacagcacttgaacaacacctgaaaaaacaactagacctaacagacatacacaggatattctacccaacaacataatacacatacttctcaagtatacatgggacattttcaggatagaccatataacacatcacaaattaattctcaataggggctgggtgcagtggctcacgtctgtaatcccagagtaatttgggaggctgaggcgggtggattgcttgaagccaggagcttgacatcagcctggccaacacggtgaaaccccatctctactaaaaatacaaaaattagctgggcatggtggtgcgtgcctgtgatcccagcttcttgggaggctgaagcgtgagaattgcttaggagcccaggaggttgaagctgcagtgagcagagattgtaccactgtactccagcctgtacttcatgacaaagaaaatgtaccattgtaccactgacagaacgagaccctgtcccaaaaaaggaaaaaagctcagtagatttaaaacgatagacatcatacaaagtgtcttctctgaccacaacaggataaagttagaaatcaataacagaagattttaaaaagttcacaaattagtagaatttaaacaacacactctcaaacaaccaatggatcaaagaaatcacaaagaaattataaaattcttaaagacaaatgaaaatgaaagcacactatatccaaacttatgggttgtggccagttgtggtggctcacacctgtaatcccagcactttgggagactgagggaggtggatagctagaggtcaggagttcaagatcagccaggccaacatggtgaaaccccgtctctactaaaaacacaaaaattagctgggagtggtggtacgtgcctgtagtcccagctacccaggaggctgaggcatgagaatttcttgaacccaggaggcagaggttgcaccactgagctaacaccactgcactccagcctgggtgacagaatgagactctgtctcaaaaaacaaagaaacaacaaaaaaccacaacttatgagttgtggtgaaaggagtgctagggaggaaatttatagctataaacacattaaaaaaagaaacacctcaattcaacaacataagtttacacattaagaaactagaaaaagaagaatgaaactaaacccaaagttagcagaaggaaggaaacaatagagatcagggcagagataaatggaaaagagaatagaaaaacaataaaaaacaaaaccaaaagttggttcttcaaaaagattaataaaactgacaagactacactttgggaggccgaggcgggcggatcacgaggtcaggagatcgagaccatcccagctaaaacggtgaaaccccgtctctactaaaaatacaaaaaattagccgggcatagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaactgacaagactaaggaaaagggaaacaatctaaattacttaaaacagaaatgtatttgagaatatctttatatatttctgtctgtctgtctgtctgcctgtctatgttttagaaacaagtgtctgtctatgttttagagacaaggtctagctccatcgccctggcaacaatcagatgcaaccacaatcagtggcacaatcggctcactgcagcctcgaattcctgggctcgccactatgccagctcttttttttttttttttttttaagagacaggatcttgccatgttatccaggctgatcttgaactcctggcctcaaggaattttcccacctcggcctcccaaattgttggaattacaggcatgacccaccattcccagcctagaaaggattataaaagattactataaataattgtgtgctcataaattggataacccagatgaaatagatgaattcctagacacacaaaacctaccaagactcaattataaagaaacagaaagtcagaatagacctaacctagtaagggaattgagtcagtaataagacaatctcatgacaaagaaaagtcctggacctgatagctttactggtgagttctgccaaacgtttaaagaagaactaacactgattcttttcaagcatttccaaagagtggaagaggagtgaatacctcttaactctttctatgaggccagcattaccctgataccaaagccaaaaacactataagaaaataaaacaacagatcaatatgcctctgatcattgatgcaaaaactctaaaaatactagcatactgggtggggcatggtggctcatgcctgtaatcccagcactttgggaggctgaggtgggtggatcacctgaggtcaggagttcaagaccagcctgaccaacatggagaaactcttgtctctactaaaaatacaaaattagccatgtgtggtggtgcatgcctgtaacctcagctactcgggaggctgagacaagagaatcgcttgaacccgggaggtggaggttgtggtgagccgagatcatgccattgcacttcagcctaggcaacaagagcaaaactttgtctaaaaaaaaactatcatactgaattcagcatcatattaaaaggattatacaccatgaccaagtgggatttattcctggaatgcaacgatgtttcaatatataaaaattgatccatataaattcagacaattaattttaactgatgtatagtttcacattatatgcacataccacgatttacttttccattttcctagtaatgagctttaagattatttccaatttttagctattactaataatgtttcaacaaacacctttggacatctcttctgcaaatgtgtgtgtattctcttggagaaggtttaccttgtggaatttctagtgtgtatgtgtatgtgtgtgggtatatatatatacacatatgtatatattttcaactttactatatatttccaaaaaactcttcaaagtggcagatttaaactccccttcgccgtatataaattcacggttcctaaagcccttggcatagttttgtgtttttatagaaaagggcataaagtcttattgctgttgaattgtaccttgctcttttcaattgtcttttcacaataattcactatttatcatctgttgtgaatattgtggagtagttcttaatcattttttctactaaactattttatatcattaatttgtagaaatcctctttatataatggatattatacttttcaattatatattttgtaaatattttacccaattttctggcttgcatttaacctttatttaggatgcctaggatttttcattttaatacagtctaatttatttttcttttcttcttcatgcattctggcatttgattaataagccatttgttgcccaacgtcattagttctctgtatatacttttaaatatcttaaacatgtaatattcataagtaatttcacaagtagtttaagatttgagtctgtaacctaaatagatacaggattttgtgatatgctgtaatatacagatttttatttatatatggataaaaatttatatgttttttctgacagcatttattggatagtataatttttctactgacttttagtatcatatcttttattacaagtccaatgtattcagcatacctatggatctatttcttggtgcttccattttttcccattgtttaacggtgtatcactgagccaaagcaaaccattttaattattataattaaaacacatttaaatattgataggctattattgttcaaaataactttggttcttcctttccgttgattactttaatatgacttttccaatcaagttctaaaaaaatactggtggtatatttattgaaataactttaataaaattaaatgaaagatcatgtatttgttttctgaattaattcttagatacattaatgttttatgttaccatgaatgtgatattataatataatatttttaattggttgctactgtttataagaatttcattttctgtttactttgccttcatatctgaaaaccttgctgatttgattagtgcatccacaaattttcttggattttctatgggtaattacaaatctccacacaatgaggttgcagtgagccaagatcacaccactgtactccagcctgggcgacagagtgagacaccatctcacaaaaacacataaacaaacaaacagaaactccacacaatgacaacgtatgtgttttctttttttcttcctctttctgtaatatttctttgtcctatcttaactgaactggccagaaaccccaggacaatgataaatacgagcagtgtcaacagacatctcattccctttcctagcttttataaaaaataacgattatgcttcaacattacatatggtggtgtcgatggttttgttatagataagcttatcaggttaagaaatttgtctgcttttcctagtttggtataaagattttaatataaatgaatgttgtattttaccatcttatttttttcctacatctgctaagataatcctgtgttttccctttttcaatctcctaatgtggtgaatgacattaaaataccttctattgttaaaatattcttgcaacgctgtatagaaccaatgcctttattctgtattgctgatggatttttgaaaaatatgtaggtggacttagttttctaaggggaatagaatttctaatatatttaaaatattttgcatgtatgttctgaaggacattggtgtgtcatttctataccatctggctacgagaggagccgactgaaagtcacactgccggaggaggggagaggtgctcttccgtttctggtgtctgtagccatctccagtggtagctgcagtgataataatgctgcggtgccgacagttctggaaggagcaacaacagtgatttcagcagcagcagtattgcgggatccccacgatggagcaagggaaataattctggaagcaatgacaatatcagctgtggctatagcagctgagatgtgagttctcacggtggcagcttcaaggacagtagtgatggtccaatggcgcccagacctagaaatgcacatttcctcagcaccggctccagatgctgagcttggacagctgacgccttggatcatctgccactgatctctggtcaacatttttatcacccaacacaaaagaagcagagatttatcaagttacttaacctgaccctttcatcttttgctacacatactcttgtaattgatctctccatgaattgttttctgtttaaaatatctagaatgttttctgcttcctgacttgattctaatattgtataggtactagaaatggttctagaaatagatctttatagatgagaatctggaagtggtttgctgacctgtttcagtctgaatgaattcctgaccttcttgtcgggaggagacagaaacctgatcatctgtagtgtacggtggtatcatgattacttaaatcatcaaatgtggttattgggaatgatgtgttttttaaagtggtacatgagaggtaaaattgctattgtagttgactgttgcagttataattttgtcaacatggtctgtaagagtgcaatggcgtcggcccggtgcggtggctcacgcctgtaatcccaatactttgggaggccaaggtgggccgatcacgaggtcaggagatccagaccatcctggctaacacagtgagaccccatctctactaaaaatacaaaaaattagccgtgtgtggcggcacacgcctgtagtcccagctacttgggaggctgaggcaggagaatggcgtgaacccgggaggcagagcttgcagtgagccgagatcgcgccactgcattccagcctgggcgacagagcaagactccatctcaaaaaaaaaaaaaaaaaaaaaaaaaaagagtgcaatggaaagctggtagaaaatggacattgtttaaagaccaaaacaaccacactactttgctaatccctatcagctaaagactagagaatatatgaggcatagatttacgtggtgtttgactaaggcatgcagaatataatcttgacataggctaagtttatcaacatagatacatagagattctaaagttaaagtcttagcccaagaagttagaagtggtgctcaagtttgtttgtctgacagaaactgtgaatccacactggcctgcttattttgaggttgcgttgccagagctttcctagcataataaagagaggtgcatacaaaggaataggaatagtaggaggtgggggtaaaaatatcaggtgtgatccacatgccaagccgacccccactgtgtcccacaggaagccccagaagatgtttctccaagaaattaggattcgtttgttggggagggctgctggcatgcttgaaaagtactgtgacggctgaattttgtgggcttggggagattgcaggttctctgatttcaaggggaatgatgtgatcctagagttgcaaagaacaagtgacagtggaggcgcttatgctttgtgactgcactagagacaaggaagacacaactagaataatggggagcaggaatggagcggccaacagaatatctgactgttagggatctttgatgaaggctgattctcagggagtgaactagatcagtgaccaactatttgtctttatataactgggtagtgtggatggattctaataaagggactacttacagcacagcaggaaagtcacaaagaaaccagacagaagagtgtaagtagtaaggggccaagcagtcatctgactagagacagtgccagcttgccaaagaaggcaccagacagaagctgtgatcttcagcaaagggacacagtctgcctgtgctgaccctgcaggggcagaggtgggggataaacacactcttctctcacctatcttctgccaccccctccattagctgaaccccaataaaagcatgagggtaagggagatctctgaagtatccaattcaggtgagcctcctaaggaacaaagcagaatgcagaaaaattaagagtgggtctagggaataaaatagagatatgcaccagagtatgatgatgtgtctgggaaagaatatacaaatacttttaaaattactagacaataaacctgagatgacactaatacaggtaaatctcatttaatggtaatatattccaagaaatgcatcattaggtgattttgtggctgtgcagacaccaaagagtgtactttatacaaacctagacagcgtagcctactacatacctaggctatatcgtacagcctattgctcctgggctacacacctgtgcagcatgtcactgtgctgaatacagtaggccaatggtccgcaacacccaagccatggaccagcaccggttcgtgtcctgttaggaactgggcacaaagcagtagatgagtggctggccagccgagcattactgcctgagctccgcctcctgtcagatcagcagcagcattagaccctcacaggagcgcaaaccctattgtgaactgcccatagaagggatctaggttatgttctccttatgagaatctaactaggctgggtgctgtggctcacgcctgtaatcccaacactctgggaggtcgaggcaggtggatcacaaggtcaagacaatcctggccaacatggaaaccccgtctctactaaaaatacaaaaattagctgggtgtggtggcgcatgcctgtagtcccagctactcgggggactgagacaggagaatcacttgaacccgggaggcagaggttgcagtgagccgagattgtgccactgcactccagcctggcaacagtgggagactcagtctaaaaaagaaaaaaaagaaaaaaaagaatctaactaatgcctgatgatctgaggtggaagagtttcagcccaaagccatccccactccgtggaaaaattatctttcacaaaaccagtccctggtgtcaaaactttggggcccactgctgtaggcagttatatcacagtagtaatatctaaacatggaaaagatacagtaaaaacatagtacattgggagaccgaggggggcggatcacctgaggtcagaagttcgagaccagcctgaccaacatggagaaactccgtctgtactaaaaatacaaaattagctgggcatgctggcgtggggctgtaatccctgctactcgtgaggctgaggcaggagaatcacttgaaccccggaggcagaggttgcagtgagccaagatcgtatcattgaactccagcctgggcaacaaaataaaactccttctcaaaaaaaaacaaagaaaaaaatatatatatattacaaaatttaaagagagtggtacaccagtaaaggacacttagcatgaacagaagttgcaggactggcagttgctctgatgagtcagtgagtacttggtgagtgaatgcgaaggcctaggatattactgtacataactatagactttatatgcactgtacacttaggctacactaaatgtatttaaattttttctttctttaacaagttcatcttagcttatcatgactttataaacttttaatttttttaattttttgattctttggtaataacacatcttaaaacaaaaacacattgaacagctgtacagaaatactttatatccttatttgataagcttcatttattttgattttttatgttttaaacatttttgttaaaaactaagatacaaacacacacactagcttagccctgtaagggtcaggataatcaatatcactgtcttccatctcgaaatcttgtccaagtgaaaggtcttcagggtcttcagtggcaataacatacatgcagctgtcattttctatgataacaaggctttcttctggaagaactcgtggaagaccttcctgaagctgttttatagttaattttttttaatgagtagcagtactacactctaaaaatatgaataaaatctatagtattatacatactgttgatccttgaacagtgcaagggttaggggaccagctcctctgcagttgaaaatccatatataattctgggatatccccaaacttaacttaatatatgatatatatcatatataatatatatgatatatattacatatgatatatatcatatatattatatatgatatatattatatataatatgtatgatatatattatacacaatatgtatgatatatattatacacaatatgtatgatatatattatacacaatatgtatgatatatattatacacaatatgtatgatatatattatatacaataagtatgatatatattatatacaatatgtatgatatatattatatacaacatatgatatataatatactatatgatagagattatatacaatatatatgatagagattatatacaatatatatgatacagattatatacaatatatatgatacagattatatacaatatatatgatacagattatatacaatatatatgatagattagatactatatatgatatagattatatacaatatatgatatagattatatacaatatatatgatatagactatatactatatatgatatagattatatactatatatgatataaatggtatatcatatatgatataaatggtatatcatatatgatatatacaatatatcgtatatatgatatagatgatatatcatctataagatatagatgatatatcatctataagatatagatgatatatcatctataagatatagatgatatatcatctataagatatagatgatatatcatacctgatataggtgatatatcatatatgatatagatgataaatcatatatgatatagatgatatatatcatatatgatatagatgatatatatcatatatgatatatcatatattatataataaatgatatatattatatataataaaagctatatattacataataaatgatatatattatgtaaaatatatgatatatattatatattatatctgatatatattatatattatatattatatattttatctgatatatattatatttgatatattatatattatattatatataattatattatattatattatattatatatattttatattatattatatataattatattatattatattatatattatatataatttatgatatatataatgtattatatataatttatgatatatattatatattataaatcatatatcatatatattatgctatattatatataatatagcataatatatcatatattatataatatataatataatataatataatataatgtaatcatatataatatataatatattatattataaaatatattatattatgatatactatatattacatattacattagataatattttatataatatataatatatattatatattatactttattatattacatatataattatacattatatttcatatataatttataattatatataattatatattatattatataatattatgtataatatattattaaatataatattatatattatattaaatataatattatatattatattaaatataatattatatattatattaaatataatattatatataaggatgcaggatgtaaaaggaaattatatatatgttatatattatatatattatattatatataattatatatatatttgggggtgccctatttcctatctcataacttattttaagaagcacagcataataatgtgtggacttgggattcagtttttgaaacgacacactgagccttccatgaccttcctgtacatgtgaaagcacacctgtctgcatggcagcatttggacctcacagtgtggattgtgccttcaccctggaatgtttatgccctatcgccatggtgatgtgattagggatctgctgcccttggtcctaagtgccactatctgtgctgagtttttcaaaggtcagagcagattgaacctttgtggttccattttccctgattttgatttttcttatggggaacctgtgtggctgcattcaaggtatgttcatactggcctgtcaaatgcgatcttttcaaattactagttaatgctttcaaaatatgttatttaaaaaattagcctctgtattttccatatgcagttataaatatgtttcatggttaggttttattcctcaatttatatatttgattcttataccaagcagagtacctttgaaatttttcttcatttaaaaaatatgtatcttggctcaagcctgtaatcccagcactttgggaggccaaggcaagaggatcacaaggtgaggagatcaagaccatcctggccaatacggtgaaaccctgtctctactaaaaatacaaaaaattagccaggcatgatggcagctggtgtagtcccagtgtgaattgggattcagtttattcccaaattcccaaaatatatatatatatataatatatattatattatatataattttatatataatatatattatattatatataattttatatatatatatttgtcggtgccctatttcccatctcataacttattttaagaagccagcataataatgtgtgggcttgggattcagtttttgaaacaaaacactgagcctttgatgaccttcctgtacttgtaaaagcccacctgtctgcatggcagcagttggacctcacagtgtggattgtgccttcaccctggaatgtttatgccctatcgccatggtgatgggattagggatctcctgcccttggtcctaagtgccactatctgtgctgagtttttcaaaggtcagagcagattgaaccattgtggtttcattttccctgattttgatttttcttatggggaacctgtcttgctgcattcaaggtatgttcatactggcctgtcaaatgcgatcttttcaaattactagttaatgctttcaaaatatgttatttaaaaaattagcctctgtattttccatatgcagttataaatatgtttcatgattatgttttattcctcaatttatatatttgattattgtaccaagcagagtatctttgaaatttttcttcatttaaaaaatatgtatcttgactcaggcctgtaatcccagcactttgggaggccaaggcaagaggatcacaaggtgaggagatcaagaccatcctggccattacagtgaaaccctgtctctactagaaatacaaaaaattagccaggcatggtggcagctggtgtagtcccagtgtgaattgggattcagtttattcagtttattcccaaattcccaaattatatatatatatatatataatttccttttacatcctgcatccttcaacgttccatcccccaccccacagattaagttattccccaggggagaatatggcaaagtctattttaatgcagtttttaacccaattaagaacctatgaaatcattactttccaaaactttggaacaaagccacagtagtatggatccgttggaggcttttcacacaataaaatgtacatctctttgtttttaacatgtttttcccttcctctcttctttttttgtgaaatgtgtatttactttaatatatttgtagtaagtcacttccatgcacatattaattttttaaagtaataagtatgtgtattgtctacgtgtgaaagaaaacacacatttatttttatgccttggaagttatccagaatcatggaattgtcaatcacagtcaatcacccaacctactcacctttccagtgtaatcttagtcaaattttttttttgttatccaatgagatgcagtatttcaactcagaaagataaatagagtgaatttatagagactattaactaagaacatacagttttatttatactcagaagcaagtagattatgtacatatatatgaagataaaaattaaaaggataattgtgtaaatttgcatgtagagagctttgaaaacctgtttacttgttaatgctgttttgatgtattgtgtctttgttctcccgacccatcatccagagctctctgcaggagctaagtgctcatcagttccatgatttggaaactgtctaagtttagaggcacttgtatttgttagtaaataaggcaagatgatattgtttcacaggttttagtgcagaagactgaatagataagctgctccacccagtacactggtgttcatttcatggtcatctcatctgttaaccatggatataaaacatttatcttcaatgatggggttttaccatgttggtcaggctggtctcgaactcctgacctcaaatgatccacccacctccaccttccaaactgctgggattacaggtgtgagccactatgcctgactgattattttcataaccaagaaaagaaataaatacaattaatgctggtgcatggtattaaatctagtttttaaaacattcacacataaacaaggcagaaccctataccctccatgataaatgcagtagcagtgtatgtgggtctgtgg

SEQ ID NO: 258 - DNA, 2867641 bp, Homo sapiens (residues 1,433,822-2,867,641 of 2,867,641)
  misc_feature (283802)..(283802): n is a, c, g, or t
  misc_feature (283822)..(283822): n is a, c, g, or t
  misc_feature (283824)..(283826): n is a, c, g, or t
  misc_feature (283828)..(283829): n is a, c, g, or t
  misc_feature (283831)..(283831): n is a, c, g, or t
  misc_feature (283926)..(283926): n is a, c, g, or t
  misc_feature (283930)..(283930): n is a, c, g, or t
  misc_feature (283936)..(283936): n is a, c, g, or t
  misc_feature (283946)..(283946): n is a, c, g, or t
  misc_feature (283973)..(283973): n is a, c, g, or t
  misc_feature (283977)..(283977): n is a, c, g, or t
  misc_feature (285181)..(285181): n is a, c, g, or t
  misc_feature (299588)..(299588): n is a, c, g, or t
  misc_feature (306297)..(306297): n is a, c, g, or t
  misc_feature (306303)..(306303): n is a, c, g, or t
  misc_feature (311059)..(311059): n is a, c, g, or t
  misc_feature (311063)..(311063): n is a, c, g, or t
  misc_feature (311111)..(311111): n is a, c, g, or t
  misc_feature (1615094)..(1665093): n is a, c, g, or t
aggttgaaagggacttggtagatgtcaagaaggtagtggcagtcctgctgggcttttaaagggtctgaagaagtgacaggatgctgtggttgaatcctagcatgtattttagcatttgttcatttggagttgattatttcacgttgctttcatttgccattacctggaaagccaagggctctactctcatttccttgctgctctttctttgccttccttggtccgtgaagaagatggtccaggagaagctcattccatgcttgttaaccaggcacgcccctaagttccagtccctgagtcattcatgagtagcactgccaatgaactgacagcaatgctgtgtccctccacatcccctaggtgactcgaagaagccttccaaaaagcgtgtgaaaaggaagccctactctactaccaaggtaaagtagcctgtctttgcctaagatgcaaatgttgttttcttggatcctttatttttcagttgatatcagctatgggaaaattatccactacattataggtgttagataatatttccttgggggtggaggaggtgtattttaccaactgacacctgattccagaggacgtgcaaaattggcagtgtcagatagtacactgggtgctaagggatgttttcttcaggaacaagctttccactttagataagaattctgcaatttctactcaaaaattacctagacagaaacattcttcaagaaaagctcctgtgctttcctaagggaactctactctagagttggggcttttgacttgaaccttatttccagtcttggttacccagagtttccaagtgaacaaaagacctgtgtgagccatccatagcatagcctgattctcagagtgttttccttctctaattacaggtgacttcagggagcacattcaatggtacgtattctggaatcactcactggttgttagaaaaggattctacaggaaatctggagcttaactgctggcttttgtctggagagcctccatgatccaagacatctggtgggaatgaggatgtagggtatagtaaaagaaactggttttcctggtgacatactctttttatctatgtatagtttctgggaacatgttcacattaggttgtgtgtgggtatgtgtgtattagggcgggggtggggtgaggtggtctgtgtgcaagtctgcatgatttgcttgtgaatgtgtgtctatgtgtgtttcccctacgaaaaaaatgttgtgtttacccagcacaactctcagtgccatgtttcttaatttaacaaatcagaccacatactttacttacattagttcacacctcatcatcatcatgcccatatgttgtgagcttgtttactgagcccacatgccagatggagaaactaagccacataaataaatgtgccctggttcacttgctgcatagtgaagagtcaaaatgtttactcatacggtgctaatgttgaaggcctgaactacaacctctatttatcagccagtgaagagatcactattcaccatgcaagggagttccagcaccctctatgcctggaattacccacacctgcagagatcccaaacgccatccctcacataagagaacgtcatgatctcataatccaggtagctatgtagacatcttcctgcaggtgtcacatagtccttagtgtgaaaccaacatagaaagcccatgtttctgatcaaatcacaggttctgaaacactaagggaggcactaagtaggacaatgtggtgcctgcgtgtcatagctgggtctcctcaagacatggatcaagtccagtaagaattggggagatgctttagagtcttgatggagttatcaccacaagccctctgagctacacactttagggatcatgaccattaagtactcaaattaccatttggttgttatccgggtatccgtcgtccttgtggcaaccctcttgtgaagctggtgtggacagcctcagtgctggagctgtgcctgccttctgagtggaccctttctgtgttagcaggtgggtacaagcgtgggggtcagcacactcagtggatttacacacacagcgttgaagagtaaggctgggcttcattatttatacattttcaataaatgatgatcttcataacataaaatcaatgatgtagtacactagaatactgtccctagtattgaatcttgtctctcagcaaagggttgcttaaagtcacgtgacagattccattcaactgatggcacatgctgtagcagcagttaaagcagtcatttgaaaaggcttttactataaacttacgtgtgagcctgaagtgggggataaaagaggcgattagctcccctgtgccatgtttctcttatgtgcgtggtggaggaaaattacacaggaaggtgatggagagaacagagcaaaggattggacaggtccattgaacccataagactatggtgaggttagtgaatgagattggtcattttaggtcaaattttacccagagctggtgcagccactgcccattcttagccagaccttattgcaggcagctctgatcaatagtcaaggaggcagtgggggttgtagactttactcattaaatcaccaaagcaccagcccacacggccacttttccagttaattgacagtagcttgcacattcaggtttgatcagtggaagggaagttactctttgcagacccatttttgacaatcattttgcggtgtcggaaggtctgagcagcctcgggaggcaagcagtccctggtccctcagtgtagtcactggaggagacagtcactgagaggcagctggcagggtgaagggaaaggggaggcaggccacagagatgacagcctttaagctgtcatactgggaggtcaaggatctgaaagaggaaggagaattctttatcattaaggacctgtccttatctcaggcatttcctccagagcaccacctttgtccacccacacaccttgggctaggaggactggagaaagacagtgaggggtctcttgggtctctggcacagggcgtgatgaagagatggcagtttttcaggaatctctctctttagggaaccaaatacatttcccatctcaggtccttcactcagcggggttgaggttctgctcgtcacttatcatctctgaatgtcagcaccctcaagtgtaaaatctcagccacagcccctcctctgcaccccctgcagggctgatgttctctataaaccataaggcgtcatgcccacggaaaagccgaacaggaaagcatgctccactgccccggagccatccaagttccccctccatattccgccactgctaagtgtccagcttattcctcctggcatgtagtaaacacttagagaacattactgaagtaccagtcctctctaaggttttcctgtatttagtgattttttagccctgtactgtgatactaagaagtagggcttaaatagggcctaaaaagtattgctaaaattacattatgacagtgcagagaactgagggcagagggaggacatgagcttgccaggtccacatggcttagtggaatttgaatccgggcccccactctgcaccagccctgcactcacagtcatcctgctgtgttcccctctccaggaaggcactgcccacgcagtctgtctgatagaggtgttgagtgctcactgaactccgtgatcttcctgaaacccaactttgattcagtgggctctgcttggaagcctgtaaagaaaaggatcataagtttaaacttagaacagattatcactattttccctctggtcttctgtcagcaagatgtcaacagccctatctattgtcaatgcattaaccagcatcttctctgatagagaatacaagaagatatgctgtgcacaccaaccagtgtaggagacctcatggctcccgggtaaagaagaagaggtacccacaagaaggtactgtggaagttcattaattaagttgattcaagaattgcagttgcggggagtattcagtgtcccatatgtaagaggaaactatgaagagactaagccatattttttaatgtgtcaggattctaatttgcctggtcagtaaatattgctaccaccacaaaagtaaatatctacttaaaagtcaattttggttcatgtttaatgatagacaatgtttcaagctaatgtctagaacttacctggttgttaaacataagcatagatctccctgaaagagtggtgctatattattatttttcaattaatatatttctttagagagttttaaattgacataaaaactgagcatatggccgggcgtggtggctcacacttataatcccagcactttaggaggccaaggcaggcagatcatctgaggtcaggagttggagaccagcctggccaacatggtgaaaccccatctctactaaaaatccaaaaaaattagccgggtgtggtggcaggcgcctgtaatcccagctactcaggaggcggaggcaggagaatcgcttgaacccaggaggcagaggttgcagtgagccaagatcatgccattgcactccagcctgggtgacaagagtgaaactccatctcaaaattaataaataaataaataaataaataaataaataaaaattgagtatataatacaggaagttcccatattattctgtctcctcaccctcacttcctaatttcacctattagtaacatcttacattactgtggtacatttgctagaataatgagaaaatattgacacattattatctgaagtctacatttgcataatgttcattctttctgttatacatatatatgaattttgaaatatttaaaacattatgttcacccttatggtctcataaagaaaatgttcacttccctaaaaatcctctcttctcattaatctctgtcctctttctccagaaaccttggcaactattaatatttttactatcgcttcagctttgccttttccagaatgtcatatagttggaatcatatattatgtagttttttcagatgaatttattgcactaaattgatgtacgctttagctgctttcatgtcttttttatgccttaatggcaaaaaatggcacattaaatcaccaaataatattgcattcaatgaatttttgtctttttattcacctgttgaagaattcggtagatttcatgagagaaaccatctgggcctggtgctttctttttcggaatgctcttaatgtgaattcaacttatttaatagacataagtttattcacattaggattctagcgtgaccttgggaagattgcctttcaaggaattgatacatttcactgaggttatcagactgcggtcatagaactgttcatgatattccttttaatgcctaacagttcagtagagatggctcctcttttatttctgaaattggtcatttgtgttatcttctttttcttggttagcctgcatatcaattcattcattgtaatgagcatatcaaagaaccagcttttggttttattgattttctgatgatttcagtgttttaattttattgatttctgtgatgttgtttattacttttacttgctttccattgcattcctctattttctatagttccctaattgaaacatgatattactgattttaggtcttgtgatttttagtatattgcatccaatgctgtagatttccctctaaggactgcttttgctacatccagaaatcttgccaagtcacattttcttttaatgtagttaaaagtatttttaattttctattgagacttcttaacccatgagttatttaaaagtgcattgctaatttgcaaatatttggggattttgtggctcttttacagttgttgattttttgttgtcaggtatgtgttgcaaaagcagtcgtctacctcatcttgccaccacccaagatggcccaggatgtgggctctccctgagtgaatctttggcaatctgccaacctgatgtgttcggcctccttctttagtctgagcttgccttctgcttagaaagggccattctcagttctggcagggagttttcccaacattgagaaggtggcattcttactccccactgcagcctgcacctctgaccggtggtcagcagacaggacagaggtcctcattagacagagttcagcagggtctctgaccaaagtgcatcttcagagtctgcacctacccactgtgaccacgggcaggctctgagtcctaaagcaggaggaactgtgcgaccatcctgattggaaatttgtgaggatcaccgtgttactcaagtaaggtctttggaaagtgtcgtattactactgtttgtgaactgcttgttggtggcctggctgagccacacactttatgaaaaccaggacccctcagctggtgtgggtgtctatgcagcctgagaccctcatgtgaacagcctcgtggcagctgtctttgccccttgccaccatcagtgcctccttgttcctgggcactgctttctctgatggtgctccattgttttcctgcacctcagtgtctacagctggatgtctcttccgcaatctaggcgagggggcatcaacggcagttctgctgtggcactgccctccttcttagcttgtcttgctctgtcttaggctccctcaaagatcccacccttcaggttcttccacaagtttcttattgaaatccgagcagaaaactatgaccaatatgaccaatcctatacccactgaagacatgaatgaagaattaaaacaattctccatggactctaccatatagatccctagaagtaatttctaaaaaaaaaaaaatcaaggaaaatgtaatagttttccataaattagaataccctacatgtacaattaaatgaaatggctagtatagtcttgaaaccaaaaccagataaggtaaattaaattctgtgatattttaaaatactttaaattctgactaatgtgagttaatctcaaaatatgaaatagtagattaacattgaaaatgcaataaataaaattagctacctcaagagtttaatggaaaaaaatgtgattattgcaatagattcaggaaattcatgaataacattcaccctatatttgtaggacaactatctgattaactttaagtgacctgttacaaccacttgaattaatgctgctttcacagcatatctcttggcttgttaaaaacccgacaagaatttccgtaacattatttttaacacctatattgggtgtgaacccaccataaagtttgcccactgaaaaggtctacaatttgatgctttattaaattgatactgtgtgcacccaacaccacgatctaatttaaatatgtttccctcacccaagttctgtcttgcgcactggcagttaatccccactcccatctccagccctaagcaatactgctgtgacattccatctccataaatttcccacttgctttatagaaatggacatatatatatatttggaatctgacttccttcatttagcatactatgtttgaagttaattgacgtgttagcacgtgctggtcatgtgttttccttcatagtctgctgtgtttattcatacaaatagtgtttattcatttatcagttaatggacatttaattgttttgttattttctttgatgagtaatgtagctttgagcattcacatacagtcatgtaatgcataatgacattttggtcaaaaaaaatttttttttttctgagacccaggctggagtgcagtggcacaatctcgggtcactggaacctccatctcccaggtttaagcaattctcatgcctcaacctcccgagtagctgggacaactggcacacaccaccacgcctggataatttttgtattttcagtagagacaggattttgctgtgttggtcaggctagtctcaaactcctagcctcaggtgatccacccacctctgcctcccaaagtgctgggattataggcatgagccaccacacccagcctaatttttttaagaaagaagggaactattttctaaattacttttgccaatttatattcctaccatgatgcatagcactaatttcaccgtacaatgtatggtaggccccaatatgtaagaaatgatgaaagtaacacataaagattagtataagacaaatgagattatcgttgttgctatcatctttgtcaaattctgaaaacaatctgagtatatttttatataaatatgcttggcaacatagctgaaaaaagcattatcagttacatttatcagtaacaaagacataaatttgaagggggaaaaacacttgtactaacaatgcaatgtcagaattaacataaaaattctgctggtcactttggaatatttaattgcctggggcagtgtttagtagacaaatgagcatctatggagcacccaaagtaggggaatcaacagaacttgggtttcaaaagttatctgggtttagagcgtgaaactttgttagaggacacacaccttgcatgagtgaggtgccttggtgtgtgtggacgtatcattatgcttggaggtacagcataatggtggcttcctccagaaagggacatttggggtagattcatgccatctagacaacacagcctgatgtggcatggacatgaatggaggtgaaatggtcagtagttgagaggatcagtcctgacaagggccgaggtgaaaaacctgggaacaccttcaggtgcaaagtcttcagttgaaaaaggaggtggtcacaggaaatactgagatgggtcagcaatgcatgggagacagagttcttggccctgcagggtgagtagtgtggattctcaagttttctcctctctccattaatttctttcccaatgcagatgacttccatcatacagtcttcagcaaccttgaaagattggacaagcttcagcccactcttgaaggtaaaggaaggcagctaacaagactggcatctgggcttggctgtgcatgttttctatcgtggggaaatatatgtaacacattatttatcatttgaaccttttaaccaaagtgtgcactccgtggcattcaatatattcacagggttgcataaccaacaccactatctacacccacaattttgatgatttcttacaaaaccttgtccacaataagcaatatagcaccttccccctatttccagcccatggtgattcctatccgactttctcttgtatgaatttgactattctaggcacttcatgtaattacaattatacaatatattccttttgtgtctggcttatttcactaagcataatgttctcaatgtccacccatgttgtatcatctatcaaaatgatgttcgttttttacagatggatgatgtagcattgcatgcagaccaccttgcttttattacattcatttgttcactgatggttggattatttccaccttttggctcctgtgaaaagtgatgctacaaacattagtatacaaacatctgtttgatttctgttctctattctttggggtgcctaagagtagagttcctgggtccaacaggggttctatatttaaccttctgagccactgcagactgtttttcacagtggctgcaactttatccatttctaccatcaatgtatcagggttacaatttctttacgtccttgttcacacttattttcctttaaatcatcctagtaggtgtatattggtggctgcttgtgtttttcatttgcatttccctaatgactaatgatcctgagcagcttttcctgtgctactatctgtggctgtatcttctttagggaaatatatgttgaagtcttttgcccatttttaaagagttgtctgatttttatttagttagtttgttgctgtagatttttgaatatatcttaaatatatttaaaaatattctaaattttagtctcttacaagataaatgatttgcaaatatttccccctttgtgtagaactttagattcacaaacttcattaatttgtatgaaatcctcagcagttgaccccaaacagataagactgaagcagtattttaggaatagttgaaagtatgatcaccacaaaacataagcgtaatcaaatcctgcaagctacatgtaaggcacaatgacaaataaggcagcaaagggccatctggtgattagttcaccacacttgttgcaactgtttgcactgcagagttaaaacataccagcattcaacccatgtctcctgtcttgaagtaaactgtcgtatgttggctggcctgaacaagcgtagatattctccatcctcaattaatatgcatgcatgacaaagaaaaggaggcctggatgaaaaaatactgtgtgattaataattatgctttaattaattttaaaggatataatttcagtacttctaattctcccatcagcagttataacaaaggattagtgaataaataccatagactgttttgcctagaattgaatccaacctgtctattaaactttgcttttattcaagtgcaaaatgctaaaacacataataactgcagtgacagccactgtggatcctcagaggtaaaagtagtcttgggacataaatcctgcaagtaatattgtttttacaggtttagaaaaccatttagctgggtttcaaacctcacagtgtgagcagtgggactctcatcaaactatagcatgtgcttcagtaccatttgtagactgactcattcccattgccttaagttgccatcagcaaaatgccagggactctatttcttgctccttagctcctcgttcttgcctgtctttccacgagggaggattttctagcaggagctcaagctgtgcttttaatgaaacacatccacacacactgtcctgttgtccacattaagcagagctccctgaataactcatgaacaaaagcatctatgactaactgttgctctgtgtcctcctagcctctgaggagtctctagttcacaaggacagaggagatggagagaggccagtcaacgtgagggtaaggttgccttgctttctctgaaatagaaatgttcctttcttgttgtctttctttttcaactgactttacatgtgaaaagatgacaatgtccatgacaggtattaaatgcagttttctgagggggaggaagaagtgactcttagcaactgatatgtaatacaaaatggcatttagctatgatggcttcaggttgtagactgtatccttggggtccttgtccttggaagcaatgtcttctccttggattcagtattttgcacttgccaacctacgtggacctgagagatccaccatccagaagctgatgtcttttccagtgtgtatcctacccttgttttggaggccttgaagttgactacactttctgatcaagttttcaatattcattgagagaaacacagccttgtgcaaacaatccacaacatgacatacccctcaaaaagctttgtttctgtattgcaggtggtgcaggtggcccctctgaggcatgaatctagtaagtattctggaatcacttaccaagaaaacaatctggatgccaagaaaggtgtggcatccttgcctggtttcaatgtgaagagccaccctgatcctgggattgtgataggaataagtataggggaagtgtttttttaaaacctgaattccccagggaaaaattatggccaaattttgaggaagcagctgtgctcccttttgggtggtgctgagttgggtgcttgaggattggtggtgtcttgtgtgaggctgcatcgtgtggtgtgaatgtgtgtgtttctgtacaggtgaggctgtgtgttttctcaggagagatttcccacttatacaacccaatcaccagtgtccacttctaacaataaaatccacccccgctctactctctctgtacagtgactcctccaccctcaccagagccatccccgggtctgccttattatccccactgctcaggtggagaacctgaagggccaagggagtggccccagctcccgagttcctgaatgaaaaagtgaaaacacgaacccaggagtgtgggccagtgctgacgctgacatgcacttagtcatggggtgttcaccaccacacagggagtccagcattcatgtataaaccctaaggcaccgagcccaaaaggccccaggcactgcccatcatcataaagtggtctccgtggtcacacaacccagggcagttataggttcatctccccacggacaggcatagtcatcagtgtgtcaaaagcacaaagatccccaggtgtttggctcagctcaccgatcctttttttttttttttttaacttttaagttcaggggtacatgtgcaggatgtgcaggtttgctacatatataaatgtgtgtcatgagagtttgttgtacagattattgcatcacccatatattgagcctaatatcagttatttttcctgatccaccccctcctcccacctcccaccctccagtaggccccacgctcacaaattctaagaggagtgggggaccacaaaggccagtgtggcccacttcagttgtgaagttaatttgctcagcaactggccaaagtctataaggatgggtgatgtattttagtagatttagtaatactatcttcccaagccctaaaatgctcaaatcctgccagccaaaaatggtgaggagggacagataggaactctgtgtggcacttggttattagcctggcttccatcccttagtggcaactctcttgtatatgtgggttaaagaccctcagcctcaagccaagcctcctccatgaggagccatctcactattgactggctagtgccgggtatggccaccagcccaactgaaacaaaatgttgctttaaaacaagtgtaaatctcatacatacaacaggcaaatgcagaagcagtgtggtctcgcaagttgtaaagaggacagtcgcaattttgctggacttcaacctgggtagaagacacgagggaactctgtcactaaatcacggcagagttcaaggccgcttgtagactatttcgtgttatagaaggtggcctttagctactaagcaaaggcctctgtttctcatttctttcctgttcatctccttggtcatccttcttccacaagggaaacgagcccaagcaaaaggcagtttcaatattaatttgaccgaggttttgtgcagttaattatcatccaggtaatcaggtgcaacccagtctgcctagcagcccccctatctctgctctgtgttttcatttaataaacattttggtctacttactatgtgctagattttctcgagaccaagtaaatgagatagaatccttatgttggcagctaagttagatttcacataactgacaaaaattaaaatttctgatttcttgtaaaaatattttgtatgtgtgaatgcatactgaatgtaaagtggataaaaaactcacacttgcactcatggaaggcttttcatgaatttgtcaatttttattttttatatttccccacttcactggataatgcatacctgaacctggaaactgatgcccactgcagaaagtgttctgagccacatcccttagcttcactagtgcaggtccacctgggaggatgtcccagcatcagcttggcccatgctgtgatcagccacctccatgcaccacaccaagcaagcccctgggtgattcacagtctccactaccagggcactgaccttaactctgtgttcttctagctccccatgaggacaccgtacacaacatcactaacgaggatgcctcacacgatatcactaacgaggacgctgtccacggcatcgctaacgaggccgccgacaagggcaacgccaacgaggacgccgcccagggcatcgccaacgaggacgccgcccacggaatcgccagcgaggacgccgcccagggcatcgccaacgaggtcgccgcccagggcatcgccaacgaggacgccgcccagggcatcgccaacgaggacgccgtccagggcatcgccaacgaggacgccgcccacggcatcgccaacgaggacgctgcccacggcattgctaacgaggatgccgtgcacggcatcgctaatgaggactccgtatacgacatcgctaatgaggatgccatatatgacatcgctaatgacaccgtacaaggcacgctaaagaggacgctgtacacgacatcgctaatgaggacaccatacaaggcattggtaatgaggacgttgtatatgacatcgctaacaaggacactctacaagccgtcgctaacaaggacactgtacacaacatcgctaatgacggcaccgtacaagacatcaccaatgagggcgctttatacgacattgctaatgataccgacaaggcacgctaacgcggacactgtacacgacatcgctaatgaggactccgtataccacatcgctaatgagggtgccgtatatgacatcgctaatgacaccgtacaaggcacgctaacgaggacgctgtacacgacatcgctaatgaggacaccatacaaggcatcggtaatgaggacgctgtatacgacatcgctaacgaggacaccatacaagccgtcgctaacaaggacactgtacacaacatcgctaatgacggcaccgtacaagacatcaccaatgagggcgctttatacgacattgctaatgataccgacaaggcacgctaacgtggacgctgtacacgacattgctaatgaggacaccgtataagacatcgctagtaactatcgcaagaacaaaaaaccaaacaccgcatattctcactcataggtgggaattgaacaatgagatcacatggacacaggaaggggaatatcacattctggggactgttgtggggtggggggaggggggagggatagcatcgggagatatacctaatgctagatgatgagttagtgggtgcagcgcaccagcgtggcacatgtatacatatgtaactaacctgcacaatgtgcacatgtaccctaaaacttaaagtatatataaaaaaaaaagacatcgctagtgagcacgctgtatacgacatcgctaatgaggacaccatacaaggcatcgctaacgatgacgctgtacacaacatcactaatgatgacaccgtataagacatcgctaattatgacgctgtatacgacatcgctaatgacaccgtacgaggcacgctaacaaggatgctgtacacaacatcgctaatgaggacagtgtacaagccatcgctaatgaggacactgtatatgacattgctaacgaggacactgtacaaggcattgctaacgaggacgctgtacacaacatcgctaatgaggacaccatataagacatcaccaatgaggatgctctatatgacatcgctaatgacacccacaaggcatgctaacgaggacgctgtagacgacattgcttataaggacaccgtacaagacatcgctaacgaggacgctgtatacgacatcgctaatgaggacgttgtatatgacatcgctaatgaggatgctttacaagacatagcgaatgaggttgctgtatatgacatcgctaatgaggacattgtatatgacatcgctaatgaggacgctctatacgacatcactaatgaggacgctgtatacaacatcgctaatgaggacgctgtatatggcatcgctaatgaggatgctgtatacgaattcgctaataaggacgctgtatatgacattgctaatgaggacactgtacaagacatctgtaaaaaagaagatgctgccaatgtaagacacttttctttgtcttgaacagaaatgttactttcctggcttctttccaatcagatgtagacatgaacatctgccagtgtgcattatcgatgtcatctgcagtttaatcaaatgtagacatgaacatctgccaatgtggactatttatgacatctgcaattcccttggtgtggtgctattgattggcggcctctcaccaacccatgccaggcacactggggtgtggtagatggcagcatccacgatccactgcaatgcagaggtgtttccctccacagcagttttcccccatggattaagagttgtgaaactgccaatctagatacactttaaagataaattctgtgggaaaaggtcttgtcttttccacaggtgtcttccgtgccagttttgggggactttgacctttgactcaatcactataccccttcttattttctctctcaagttgtcgagagactatcagatctgtgtgacgtgtatggcatcatttcaccctcctaatgttttcttttctataattgcaggagccattgacactggagaatgatacctaccctgaaataactcacttcctgaggaaaaaacgccatctctagggtacagaaacctgattctgggctccttttgggaaggaggatttggagtctggtgagagcaaatgattttgcaagtataaaacaatgtccagagaggctgtagggatatctgtgagcccagaggaaacaccaggggatcctgtgcgaagcaccatggcttcagctagggtgggaggagtgggtgggcctctctctaatgacttatcctggtgtttgtgtttctaaagatttgattgtggagagcatatctgatgatggggatttgtaggtaggtaactactttccacgtaagatccaattggagagagttcccaggggccttcggggtatccatgctgcttgggaggttaagggagggggcatgaaatcaaaaggaaacaggaaatatgtgtcatattggatttggtcttttccgggtttattggcataatagttagaactgtctctctgggctatgagggtgctgtgatatttaaaggtggtctttcccagaacacctggccttttcttttctgcctctgccaaacatcacagcctttgggttggattagtcagcaccccttgggattgtgcagaagaggtttggggttgcatcgagtgtcacctgtggtgaacagaatctgagggacacaactctctcacaggcacttccttcaacctggagacagagttctcctggtgtgtgcccaggggtggaggagaaattgacagtctgcctctgaactttcaggactttaaaaagcactcatgtttccatcctcactgttgactcctggcttaaagggatctcccggggtgagtgaggaggcgggatcggaccctggcagtctgacggcagcacctgtgttcctctgcactgggccgtggatgacattacacaccttggtgagaatcaggaattgaggctaaccacatctgaaattgagatgggccttgagtcatataaatagtttggaaaagatgcattttactacgctattgaaagaaaccatttatttctcactccagcaggataaatggttttcagtatccacttaactgctcattgactcttactgtagatgaggaggtggccagcagcccctgccctcccccagttgtaggcccaaggtaaccagcaattgactggatataatggaagagtggtgcattcggaggtatctgtattaatgggacccacatgatatggatgagagctattagggtgagaaaaagcctgggagcacaatgaaatatttaaatattaaacaaaacattgttgaaatctccattgtactttagtagttgaagtcattcttgtggtcatcactgcctttcccaagcataacaagctacttaatatcacatggacccgtgccatgaggaatgatgatcagtttgtcaaatgccaataaaacaattgcctctataagccacaatgtttcatccatatatttcaatttccatgtgtaagtatagttcaaatttcagaaatttattattatctaatagaatatgcatggtatatcaatgagcaattatcatactgtttctattaacaattatttgtatgatgaaaaaagcagactcccattcttggatttttctcagtttgcacacattagcatgacagccccatttccacctgacatgtgccagcaagaggccaggaacagaggcttttcttattaactaagatttctaaatgtattacgtattcacatttagaaactctaaatatcataaaaggttagcaaggaagtttcccttccactctgaacttccaaacaccaagtcaacgtttttgtttgcatatcatccctgcaatctatgtgcaaatagaagcatgcacctggaatgcaggctgatgtgtgatcgtgtttacacaaagtcctctgcacctctgcatatatcactgggcaatgcaccttagttatcattccacatttcaaatgtaaatccattgtattgtttcagagctataaagtactgcaccccatgactattcccaaaattacttaagcaccccgctatgggtatccgtttgttctgtttccagtcttgctcttataaccaatgctgtagtgaacagcactgtgttgagaagcggtgaacgtgggcatctttgtcttgttcccttcctcagggggaatgctttcaactctcccccattcaggaaaatgttggctgtgggtttgtcatagatagcttttattaccttaaggtatgtccgttctatgctgattttgacgaacggttttaatcataaagaaatgctggattttgtcaaaggctttttctgcatctattcagattatcatgtgatttttgtttttagttttattgatgtgatgtatcacatttattgacttgcgtatgttaaaccatccctgcatccctagtatgaaacccacttgaatcatggtggattatctttttgatatgctgttggattcagttagcttggttgtagcatttcttattattccatctgtggaatgtattggttgaaataatgaaaacatgttctatcctcactgcttagcactttgtgtttctttaatagccttcccaacagggcaacataaaagcaggagccctgctagtctccccttaacccggaatccccccttctccacagctcgctcattggacaggatagactgggcgcccaggcttcaaggtaaggacgtgctctgtcacctagaggtgcagtgcttgggaaggccaaccttggagggttgcctgccagctttacagtgacagaggtgttgagagggactgaccaccagtgcataaggctgtgctttgttggtgacataaaggattgtttcacagattgttggggagggacaatcccaaggcctcccctggccctggtgctggctctgcacaaaggcaataagagagggatgctggtaagggctgacctgttgctgtgctggggaggaaggtgctgggctgaaattcaggaggctgaggatgcagcagtcccataggaggtacatgaccttcaggatacattttcttcattgatgatcaatggaaatgagaaatcactgactattttttctatcattggaatctactctccactgctcatgctgttcctgtcttttggggaagatggaggatcaatcagtgtgcgctgcactgagtggaaggaaggagaactgtgacaaaaattaaggaaggatgagagacgggagggcccttcatccagctgcttgcagagtcctcctgaggaggaaagccccgtggctccctggcgaaggagcagtgagggctgcgtgactcccacagtgaagtgtgtggtatgtctgaggacacccaggctggtggtccatgaggagccagtggcagagtgagaagaagaaaggccaggagggtggctggaggccaggctctgagtcattctccatgtgatggaaacagccggagcccagtgggcttggaggtacaggatgcggtggctgatgacagaacaatgtggagagaggcgtcatttgtcaaatccttactttgttctgggcattgtactaaaaattctaatggctcatcccatttaggggctgaaagttgcagaggtttaggaagctcacccacgatactggagcccccatctcttgccctagtgctgtccaccttctcacccagccaccacctgtttcgggggaacacacagaagtggtaacctcttatggagaggcaagtaaattctgctgtttttgttattcacagaaaaacactggctcgtgtgggttgggaaggtgaaataccagaagtatttcatctggttatttctacccatgcaactcctatagtattgaaatgcataggttagcatttttggccaatttactcagcattctgggttaaaggcttttatttattttatttatttatttatttatttttgagatggagtttcactcttgttgcccaagctggagtgcaatggtgcgatcctggttcattgcaacctccgcctcccaggttcaaactattctcctgtctcagcctcccaagtagctgagattataggcacatgccaccacactgggctaatttttttgtatttttagtagaaatgagatttcaccatgttggtcaggctggtttcgaactcctgacctcaggtgatctgccctcctcggcctcttaaagtgctgggattacaggcgtgagccaccacgcctgccctaaagtcttttaaaattcacttgtataagttgacttagttttctttaaccttgtagaaaaatacaaaaatggcaatctcttttatcacacaaataatgtctttttaatggagtgatttttttctaattgaggtattatgtacttttcatttacaaattattgtttacatttgaagtgttttatgaattaatatttaattgcatagatgaagattactagttataggcattttactaaccaatactcattaagcatagcatggattcatatgacatcaaggagctattttatttggtaaaacgaaaaagcacaagaatgaacgaatgcaagaactgaaacagtggagacacctagaatgacttgtctaagatctaaatcattttgttgtcttcccagcatacttattatcctgatcattgtcatcagcattgtttgggtccttttagcacagatttctcaaaatgggtaactccataacagttggaagcttacgaattcatataatttgtaagaggtcaatttggaagtacctatctattttaaaattccaataacctgggaatttcatcccatgtctagagtcttttatgtaaaatatttccacaattaggagaaatatgtgcatggggattttctatgtagcggtgttttgatagaatagaaaattgggataaatcaaatttccatcacgaaggaaatagtaatatgctgaataataatacagcgaatattatgcaggctttaaacatcaaaaaagagttcaacttctgacttccgatgatggtgttgaagcaggtcactgctggtttacatttgattttcatgtgggaactctggaagtccgccttagtgattttacatgtggctaaattgagctaatgacaagccgttcgaagtatggcaaaatggaactttaaaacagtatcttgtcaacaaccaagaggacctgtttcacataaagcccatgcattcatctgcctgtccatcattctgtctgtccacacgggcatcattcgttagtggaactgagtgcccactgtcgagctgacaagcccataacctccctgttcctagtcacacattaattcttcaacaagtcccttttgatagattgtgattaagcttagctactatttccaattgcttccccaaacgtacttctcactgttctcccatcacacccttcagcccatccatgcggggttcctttgcttttcccaccttacaccaaactccctatttttactcccacttttacctcctctccaagacaaaacaaacaaaactagcattttaaaacttagttgtaatctttcttccttcatgaaaatttctccaacagccactcccacggtcctgtgtgttccagatattttaaaataatggctataaggctgagcacttcaggatatgctgttttgctgtgtgcagatggaggcagtggctggagtgaatgaacggcaacacttgctggcaaccggcagaagctgagagacagggaacaggctctcctccagagcctccaggagccaggcctttggacaccttgaatgtgggcttctgggagaccatgcgtttctgttataagcagcccagtctctggcagtttttacggctgccccggaacactcatctatacctgtctgacaaggtcaagctccaaggaagggattctctacatatctacattgtttgcagattttacaataatcatttattcttgcatggctgatcattgttaaccaatacaaataaaataataaagaaatgacccacattttatgttgggagtttgatctgccatttatcaagtatggaatcttgaacaaggggttaaacatctgaatgtctccatcacttcatctctaaagtgggggtgctcacacccactgggctcccccacccaggttggtgccggactctccctgggcccccctgttctctcaccagccacatccattctccccccagaggcgctagtgactgtgcgtggctttccattcccaccatgtttgtctctaaccccagtggcagatcagtgtaagaacacagctgagtgctcctcgcctccttgccccttcaagggctcctcaccacccaccagatcaggtgcaaacttccaagccttactggatccccttccacattctgagctccgcctgccttcccatcgctatccttccccacctgcctccctggtagagaaaagcagagtgtgtgatgctgtctgaatgctgagcacggccttttgcagccagtccactgtgtatgctgcccctatcggagacctccaccttaaccctttccagcctggaggctcctcccagggccccacaacagaagtgacttcccttgcctttgaatttctatagcacaagccctactgccccccgttaaaactgcaaagtccttttgtggaaaataactttattcatgactgtgtttatcacactatcttatggagaagagatgatcaataaatatttgttgaataaatgaatagcagttacaaaacacttgattcatatggaattaatgttggttctcaaagtgaaaaattacaaacagcactgatattcagccagtatacaagtctggtcacagcagttgtataatactgaaataccccctgccactgacctttggcccccagatgcctcccactgccactgctctccccactgggaacccctgaagttcccacaggctcataactaaagggctaatgtctcgcacagcagcgagcacccaggaccgagcagccacatggccgggtctgctggtgaaagcatccattctgactgatcaggacctgaggggcctcatggttacatattttgataatatccctaattataaataaggctcagttatatagtttgaaaacaatgcttctcctcatcgcaaaatctcttagaagactccgtagatccaggaacggaaatggaaaatgacagcgtgtcaatctctgaaggttttgggcatttccattagcactccatcttcatgtaaaccagaagatatgcagtttcctgcctagagagaagagaagacacatcagcacagcggcatgaaagcttcatcagaaaacaatgcttcattaatccgtgacaggacaagcgtcagcaaacttccaggcggctggattaggccttcatctatccatcaccttggagaggaacaaaataggtggcctgggaagataagcactatgtttctattccttaatatctaaagcggaggttaacaagctatggacacacaagccaaacccagccctcttggggttttttaaatctactttcaacttttattttagattcagcgggcacatgtgcaggtttgtcacgtggatatgagcatactccccaacagttggcctttcacccctcccctccctccccatccagcagttcccagttgttgccatctttaagtcaatgagtccccatgtttagctcccatttataagagagaacatgcattatgttttgtttggtttttgctggtttttttttttttttttaatggagtcttgccctgtagcccaggctagagtgcagtggcacaatcttggctcactgcaacctccgcctcccaggttcaaacgattctccctcctcagcctcccgagtggctgggactacaggcgcccgccaccacgcccggctaactttttgtatttttagtagagacagggtttcaccgtgttagccaggatggtctcaatctcctgacctcatgatctgcccacctcagtctcccaaagtgcagggattacaggcgtgagccaccgtgcccagccttttgtttattttttgacgagacggttcttgctctgtcaccaggctggagtgcactggcacaataatagctcaccacagcctcgtgctcctgggctcaactgaccctcctgcctcagttttagcttcctgagtagctaggactacaggtgtgtaccaccatgcctagctataataatttttatttttttgtagagatggagtcttgctttgttgcccaggctggtcttgaagtcctggcttgaagtgatcctcctgcctcggcctcccaaattgccgggattaaaggtgggagatcgcacccagtctccaaccctctttttgcaagtaaatgtaactggaccccagccatgctcatctgcccatgtactgtctacggctgcttttgctctacagggcagagttaagtggttgcaacagacaccgcacagaccacaaagtctgaagtactttctctccagccctttacagagaaagtctgccaacctctaatctcaataacagggaaatcaatgacaaccacaaagtgacaaagactgggtgtctaagatggatgctcagaataaacaagagagaaagatgaaaagtagaaggaggatttcaaacgcaagcttcacctaatccgttatttttcaaatgaccaggcctatctctgtagctgaaaatcacctcaaataagatctctgatatacagtctccaaaagctcagccaagaaacttacaaagtctctctgccttaacttcatccaccttttttctctccagcttctcctcggtagttaatgattataaaaatatttattggctcatgcctgtaatcccagcactttgagaggccgaggcgggcagatcacgaggtcaggagatcgagaccatcctggctaacacggtgaaatcccgtctctactaaaaatacaaaaaattagccaggcgtggtggcgggcgcctgtaatcccagctactcaggaggctgaggcaggagaatggcatgtacccacaaggcggagcttgcaacgaggtgagatcccactactgcactccagcctgggcgacagagcaagactccatctcaaaacaaacaaacaaacaaacaaaaaaacagtgtgatggccaggcgcagtgctcatgcctataatccaagcactttgggaggctgaaatggatggatggcttgagcccagtagtttgagacaagcctggcaacatagcgagacctcatctctacaaacatctttaaaatatgccaggcatggtggtgcatgcctgtagtcccagctattcaggaagctgaggtgggaggatcacctgtgcccgggagttcaaggctgcagtgagctatgatcacaccacagtgctccagcctgggcaacaaagcaagactccatctctaaaaataaaataaaattaaaaaaaaaagatcttcgctgtaaaagaggtacactcaaatgcaataaaagcatataagaaggccgggtgtggtggctcatgcctgtaatcccagcactttgggaggccgagacgggcggatcacgaggtcaggagattgagactatcctggctaacgcggtgaaaccccatctcctctaaaagtacaaaaaaattagctgggctaggtggcaggcgcctgtagtcccagctactcaggaggctgaggcaggagaatggcataaacccgggaggcagagcttgcagtgagcctagatagcaccactgccctccagcctgggtgacagagcgagactccgtctcaaaaaaaaaaaaaaaaaagaaaaagaaaagaaaagttcttgtgacatttgtgtatgaaatcagccttcactacatggataggaccagcacgcttctgcggcacgactctgcaatcttactacatttttttttactttgtattttatttattccttttgagacagagtctcactctgtcacccaggctgaagtgcagccgagatctcggctcactgcaacctccacctcttgggttcaagcaattctcttgtctcagcctcccaagtagctgggactacaggcacacgtcaaaacgcccggctaatttttgtatttttagtagagatggagttttgccatattggtcaagctggtctcgaactcctgacgtcaggtgatcgacctgtcttagcctcccaaagtgctaggattacaggtgtacatttatttatttatttgagatggaatcttgctctgtatttattaatttatttatttgagatggagtcttgctccatcgcccaggctagagtgcagcggtgcaatctcggctcattgcaacctctgccttccaggttcaagcgattctcctgcctcagtgtcccaagtagctgggattacaggtgcctgccaccacagctggctaatttttgtatttttagtagagacagtgtttcaccatcttggccaggctggtctcgggctcctgacctcatgaaccacctgcctcagcctcccaaagtgttgggattacaggcctaaggcaccatgctcggccatatttatttatttaattatttagagacaaagtcttgctctgtcacccaggctggagtgcagtggcgccatctcagctcactgcagcctccgcctccgaggtttaagcaattctcatgcctcagcctcctgagtaactgggactacagatacttgccaccacgcagggatttttttttctattttttttgtagagacacagtttcaccatgttggccaggctggtctcgaactcctgaccttaggtgatctgacagcctcgtcctctcaaagcactgggattacaggcatgagccccttgcccggcctctcactacatttaagtgacgccatggctcatgcctgtaatcctagcactttgggaggccaaggcaggtggatcacctgaggtcaggagttcgacatgagcctggccaacatggggaaaccccgtctctagtaaaaatacaaaaattagtcaggtgtggtggtacaagcctgtaggcccagctacttggaagactgaggcaggagaatcactttaagcgggaggcagaggttgcagtgagccaatatcatgccactgcactccagcttgggtgacagagtgagatactgtctcaaaaaaaaagaaaaaaagagagaaaaacatatgatgccagggcatctcggcctcaatacctgggtgagcacagtcatgtccaggccagggctgctggtcgaggtccggccccatctcttccagcagaaagggagtaagcttgcagggaggctgggggacaagatcccaggatctcagcctctgctcatggatcagctctgagaccccgagtgagctgggggtgctctgtgcgcattggtttccccagctgtcaagtaaagagattggatgaggaagtcttgtcaaggtggaatgatctcagatttggggcagcagtgaatgatcccgctccctgggccatgccagtggcccggcctcggctgaacacagccccaacactctggaatggggatgagggggcagtcagctcttgctcctagtaagagagatgcaacagggctctgtggctgagctgggtgccttgcctcacacctgtaatcccaacctttgagaggccgaggcaggaggattgctcgaggccgggaattttgagaatagcctggacaacatagccagaccccatgtctacaaaataataataaaacacacagctatagtccaagctacttggcaggctgaggcaggagggtcccttgagtccaggaattggaggctgcattgagctataatcgcaccactgcactccagcttgggtgacaaagtgagaccctgtctctaaaagaaaaaaaaattggcctgtgagcatgggcttgattttcaaacaggacccggagggtagggtaaacgtgtgggtaaatctaaatgaatgttattggtataaaattacagtagtatagaaaatgatatcttgtggggtttaaaataaataaaacatactgaaatatgtatgggtacagttatatatctgggatttgcactgaaataatgtggggtagagggaagcaggaaagagtatacatgaaatgagcttggccataagattgttgttgaaattgaatggatactctgggcttcattacacaattctctttactcttacatagctctacactctcaacataaataagaataaaaacacaaaaaacacacagatacatctatgcacacacacatatttaaaatacacaaaaatattagcatataagtcactgggggtaaatttagttcctgttccaaggttcttgtactgactaggaagaggatagaagtactaactcataggctgggcgcggtggctcacgcctgtaatcccaacactttaggatgccgaggtaggcagatctcttaaggtccggagttcaagaccagcctggccaacatggtgaaaccctgtctctactgaaaaagaatacaaaaattggccgggcatagtggtgcacacctgtggtcccagctactcaggtgactgaggcaggagaattgcttgaacccaagaagtggaggttgcagtgaaccaagattgctccactgcactccagcctgggcagcagaggaagactctctctatctcaaccacaacaaaaagtactagctcatgttagactttgataagggaaggatgcatgttgtaagctctaaaataatccagtcatcttttaaaataactctaagactgcacagttatgaaactaatagagaaggaggaaattaaataataaaactaataaatccaaaacaagatgtgagaggagataagaagaaatagaataggcatggaaaacaaattggtggtgggtttcaacccaaataaatcattagttacatttaaaaggacaataaaaattaaaataattgaaaataaagtaaaacccaactaatgccttttatataagggtacagagaggtggaagatcatgaaaaatatgtcatgcatgtactaaccaagaaagctgtataactttttttttttttttttttttttttttggagatagagcctcactctgtctcccaggctggagtgcagtgatgtgatcttggcttacagcaatctctcccttctaggctcaagcgattctcccacctcagcatcccaagtagctgggactacaagtgtgccaacttagaattatattagccacacccagctaatttttgtattttttgtagaggcagggtctcgccatgttgcccaggttggtcttgaactcctgggcttcagtgatccacccacctcgacctccagcaaagtgccaagattacagccatgagccaccatgcccagcataactatttttaatgaagtagactttaagaagaaaagtattattagaggtaagggacacatcacagaaaagaagaatttactaggagccaggcgcaatggctcgtgcctgtaattccagcactttgtgaggccaaggcggcggatcacctgaggttgggagttcaagaccagcctgaccaacatggagaagccctgtctctactaaaaatacaaaaattagccaagcatggtggcacatgcctgtaatcccagctactcaggaggctgagggaggagaattgcttggacccaggaagtggaggttgcggtgagctgagattgtgccattgcattccagcctgggcaacaagagcaaaactctgtctcaaaaaaaaaaaagaagttactagctagtttcggtaattcttaacatccaggaaactggatgtgaaagtttttcagagaaactaaaccaatagattatacatagagagagacttatttaggaattggctcacatgattgtggggactagcaagttttaaaatctgtagggcaagccagcaggctataaattcaggtaagagttgatctcgaagtctggaacctaaaatctgtagagcagtcagcaggccagaaactcaggcagggtttgtgtgttacagtcttgaagcagaattcctgcttctctgggaaacctcagtttttgttcttaaggccttcaactgattggaggtggcccacccatattatggtgggtaatctgttttacttaaagtcaattgactgtcagtgttaatcacatctatgaaataacctcccagcaagatattgacaagtatttgaccaaacaacaggacaccatagcttagccaagttgacacataaattaaccatcaggagcaagtagaatatccaaaaaacaacatactaggggtattatatcttatatagctattataattatataaaacatataattatagaatgacgatattaagataaccattagaacaaaaatataaacttttctttctttttttttttttttttttgagaccaagtcttgctctgtcacccaggctggagtgcagtggtgcaatcttggcttactgcaacctttgcctcctgcgttcaagtgattctcctgtctcagcctcccaagtatctgggattacaggcacctgctaccatgcccagctaatttttgtatttttagtagagacatggtttcaccatgttgcccaggctggtctccaactcctgacctcaagtgagccaccccccttggcctcccaaagtgctgggattacaggtgtgagccaccacacccagccaaaaatcaccttttttacaaggatcaaaacagtcattatgctggagatgacagacctcactgtcaccatgctccttttgtatgtctactaggcacggtgctgggtccacactcacagaaaccttaggaactcgcacccaggggctccggctgtagcagaatcccaagaataaaacctggtgctgaaagagtaggagatgaggccgggtgccatgactcactcctgtaatgccagcactttgggtggccaaggcgggtgaatcaagagatagagaccatcctggccaacacggtgaaaccccgtctctactaaaaatacagaaattagcggggcgtggtggctggcacctgtagtcccagctactcaggaggctgaggcaggagaatcatttgaaccgaggaagcagaggttgcagtaagctgagatcgcgccactgcactccagcctggtgacagagtgagacaccgtcccaaaaaaaaaaaaaaaaaaaaaaagcaggacactgaactctgggagggcctcctggtgagaggtgagcacagaggggagagatggaggcaggagcatgggcttctggtggccccagcagaccctgtggcagcgtggccagggtcctctgcagggaggaatcttggccaggatgacgctgtagcaggcctcttcctgaggcctccagccagcccggccagggtcccagcgtccagtgacccctgtttcacagcagcagctggggccagccccaggctctcttccactcccagcttcttaaaactggaagtggagagagttgtttgataaaacactggggcaaaccacatcctctcttcaccaagggagagttcgaggggatgccggcagagggagctttagagtagagacccctacccaaccagtgaccgtcacgcacacagcagggcatgctatggagacccccagacagtcactcggggagacccagcaggtccagactcttcagagatctgtggcagcaggtccccactcccaaaagccacgtgcccacgggtggtctctggtgcctgagaccccagtctcatttgcatctttgcaacttcgagtttaagtgggtgtcgcatctctgtatgtcctcccgagcagaggaggggcacagcctggggtggcagctggcgtcaaaccctcaaatcccctgagagccactggggagactaagcagtccccagcccccacttgtccctgagctgccattctcagccctgtgggaggagacagaaagccctgaagagaaaccaaaggaccaggtcaggaggggctgggggggtggcatgagcaatcagggcagggaaggatggaccgatgggggaatggagggaagaaggaatgaatgaaaaggtgaatgaatgaacaaagagagagaacggccactcctcccttgctttagtttacaaagtactgggatcctcccaacagcctgcaagacagaatttctgggaagcagaccaggtggctggcagggaggggaggcttgccctggcttttgtgggcccaatgggaggcagggggcaagaaggggcatcctgtgtgtgtcctccctgcagtggcagcagcaccttcctggaagagggtcaggaaacacccgctgtggcccctctccaccacgccctcatccaggacaccaagtatcagtcactcagctcacgagacccaggccctgactcagggagagaggatgtgaggggtggggcaccgggctcctcaggactgagagacctgggatgtggccccgggctgggtgtaggggcagactggctatggcagcattgtgtgtaccccagcaggccagtacccacgcagggagcctccaaaccccttcacccatgaccctgggagaagaccgcagccttggagaattggcctcactgaaggggcctgcaccggccagcagggtcaggcggggccagacaggttcccacctgggatatgcaaatgggcctcctgaatcctggagccaggtatggactcacacaccaccattgtccccaagtccccatctgccccacgggcacaccctgccgcctgttctgtgcaagggccctgaggctgtctccttgcgcccaagacctgcaggtgctgaagcccacacacacggctcctgcttcctgggccagtgcacgtgcacacacacacacgtgcacacacacacacacacccacaaatatacccacacacaatcacacacattcacacatacccaccccccatactcacacacacatttacacacacccacacacccacactcacacactcacagtcacacacaccctcacacagcgaaacacaatcacacacattcacacccacccacaccccacacactcacactcacatatactcacacacacccacacacacatacacaaacacaatcacacacattcacacacacccacactcacacatacacacacccaaacacgatcacacacattcacacacacccacaccccacaaacacactcacacatatacccacacacactgacacataatctctcacacacacacatgctcacacacacacgccttctccaggaggggctggctgccaaaggccacccagcttcctcccacgtctcactcaccgtacaatatttgagaagaccttggagtcagcagcaacagcggcgtgggcaaaggccgggggtcaaatggggcctggtgtcgagagaggaccacagccagcacaatgacagccagcgccagccccagccccagccccagcaggaccaggtcacccatggctccgtagtcctgggccatggctctgcggcccagaaggagaggggaggccggtgggcagatggagggacagatgggtgggcagatgaatggacaagaagatgcatagatagactcacaggtaattggacagatggacaaacaggtgggggctgaagacagacacgaagatggatcgacagacaggccagatagctagacaaagaggacagtaagagaaagatggtcagatagacaatgggacagagatgggcttacagatgggcggacagacagacaggtctgaacagcgggctgccagatggacagatgggtgaatggacagatggctggcagctgtggcgagctgctgccctcaccaagtgcacactacggagtggccaaactcatgcctcaacttctagttttcagctcctgcttgttcctggcaggaggccaggcagcaaagcgtctgaggggagttttctttgcctagagaagtcagctgctgtgttaactccctcactgctggtaggtccaaaggccccacctaccgcccgccagagcccatggtcacactgtcgcaatgtgcaggagaacttggtgcgtgctgcactgcggttgccaggtaggggcagggctccctggaacctccacaccattccccaggttctcagcagctctgggaaagcagagctggggccgcttaactctgccctggatccggcaaggctgcccccctcccagagtggagccctgctccccagctcccatctctatcccctaaccctctccgcatggcccagcctagtcagcatcaaggtggagctgaacagaggcagaaggaggaggacccaaggtggtgtcactcaggacccgggttcaagtccttatgcttctgcagcctggcctgggtcccccaactcccccagggtgaccaagggctttccagtctgcacagaggacagggggtcttgacagcatcaaattctggtgactacgagacacttacgtgggaaatgcagacagaccatgcctctagcccttggcaccaggcaccatccatccctgggacttgctgtcctggaaatgcagcatggtcctccagggaggggggctgtgccatgtgggggccccaccccacctgcagctctttcccaccctggctgcaggtctgcttccctgaatccaaatccgctactactgtgctggcagcgcagcctctctggggacactggcctggctctgttctccccaggcctcagggtgcctaaatgggaggcaaccaggggagtgaggacccactgaggggctccgttgaccaggctcagcaggggtgcaggtgatgtggggtggaatccttcccacatggcccccacagtcctccccgcttcctccccaactgaacactgcctgctccagatgtgtacacctggagtctgggcccctccatctgggcagcagagaaactgaggcacagagacagactgtgtccttacagggcacacagcctgccaggcccctatgtccggccagagcccctggtcagcctgggctgcagtgattgtttagaggtaggctgttcccacggctgcctctcacggtaggggggcctgtggacgcctcctcccgcccccacccgactcccaagcctcagtgacattgctcaaccaggagctgaagtgcattcctgggctccggccagcccacccacccacccgctgcagtcctggaagcccagaggcctgggcagcaggaacagtggagacagcagtgtgggggacgtccccctcctctccccaccatcctcgtcaggcagaggccagggtgcagggaccaccggagcaaaggcccagggaaatgaatgggtgtcattctggtcctgacccgaggcacagccaggaaggtccctgtggggaaaagaaagagatatcagactgttactgtgtctatgtagaaagaagtagacgtaagaggctccattttgctgtgtagtaagaaaaattcttttgccttgagatgccgttaatctgtaaccctagccccaaccctgtgctcacagaaacatgtactgtgtcgactcaaggtttaatggattcagggctgtgcaggatgtgctttgttaaacaaatgcttgaaggcagcatgcttgttaagagtcatcaccactccctaatctcaagtaagcagggacacaaaacactgcagaaggccgcagggacctctgcctaggaaagccaggtattgtccaaggtttctccccaggtgacagtctgaaatatggcctcgtgggaagggaaagacctgaccgtcccccagcccgacacctgtaaagggtctgtgctgaggaggattagtaaaagaggaaggcctctttgcagttgagataagaggaaggcatctctctcctgatcgtccctgggcaaaggaatgtctcagtgttgattgtatattccatctgctgagataggagaaaactgccttagggctggaggtgggacatgctggtggcaatactgctctttaatgcattgagatgtttatgtatatgcacatcaaagcacagcacctttttcttaaccttgtttatgacacagagacatttgttcacgtgttttcctgctgaccctctccccactattaccctattgtcctgccacatccccctctctgagatggtagagataatgatcaataaatactagggaactcagagactggtgccagcgtggggcctccatatgctgagtgcaggtcccctgggcccacttttctttctctatactttgtctctgtgtctctttcttttctcagtctcttgtcccagctgatgagaaacacccacaggtgtggaggggcaggccaccccttcaggtccctgaatgtccttcctcaggaaatgatgggggaaggggcgatgagaatgaaggagacgatttaagtccctcaccccccgaggtagtcctgggctgagccccatgggacctagagaaccagggtgtaccccaccagcatgtcgggtccaggaagcctcgtggccagctcccacttctcttcctgctgtgcaacccagagcaaggcctgcccctccagcttcagtcttctcccctgcaaatggggccacggcctttcctctcaggccaatataaggattgaggccgggtgcagtggctacccctgtaatcctagcactttgggagactgagatggggggactgcttgaagtcaggagttaagaccagcctggtcaacatagtgagaccccatctctattggtttaaattttttttaaaaaaattaaataaataaaataaggattgaagagtgacttgtacaccagttgagcccacctccatctcacccttgcagagccccagagacacagccctccagagctcagacccagtgggacttgactccacaggcataaaaccctgtttgtctatgggccctttggaatcaccaggttttcggggctcctgaaggatagccccgacctggcctcacctggcccctggccccagtgcccctggtgatatccaggtgctgggctgtgatcaccgcctcccaccagcccacctccaccagcccttcccagaaccctgctccaggtgttggaactgtgcacagaggagggagcaggccccgagggaggcctggaggggctgccaatggtgaaggctgctgtgtcgagctgtttccttccggacccactccctctgggctgcgtccccggctggtccaagccctgatccctgggatctggggacatcttcccgtttgctgttccctgagaaccaggcctccctgtggagaggatcacaagcttgggtttcactctgggcttgctcttgggaaccccccaggggcatggctctgaccgagatgttttcctccagcctgttgcccagtccccattcctcggaccctcagcttcacctccagtgtcatcggcagggtgagctggacgcctacgggtctgagaaggcgcccgggttcccagcatcggctggccaccctctgcctaagaaagcgccagggtcgtgacaccccctggtggctgatcctaggtagtgtcactgcccagccccagtaagggagggcctggccccaaagtctgagggatcagggtgggaaggggcagggtttggtgtgaaccttcccctggcccccagccatgtgccttgctctccccatgctgaagatgctgaggctagttccagtgcccgcattgtgaagatctccgaatcccacctctctgttcctccccagccagatggctccatttcacacacaatacactgaggcccagagagtggggagacaggccagggaggccacctggagcctggcacagtggcctcatttattatgctgctctgctgctcacaggggaagcccgtcccccaaagtcctcttcctcatcctggtgagtatcttgtccctggattgcttgtcagccttgtctgcctggagcaatcagtagccagcaggttccccgcctttcctggagtccgaggcagctgcccagccaccagccgtgcggacgatggcttgcaccacagcgatgaaggtggatgcgatctgggtgtgatggtgccgggtctccagggctgcagtcactgcctgggggtgggaggagaggggaagcctgagcagggctccagatgccacctgaaccacacctgtgtggtcacaggcctcagcccaggtggtgccatttcaggccaggtcatcaggaagagcaggttggggcctgctgggtctcactggagcagggggcttggctctcatgtcacaggggctccagatggcccaggcactagagagaggacaccaaccattgtccactctgtgatgatccaggcctccagcccaggatgccctgggaccccacaccgtgactcagtttctccaacccctggcccacctggtcaatgtttctctccactgtcgtgacgttgggcagaagcttgttgtgcagccggggctcctccacggccctcttcacgtcatagccgaaccagaggttgtagatgatggcctggggcatgggagtgtgatcagcgtggcttgggggctgtgcagagtgggcagggccagggagaaaaggggtgacacataccagtgcagtgtctgtggtgatctgcgtgcccccagcagctcccaccaccatccggacctggccgtcctggcccaccatgatcgtcgggcacatggacaagagcggctgcttccctgcggccgatgggagaagacagggatgcccgtcagctgcctgcccaggacacccgcccctctccaccccagtcccccaccccccagacctccaccccatacctggctggatgaaattggcaggtgaggggggtgccccaaactcattggtgaatgctgggagagctgaagtcgtccattcattattgaacaggatcccactgaccggggagcagaccttggagccaaagctaccgcccagccaggtcagacagcacccgaccttgcctggcccagcctggtccctatccacccactgaggctcaaacatactcactgagaggcccaggataagctaccaaggttgggcctcagtttcccaccaggaaaagaggtgatggagccaccttactggataagtgggcagtccctgggccacccgcccctggccctttcccacccaggcggcccagcagcccctactagaggttgatggtgctggtggcggacacagcactgccgtcctctgcgacgacagacaggtgagcagtgcccccgtcatccggcgtgtagaactcgggcttgtagtaggagatcgggtgagtggtgtggtcagagatctgggaccggagctgggcagcgaagaactcagaggtcatgttgcggaccacctgctgagaccccagagctggcctgaggaggtggggagggagggtggggagggggcacaggtctcagaaggcccttgactgtgactctgaccgcaaccctctggcacccacaaccttccgtggctccccaggacccaagggcaggcccaagaccttgcatgaccagtctgactccctgtctctgtcgcgttccagcaactctgaatgtctgtctgcctggtcctcagcctccagacccttgccgcattcaatcactcattctttcatgcaaaaaatatttctacaatttgcactgcatgcctggcactggggaatcaacagggaacagacacttaggtcctgccctcatgccaagaaaaacaaacacacacagggaaagtgctgaaaccacaggccaggtaaggggaatcaagaggcatgaggtatgggcagagtggtcagggagggcttctcagaggaggcaacgtgtgaaaagagcctggaaagtggcctaaatggtcagtgcaaaggccctgaggcaggtggcataggctggtgagcgataggcagagagtgaatggagtagggtggggagaagaggatgaagatgcaggctggggcccatcccacaagacctcctaggtcccataacaactggcttttgctctgtgccatgcaggcttaggacagaggaatgagcaggctggggagtgttttcacagggtccctctggcagctatgacggggataaggataaagcccaaaggggaggctgtgggtatcaaccaggcaagagatgatggcctgggtgggagaaagagaagaagcctgtgcgttctgtccatgtgatgaggtgggctcctctcaatcttcacacagcacagctgagcctcaaacccagcactcaccctgacctctcacctccccacaaggtaggaaaacctgttgcccaggctggagtgcagtggcacgatcccggctcactacaacctctgcctcctgggttcaagcgattctcctgcctcggcctcccaagtagctgggactataggcgcccaccaccacgcctggctaatttttgtatttttaatagagacagggtttcactgtgttggccaggctggtcttgaactcctgacctcgggatccacccacctcggcctcccaaagtgctgggattacaggagtgagccaccgcatccagcccctatttctttttaagacacggtcatgattcattgcccaggctggagtgcagtggcacgatcacggctcacttcagcctcacactcctgggctcaagcaatcttcctgcctcaacctcttgagtagctgggactataggaatgccgcaccacacctggctaatttaaattttttttttttttttttgtagaggtctcactatattgcctaggctggtcttgaactcttgggttcaagcagtcctcccacctcagactcccaaagtgttgggattacagttgtgagcaaccatgcccaaccagattttatttttatttttatttttgagacagggtctcactgtatcacccaggctagagtacagtggtatgttcacggctcactgcagccttggcttcctgggctaagtaatcctcccactttagcctccctagtagctgggaccacaggcacacaccaccatgcccagctttttatgtttttatttttttattttttgtagagatgaagttttgccatgttgctcaggctggtctgaaactcctgggctcaagcgatctgcctgcctcagcctcccaaaatgtggggatttcaggggtgagtcaccacacctggcccagattttattatttaagttaacattttgttaccattgcttaaagccacctggtccttttcatcagatagtttcttacagccaggcacagtggctcacacctgtaatcccagcactctgggaggctgagacaggtgaattgcttgagccctggagtctgagaccagcctaggcaacacagtgcaaccatgtctctactaaaagttttggtctcgatctactgaccccgtgatccgcccgccttggccttccaaagtgctgggattacaggcgtgagccaccgcgccggcctaaatattttttttttaattagctgggtgtgattgaggctgggcactgtggctcacgcctgtaatcctagcactctgggaggcaggtggattgcctgagctcaggagttcaaggccagcctgggcaacatggcgaatcctcgtctctactaaaaatacaaaaaaaaaaaaaaaaaaaaaaaaaaaattggccaggtgcagtggctcacgcctgtaatcccagcactttgggaggccaaggcgggtggattacctgaggtcaagagttcaagaccagcctggccaacatggtgaaaccctatctctactaaaaaatacaaaaattagctgggtggtggcgggtgcctgtaatactgggtactcgggaggctgagacaggagaattgcttgaacccaggaggtagaggttgcagtgaaccgagatcacgccattgcactccagcctgggcaacaagagcgaaactccgtctcaaaaaaaattagctgggtatggtggcatgtgcctgtaatcccagctgctttgggggctgaggcatgagaattgcttgaaccggaaggcagaggttgcagtgagccaagatcgtgccactgcactccagcctgggcaacagagtaagattatccaaaaagaaaaaaaaaaattagcgggtgtggctacacctgtagtcccagctatgtgggaggctgaagtaggaggatcgcttgagtccaggtggtggaggctgcagtgagctatgattgtgtgaccgcactccagcctgggtgacagagccagaccctgtctcaaaaagaaaagggtcatgatgcctccccaacaggatatggtggggacgctccaagaccatgggagaagaggatacgagccggagctatggaagaagtgaacacgtaagactccagaggcaaactgcccgtctagacagctctggcctgcagagcccaccactcccaggccagcgccgtgaggtcctgttgagccacccacctcactgtgatcatccccaggtaaaccctcggacgtgggcccggtgccctccttgctgaggctgaagccacgtggccatgaaaacctgagcatcacaagccgctctctgcgtttgtggtgtgatcagggccttctaccacaagccatgtgcccaggctgatcctctctaatgtggagaggcggctgcgctggaaaggcctcagtaagagcagctgggcccttgcagacagacatcacggtgtgaccctcgggactggctccctgcggccactgcagcacaggtgttcacatctcacagtggaggcagtggagaccatgctcgcctgcaggctctcggcgaggctctgagtctggccccttgcgtagcccctggtgactccttggcttctggagcggaactccatccttcacatggcgctttcctcgagggcctgtgtgcgtgtcatctgtggccaagttcccacttcataaggacatcagtcatattggatggggtcccaccctgctccaatgagaccccatcttttttttttttttttttttgagacagagtcttgctctgtggcccaggagggagtgcagtggcacgatcttggctcactgcaagctccgcctcctgggttcacgccattcccctgcctcaacctcccaaggagctgggactacaggcgctcgccactgcacccggctaattttttgtattgttagtggagacggggtttcactgtgttagccaggatggtcttgatctcctgaccttgtgatccaccctcctcggcctcccaaagtgctgggattacaggcatgagccaccgcgcccggctgagaccccatcttaatcacacctgcagtgaccctgttttcaagttaaggccacattctgaggtattgaaaattaggactccaatatgaattcggggggacccaatttaacctgtaatatgtatatcccaaatgcaattttctccttttttcttttagacagttgctctgtcacccaggctggagtgtagctcttggctcactgcctctgcttcccgggctcccgcaatcctccacctcagcctcctgagtagctgggaccacaggcgcacaccaccacacccagctaatttttgtatttttgagagagatgaggttatgccatgttgcccagactggtcttgaactcctgagctcaagagatgcactcacctcaacctcccaaagtgctgggattacaggtatgagccagcatgcctggcctccaaatgaaattttcagaaaggccttttcataatagtaacgggaaacaagtgacataggcatagccttgataaatgtgccaaaagcccatttggaaatagcacatttgtaggaggcctgaggcaagacttgtgggattggacgggaatgctctgttcctgggaccaatacctgatgatggagagtgtccattcttccctttaaaatttttattttaatattttatttttaaaaaggggtcttgctatgttgccctggctggtctggaagtcctaggatcaagtggtcctcccaccttggcctcccaaagtgctgggattacaggtgtgagccactgtgcccagcccattcttcccttttaatatatacgcttcacatacaggctttgtttttgcaactcctatcaaatcccaacaatgtatttgggagaatttgacaagacagttctaaagtttatctgaaagagaagcagcagatcctaaatggctttccccaggcccagcactggcagatagcacctttctaaccttcgggtgtgaatccaagggtggtggtggagcttcaggacacatgcaccctcgtgtccctcctctatgtaaatggaagccttcagtgccagctcctttaggttgtaaggactgaacacgctcacagaagtcgtgtgcacagtgaggtgggggctgaaatgcagcagctcctctccctgtgttctgtccccgccccacctctcccccacctcaactttgaccactaggggaccaattataacatgagatggcaagaatagctcatgtaaagccaccccaccccagtcacctggttgctgcatagtgtcacattcataggagtacaatttagtcactagtaatcctttgcgaataatacaaacgtccagtaattctttgctgcataacaggccttgtgctcaaaaggttctgcagaccttgcctgggtgctctggccaagctgcagtcatcccagggctggctgggggctgggggtttgccggcatgcctgctggttggtgctgctgccagtcccagctactcgggaggcggaggtacggggacggcttggtctcaggaggttaaggccgcagtgagccatgatcgtgctattgcactctggcctgggcaaccaagcaagactctgtctcagaaaaaaaaaaaaaataagggggtgagaggggctataaaggctctgaggtccacgctctggaggcccacaaagtcttttctgcatcatcttgtttgtcagagcaagacccaagggtgagcctagattcctgagctggggaaacaggctccacctactggtggtgagaactgtagacaatctgtggtcgttttgagtccactataagtaaccaaaataccttcagtcttgcttgcatttctcaacattagtgaaaggggacccagtgcttggttgtagcaggcgtcctaaactctccttctgacctgcagagttttcatctgcagaatgtcccctcctggtgcacagcattcatgtcccttgtcctcatccctggtgggtgctctcgccgcctcctttctgatcccatcctcctccttgtcctaccaaccgtctgtactcaccctgtgtatttagtttatataaatgttaatgcctggccagccgtggtggctcacgcctgtaatcccagcactctgggaggctgaggcgggcggatcacctgaggtcagaagttcgagaccagcctggccaacatggtgaaaccccgtttctactaaaaatacaaaaaattagctgggcatggtggcgagtgcctgtaatcccaactactcgggagactgaggcaggagaattgcttgaaccctggaggcggaggttgcggtgagctgagatcataccattgcactccagcttgggccacaagagtgaaactctgtctcaaaaataaaaaaattaaaaataaatgttaacacctgtagtcccagtgctttgggaggtcaaggcaggaggatcactttagcacaggaggtcgaggctgcagtgagctgggatggcgctactgctcctcagcccgggcaacagagtgagactcgatctcaaaaaaaaaaaaaaaaaaaaagaccagcgggggtggttcatgcctgtaatcccagcattttgggaggccaaggtgagtggatcacttgagcccaggagtttgagaccagcctggtcaacatagtgagacttcatttctacaaaaaaataatcagccatgctgtagtcccagctactgggggtgctgaggtgggaggattccttgagcccaggatttcaagaccgcagtgagctaggatcaagccactgaagttcagcctgggtgacagagcaagatcctttctctctaacaaaaaattaaaattaaaaaatattggccaggtgtggtggctcacgcctgtaatcccagtaactttgggaggctgaggcaggtggatcattcgaggtcaggagttcgagaccagcctgaccaacataatgaaaccctatctctactgaaaatacaaggattagccagacgtggtggtgggcgtctgtagtccagctacttgagaggctgaggcaggagaatcacttgaaccaccacgcccaacctaatttttttgttgttgttgttgttagtagaggcagggtttcaccatgttggccaggctcatcttgaactcctgacctcaagtgatccacctgcctcagcctcccaaagtgctgggattacaggtgtgagccaccgcgcccgatctgaagacatttttgattggttgattgagttgggggtctcactgttgcccaggctggagtgtggtggcatgattatagctcactgcagccttaaactcccaagcccaagagatcctcccagctcagccttctgagtaaccgggactacaggtgcacaccagcacacccagctcattttaaattttttctttttttttgagatggatcttgctctgtcacccaggctggagtgcagtggcgcaagctccgctcactgcaagctccgcctcccgggtttatgccattatccagcctcagcctcccgagtagctgggactataggcacccgccaccacgcccggctaattttttgtatttttagtagagacggggtttcaccgtgttagccaggatggcctcgatcaggagatcgtccatcttggccttccaaagtgccgggattgcaggcgtgagccaccgcgcccggccccgtagtttcttacatgttcacaaagagacaaacttaaaagagcaaagcattacgaactttaagaggccagtgcaggaggatcacttgtagctagaattttgagaccatccagggcaacaaagtgagactctgtccctacaaaaaaaattttttttttttttttttttgagacagactctcgctctgtcgcccaggctagagtgcagtggcgtgatcttggctcattgcaacctccgcctcccgggttcacgccattctcctgcctcagcctcccgggtagctgggattacaggcactcgcgaccatgcccagctaattttgtatttttagtagaaatggggtttcaccgtgttagccaggatggtcttgatctcctgacctcgtgatctgccctcctttgcctcccaaagtgctgggattacaggcatgaaccaccgtggccagcctcttttactatttttttttttttttttttaagatggaggctcacactgttgcccaggctggagtgcggtggcacgatctcggctcactgcaacctccgcctcctggttttatgcgattctcctgcctcagcctcctgagtagctgggattataggccaccatgcccagctaattttttgtatttttagtagaggtggggttttaccatgttggccaggctggtctcaaactccagacctcaggtgatccacccaccttggcctcccaaagtgctgggattacaggtgtgaaccactgtgcttggcctttactactacatttttttttttttttgagatggagcctccctctgtcaccaggctggagtgcagtggtgcaatctcggctcactgtaacctctgcctctcgggttcgattcccctgcctcggcctcccgagtagctgggactacaggcaagcaccaccatacccggctaacttttttttttgtatttttagtaaagacaagatttcaccatcttggccaagctggtcttgaactcctgatctcatgatccacccgcctcggcctcccaaagtgctgggattacaggcgtgagccaccgtgcccggccgtctactacttcttaaagggtgagaggcggaaggatcacttgagccctgaagtgtgcgactgcagttagcttttatcgtaccactgcactccagccagggtgacagcaggaccctgactctaaaaaaaaaaaaaaaaagcaaaaaaaagcatatactattaatacttcctccttactataatgtttactgtggcctttatcagactagagagtgcttttatctctcccttttgttagagcttttagaattatcaatagatggtcaggtgaggtggctcaggcctgtaatcccagcactttgggaggccgaggtgggtggatcacgaggtcaggagttgaagaccagcttggccaagatggtgaaaccctgtctctactaaaaatacaaaaaaattagctgggcgtggtggcgagtgcctgtaatgccagctactctggaggctggggcagagaattgcttgaacccagtaggcggaggttgcagtgagccaagattgtgccactgcactccagcctgggcaacagaatgagactctgtctcagaaaaaaaaaaaattattaatagatggtgaccctcatcttcatgttttctgcatctattgaagtgcgccattgagatcgtggagttcttccctgtttgtccatatggtgaacaacactgattttctgatgttgaacaatctctggaataaactctgtttggtttccatggatttctgtttccctttagattttgttagtaatgtattttggatttttgcatccaagttcataattgtaactggacaaataaaggcagattttaaaaggacaagttgggaggctaaggcggaaggatcacttgagcctgggagattgaagctgcagctagcctcgattgctccactgtactccagcctggtgacagcaggacctgcctctaaaataataatacttaaaaggacgagtttacctacagtctcaccaagcaatgaaagagcttatcttcctcctgtttcctttacggatcttgctcatgtattttatcttagttactttagcataaatgctaaatcaaattctttttcactagacatcatcatagctctaggcataccacataatacccaagcacattttaatcattaaaattgtttcctttttttgtggctactgtaaccacttcagcgaaccatttagtgtgtagtgggtttaaattattttttctcctttctgggataaatttcccaggagaaggataattgggtcaaaagctacgaacatatttatgggttcttttccacaagagatcgatcagtttgcaagtgccatctgcagtgtgggggaaccaatcttcaacttgcctgcatttggtattagtattttattaacctttcattgatccaattacggctctttgacacaattttcatcagtgatggactaagtgtgatccggcctgacccgcctccggccggcgtgagaaggggcatgtgtcgggctacgctcgggcttcccctgccgcccattgtgatccagcccgctaggcgctccctgccgcccattgtgacgcctgccagccgcaggctgggtccccgaggcgggcggcatttaggctcggtctccacagccatggccgcgacgcaggagctgctgctgcagttgcagaaggataaccgagatggtcgccagcggaagcaggagctagagaagctgatgcgcgggctcgaggccgagagcgagagcctcaaccagcgcctgcaggacctgagcgagcgggagcggaggtgcgcggggaacgccgctcttctacctggcgggcgcgcgagggtcggtcccgcaggcagcgccgcgaggtgcttcgcagagtaccaggctgatccgcccgggcccgcatctctgctctaggcccttgggaacgggtgatccacccagcggacccaggtgggggactcggccaggacttcccagtcctcaatcatgagcctgcggctggtccttcctggcgactgcgggatcctgagcgacccagtccgccttgtagcgccaacctcagtttccctctgcagcctgctgcggaggcgaagccaggcagcgcagcctctgcaaggggaggcgcgcgaggcggcgcgggagcgcgcggagcgggtgcgcagaagactggaggaggcggagcgccacaaggaggacttggtgaggaagagtcctagaatggggctggacccagggtggggtgaggcagggcgggcggaagggggcgggatccgggggtggggtgaggtaggaccggcggagaggtcggcaccgccccaggaccccgtccgcaggagcagcacagcaggcagctgcaggagcagtgggaggagctgtcgagtcaggtacgtgcaggagatgggagggcctgtctcttggttcctctcggaagtcctgcccttgtcctcgcccttgttgtctccccgtccctgtctcccctgacactcgttcctccagaagcccggtaaaccccgcccttacaagccccgcccctagctcttctacggaggggaaccgcagagccagaagagcacggagcagcaactcgcagcccaattggtgacgctgcaggtgcttgagcgggaccctgaggtctttagtaggggcggagcagcagcgtgagcggggccgtgaccacctgggggtgtggcttaaggcaggccctgaaggcgtgggcggggcgggggatgtgggcggagcacaatcgcatgggggcggggctctgagggctagaataggggcggagcgcggagggggcgtggccatgaccagttggggcgttgcttacgactggtcctgaggacgcgggcggggtcatgatcgcctgggggcgggcactgagggccgggggcggggcccggaggcgcagcgggttgccggcctgcggacctcctgacattccctgggtccttctcaagaatgaactggagctggcggagaccaaatgcgccttgcaggaggagaagctgcagcaggtgagggcagaagcgggttctgttggaggagggtaggctttcgagtgtggatggggaagggcctgtcgccccgacgccgccgagtctaacccgggtgtccacacccaggacgcgctgcagacagcggaggcctgggccatattccaggagcagaccgtagtcctgcaggtgcggccccactcagacgccaaggtgcctcccgcctctcctcccccagacctggggcggtaagtctcccaacccaccgccaggacgcctccccgaggcctcagtccgcactctcacccgctccaggaggtgcaggtgaaggtgatggaggctgcggaggagctggacgcctggcagagtggccgggaactgtaagggagttgggcctgcgggcgcggcggggcactgtggggccgggctgggctcccacctgcatgcctgtccccgcaggtgtgacgggcagcttcgcggagtgcagtacagcaccgagtcgctcatggaggagatggccagggcggaccgagtgagcgcctgcgcgggtccgggcggggtgggctggagcgggacaaccctccccgtcccccccgcggtaccgcctccccctcctcctggaaaccgggccggcgccgcgggcgcggaggtagctggatgcggccctctctccccgcaggagacgcggctgttcggcggccctcgcgcgctggccatcaggtgagccgggcggtgggcgcggccgcggtcccccacctgcccgcctttcgccccgcaggcggtgcgtgctgggcgcgctgcaggtgctgctgacgctgccgctcctcttcctggggctgtcgctgctctggacggtgctgttggaccccggcgccgtctccgcgtggctctggagcctcacctcggagacgacgctgcgccgcctgcgctacacgctgtccccgctgctggagctgcgcgctaacgggctgctgccaacctaagtgcagcgccccgcgcctggctccaggtggactccagggcacctggctttatttctggtgcactcctctcctgagagtgtagaccaaggttgcctaataaactcaagggatgaagctcgtgggttcgtcgtctgtctcccatgtcatgtaggagcttgactggcttttcagcctccaaagattccttccttccttacagctcatggatttagagccactccccagtattgtaaacagcatttttagtttttcaggatacataatttgccatattgccagaaacttgtacatagcatttgacactttgccaatctgacaagctgccttttcaagtattgtgatttgaaattatttctactatatttgaatttatttctaccatttgtaacatgttgatcctgatttttcaatgctcccctttccttctgtttatttgggaagtcacactctgtattctggtattcttactacttgagctcagctcatcgctgtcatcttcccctaaaccgccttaaagcatcttaggtcttttccctctgatcacatgtgctacttttttttttcttttctttggagacggagtcttgctctgcgcccaggatggagtgcagtggcatgatctcggctcactgcaagctctgcctcccgggttccagcgattctcctgcctcagcctcccaagtagctgggacttcagacgcccgccatcatgcccgtttaattttttgtattttttgtagagacagagtttcactgtgttagccaggatggtctcgatctcctgacctcgtgatccgcccaccttggcctccccaaagtgctgggattacaggcatgagccaccgtgcctggccaacattttctccagatatcttactgagtcctaatttccactgtggccagagaatacactctgcatgattttaattctatctcatttactgagacttgttttgtggcccagcacaaagcttgtaatgaacactgagaagaaagtgtattgttgctgttgacagagtgattttttttttttgagacggagtctcgctctgtcgccaggctggagtacagtggtgtgcaatctcggctcactccaacctccacctactaggttcaagtgattgtcctgcctcagcctcctgagtagctgggactacagatgcattccaccatgcccagctaatttttgtatttttagcagagacagggtttcaccgtgttggccaggatggtcttgatctcttgacattgtgatccgcctggcttggcctcccgaagtgctgggattacaggcatgagccaccgtgccaggccgacagagtgtgttctaaatacccagcaggtccaggtgagtgacaggcttgttcagggctcctgtgtttactttcttgttggtagcgccgtcaattgcttattgtgaaatgccccttcataaacacccatacacattttgattatggatggccagtcttttttctatctgttattttcatcttacatctgtcttcatatgtaaagtgctttggttataatcagcacataactgggtctcacttcttcaattcatgtttgtaatccctgacttttaaattgggctggtaagtctattatgtttctccttttctgccttcttttggattagtatcttttaaaactccttttaacttatacgctgactcatattttttattaagacagtctcactctgtcatccagtgtggagtgcaatggtgtgatcttggctcactgcaacctccacctcccgggctcaagcgatccacctcagcttcctgagtagctgggactacgggcttgtgccaccatgcccggataattgttgtattttttgtagagatggggtcttgccatgttgctcaggctgttttcaaactgctggactccagcaatccacccacctcagcctccgaaagtgctgggattacacatgtgagccactgtgcccagcctatatttttatttgtactgctcaggactcaactgtgcttcctaaagctgaatatttgtgtttttcaactctggaaatcccattagaagttgattggggccgggcacggtggctccaatctcagcactttgggaggccgaggcgagcagatcacctgaagccaggagttcaagatcagcctggccaacatgacgaaaccccttctcttctaaaagtacaaaaattaattagctgggtgtggtggcgtgcagctgaaatcccagctacttaggaggctgaggtaggagaattgcttgaacctgggagacaggttgcagtgagcagagatcacgccactgcactccagcctgggcgacagagtgagactccgactaaaaaaaaaagaaaaagttgactggagcttttcattcaactcttctttttttttttttttttgaccgttacccaggctggactgcagtggtaccatcatagctcactggagtcttgctcttcggctccagtgatcctatctttcttaccctcctgagtagctgggactacaggcatgcaccaccatgtggctaattttaaatttttttgtagagacagggtcttcccgtgttgcttatgctggtgttgaactcctggactcaagcaatcctcctgctttggcctgctgaagtgctgggattaggagccaccccgcttggctttcctttccttcacactgcatgtttggtcatttcactattctgatcactgattttctcttcttacctgctgctgtttagctgatcttttggagtttctcttttgtttcaggtctttattcctatctgcttcagatgcagggcctcggtgggtgggagtagatgcttgctgggtctagtcacacaaagattttggagttccagagcacagcacttgaaaacaagcaagagggaaagactagagcagtgggaagatgctgcggagagccacagacaggcccccacggcagccctgagggagacagttttggagcgggcagacagcagtcaggacaaacacaatgtgtgttttggtgcacctatgccgtggtgagattatgggaatctcatgtttgttaagccacaacccgtgctcctgggccccagcctatgagtgcagccaacactgggcccccctctctaggggcaaatccaggaactgccctttggctgaaggtggacttaggacttgacacaaaacctcacagattccaacacagcactattttgggtttttattttgttgatgttggttaaatcttatctctttttttatacacaatacttcatgtacctatgaaataaaacaggtagggaatatgtccagtgcaaacagaggactcacacctgtgcatagacagcaccatccactgattgtcgctgcagtccacggcgttactaagcctgcgccacccacgtgctgccccaggaggcgctaccaggctcttcgggccacaggcctctcctccactgcatgtggcggcagggcgggtaggtcgcagggctccatgattgtggggcagcttcaagggcacatggggcagaggccctcgaaggtcccctcctcagtaggggatgtcattctgatagtactggatcatgttgtaggtccggctcctgaaaggccaagaagagtgaagggagattcgaggagccagcagggtctggggtccctccctgcagggagccctacctgtccaatcagccccttatggctgcccagcacctgaaggtacaaatgtcccaggcgtgccctcccccacccagtgaccacatctgctccaacccgggggactctgaggccacctcatgctcctcagccaaaccgcttccatccgtgggagccactgctctgccccatgggcctcgggccccttggctcgtcctggccagatgcctccaaggggtctgtacgctctcctcgcacctctggagagccccttctcgccctgccccagcccctcttgaggtcctggccgcctggcttctctgcttcctatcagcaagagctccttccgtgcccagcctccacagtgcccttgttagggtgacggacctgggcgccacctgggggcaggtctcagcttcctctcacgctcctccggcagttccccatgcagatggccacacctgggcccctcctcctagtctggatgtggtctgtcccatggcacagccttgggctcccacatgcccctcagggccttaccaaccccacatgtttaagtgctgcccccttcggggatggctcacttgctgggatcgccatcctccctttgttcaggccggacccctcaaagccacctctgactcccacagcagggagcctgtcagcccggtgctctgccttcagaccctgagccagccctccccagggccccctgcacccatctcctcccaccacagtagtgaccagcagcccggcctgcacctccagtcactgcccacgaagcagcccgaggcaggcgcagggaaggagtgggctctgactcctcagccctcctgggaggagggaggcctgacaccacactcagttctaatactcctggccttgtgtccctattgctccttcggcctcacgagccctgcccaggtgggcccggcctctgccaagtgttcccctcggcacaccacagccccctaaaccagcaccccactgctcctcaagagttcctgtcaagacttgggtcttcatgagaggggcggcttggggacagcagaatcctcatcgcctggtgcaggcaaggccctgcaggtgcccagtggccaccgaggcagtgggagaaggcaggggggcggggcactcacctgttgctgaggaagcagctctggatgaccttcatgatgaaatttgcagcctcgcgctcagtcatgttggggctaaacctgtgcctggagaagaggctgtgtcagggctgccatgggcagggccgtgctggctccctggcccagtgggaggagggtcttccatggggacggacttcagctgagagccatgccctggaaatgtacctttggggtccacatgttggaagatggggtgctgtgaaggccacacctggcctatcatgggccctgtccccttcccagcatcacctgagtggccccatggcattaggggactaagcattggggagctaagctactgcagccccagaccttagggtggaggtggggtgggcgtagcatccttgacataaatagaggcccctgggtgggtctctggtgtggccggcacaagcaggggcccctcacagttgtggtctaggggtagagcctcacctaggaaccctgtctgctctgaggttccaaggagatgacaaccacagtgacaattacatgaaaggtacctatcttggatggagcctcagctaatggacaactgtcccccagatggcctgcgtgtccaccaaggaacctacttcaagaacttgattgtctggccgcgaaaacagggcaggcccgtgtccaacatgatagtgaccagggagacgaccacatccatgtagggcctggggagagacaggagggagcggtgggcagaggccagcctaggtggtggccctgcctgtagtcctgtggactggctgatgccaacagcctcaggtgtgggctcctgccacccacctcgcctgccacatcttgcacatccccgaggcaactttcgatctgctgcactcggtcacccgtactgcccaggcaagggctgcccatacgcactctggacaggctgagtgtcctgccctgtcccccacataaggctgccggccatggcttctgcacctgggtgggatgcagacacgctgacctgcctttctctgcggggcagtggggatgaacccaggttggactgtggccttggccaagtgacctgtatatgaaactgggacaaagcccatctttggcacgtagcctgtggggtggcaggtgctcaggctttggtgacagggtggatgggatgcccagaaagggagagcccatggctgaaggcgtgggcaggattgtggggaaggtggttggaattagatgcccagagcaagaatttactggcacaggtgggcagacagaggtgaccaaaggacaggtgtaggtcagcaggtggctgctagcacctacctcactctctggaaccggattcccttcatcctaaaggggatctcagaacgttccacacaccccctccgcctccaccctggtcctcacccaggctcaccgcacagccaggtagcctggacacacatctccatgaaccacttgaagggtgtggcctccatcttgccccccatgatcatcaccatctcatccgtcagcttgatgtcgggttcccagccgagattgccgcccggcgagctttcaaacatgaagccaaagtctgcaaaaccccaaagagctgcctgtgactgggtaggagccagggcgggcaaggacgagtggtctgttttgaggagtggaaaaggactctgcaacaggagcaccccctccacccccaaaaggcaggttgtgttttcttggagacagtgatggggtgggtggtggggcagcaggcagagaaagagaagggaggaagtggaggaaggagccaagctggggcactgaacctggacgagccccactccgcccagctccagcttctgactcagagcaatggcggctctcgccccagctccctggggccggggccaggcaccctctacagcagaacagcttggtggccgacagttcggacctcagagctggaccctgacactcctggcagggtggtcctgggcattctcctctctgtggggtggggatccctatccacccctgggtgccggggtgaagggagaggagggtggcgctgtggctggctgaccgatgtggatgatatggcccttcttgtccagcataatgttgccgttgtgtctgtccttgatctgcagcaggaacagcaggaggctgtaggcggccatgcttcggatgaagttgtagcaggcctgtgcagagagcgccctgggctcaaaaaggccctggggcctgtgggcattctccctggtcccacacccaggatccctgggcctgtgggcactctccctggctctgtgcccccactatggaggcagagcccgaatcagcaagtcagtcttcggcagcaggagtgacgggctgtctggatgtgggggtgcaggcacttcctcccacactcagaacttaactttcttctaaggagtccagcccagctctacattcttttgactcccaaagtggcttacagatgccctggtgtttttttttttaaatggagtctcgctctgtcgccaggctggagtgcagtggcatgatcttggctcactgcaacctctgcctcctgggttcaagagattctcctgcctcagcctcccgagtagctgggactacaggtgcccaccaccatgcccagttaatttttttacttttagtagagatggggtttcaccatgttggtcgggatggtctcgatctcttgacctcatgatctgcccgccttggcctcccaaagtgctggcattacaggcgtgagcactgcgcccggccaggtgccctggttttttttttttttttttttttcagatggagtctcactctgttgcccaggctggagtgcagtggtgcaatctcggctcacagcaacctctgcctcctgggttcaagcgattctcctgcctcagcttcctgagtagctgggactgcaggcgcgtgccactatgcccagctaatttttgtatttttagtagagacagcgttcaccattttggccaggatggttttgatctcttgacctcgtgatctgcccgcctcggcctcccaaagtgctaggattacaggcgtgagccaccgtgcccagcccaggtgccctggttttaacccttaacaaaggatgactgaggagagcagggtgtgggtagaggctgggtatgggtggctggggtagggtggagcgcacacgactttccccggcctgtggccaccctggctacctgctggaaggccagagtggactcatccccgtactggcgtgtgaagtagtcgtacatgccaaagtctgtctggcggcccagctggtcccgggaggtgcagtcggggatgcactcgatcaccccgcactaggaggaaaggccagttctgaggcccgccgggtgcgaggtgcccagggctgccctactggctccactcagggaacttaccccaggggcagtggccaccacgcggtagggaaaaacaaagaggtccaggccgaccagctggaagatgttcttgaagaggtcgatgatctgcagggccagcatgtcctgggaagccgggaggcgcaggatgcggtcagttggcgtccttgcaccccagtagctcttctggctcatgcagggcaaaagccgagaacccagagatggagtgaggtggggagaccacagccgagcaagagtctggaaggccttcctttctgaccaccgggggctggactcaggctgctgggaccaccaggccctgggctgagcatgaggctgagctgtctggtggggtgtgtgagataaggcacccaacccctggacagttccctcaggtgggcactggcatggcagggacagtgggaaaggggctggaaggagaggcctctgggttttgcagaagccctaatttaccccgtggcacctgaaccatgtaagagaaggaaaagattcacatttctgcatatgagattggactctggtgggcctggagccttggggagcagcaagcccagtccccaagcctacttgaggcctgaccctgcttacctgccggcagtcgtctcccagtttgaagatggctgcctgccaggagatcttctggccgtcggcctcctgcgtgctgcactcatcctcagagtctgagcggcaccgcagacctgcccgcagggagagaggccactgttagcctgtaggcagtgagaagccctctgagggggccagggatgagtcctctcacatgcctgaaaggaaccccagcaatcttggggatcacttcttcaaaaccccaaggaggccaaggaggagcccagcagggcccaaggaaagccttggaacagcaggtggaatccagggttggagtctaagaacatttaggcttaaatggaactaaaaacagagccccatttcatctgcagtgaagacccaggtgtgcctgagtcagtgttgggtgctgtgagctggggggcaggaggaatgtgtctgtacactggggtcctgggagggctcggggccagtgtgcagacatggccatgggaggcaggtccctgcaaggggtggcagccccctctccacagctggccacaccgtctgtactgggttgaagagtgtctccctaaaattcatgttcaccccaaaccttagaatgtgtccttatttggaaacagggtctttgcagatgtaattaggttaagacaaggtcacagtggattaggacagtccctaatccaatgactgatgtccttcaagggagatcatcatgtgaagagggaggcggagatgggagtggagcatctgcaggccaaggtgagcccaggactgctggcaacaccaccagaagctgaggaggcaaggtgtgacctgcccagagccttcagagggggcacgaccctgatgatggactccagcctccagaactgagatcgtccgtacagtagccccaggaaactaacaccccccaacggccccgggcccctcagcctcaggaaggagcctgctggagcatgccagctgactcatggcagacagacctctggggtggcacatctgtcagtgcatttgagctccctgccatcccctagcgaggggtctgactgagggcagacagatggacagacatcatcttttatggagagctgtactaaatttaacacatgccagaagaaactggcattagcaaggaaaagcactgagctcccaaacaaaatcagggttctttactgaccttctttttcaagttcactaactccacatcgcttcaccttgaacttggccagatatggggcttttgcagcactgaaaacaacaaaaagaatgtggcacccatgatgcagccgagaaaaacttcacacgcggacgctgtggaagcgggggatgggtagggtgaggcgctcacctctacatcggggtcccagacttgtagtcgacgtccagcacaatggcttcagggttgctgggcagggagcagcctgtgcagggacagaggcagtcacagggagtgcatgtgtcaccacaggtgagccagagtcagtttccaacacggatgttacgtgcgtgtccaccctgcaggcacaccccacccctgtggaggggcctctggtccttgtccagggcaccactaacttattattctgtggccgctaagggtccgtcctccttgactcttcgactcttccaaccatcgaccaaatgagtctgcaccttctgggaaatgctcttcctagaggagcactgagccccatcctcacggatacagccctactgcttctgggggtgtgtgtgaggcctgtcctgcctccacctgcctgagcaacagcctctgaacagccctccattcttggagtccctgtttttttttttttttttttttttttggatagagtctcactctatcacccaggctggagtgcagtggtgcgatcttggctcactgcaacctccgcctcccaggttcaagcaattcttctgcctcagcctcctgagtagctgggattataggtgcctgccaccatgcctggctaatttttatatttttagtagagatggagtttcgccatgttggccaggctggtctcaaactcctgacctcaagtgatccacccgtcttggtctcccaagtgctgggattacaggtgtgagccaccacgcccggccttccttacccatttgaacactactctctcaaaagccttacttaaatgtcactatgtccatgaactgtccttggttctcccagcctttaggacttttgtctaacacgtttctttttttctttttctttttgagacggagtcctactctgtcgcccaggctggagtgcagtggctcggtctcggctcactgcaacctacgcctcccaggttcaagcgattctcctgcctcagcctcccgagtagctggaattacaggcgcccgccaccgcgcctggctaatttgtgtacttttagttgagatggggtttcaccaagttggccaggctggtctggaactccttacctcaggtgatccacccgccttggcctcccaaagtgctgggattaaggcatgagccaccgtgccaggccaacattgtttctttatgcttattttatatctctgtgagttcaagcttcttcagctcagggaccatgtcttactcatctttttaacagccacaatacccaatgtcatgccttttcttttcttgtttttgcttttttgagacagagtctcactctgtcacccaggctggagttcagtggtgcgatctcggctcactgcaacctccacctcctgggttcaagtgattcttgttctcagcctcccaagtagctgggattacaggcacgcgtcaccatgcctggttaattttttttttttgagaccgagtgtcgcactgtcatccaggctggagtgcagtggcgcaatcttggctcactgcaagctctgcctcccgggttcacgccattctcctgcctcagcctctcgagtagctgggactacaggcgcccgccaccacacccggctgattttttgtatttttggtagagacggggtttcaccgtgttagccaggatggtcttgatctcctgacctcaggtgatccacctgccttgacctcccaaagtgctgggattacaggcatgagccaccgcgcccggcccaggctcccctttctcagtgagtgctcagtaaatgtgtgaaataagaggacaagggaaagcctgtttctggccaaggaactgccagtccccaagggggatgtgtgctccttgagccctgagaggtgggctttgaggggagccaagcttggccttgctgtggggtacagggagaggggggcatgccatctcctcctcttcctcacctgcccttctgcctgctccaggctgtggctcacactcaggcccctctgtgctctcctgctagagccctgctggcttccctgacctctggggcaagactcagccaacacaatctagagccaggggctggggacttctgtgcatgccccctgcagtacaatgcttccagctctttttgcccctccccagcagttgtggccttcccaatgcgggaacagaggccctgcatacatgtcctgccctctctgggaagccgtgctgttgtgtgagctcaatacaatgtgttgggaagaaatggttaaaccggggtcctgcagggcactcaaggaccagccgctgtgaacatctgcacgggacagacagagtttggaagacaagtttgtgccaatagttagaaatgcagagagaggccgggcacagtggctcatgcctgtaatcctagcactttgggaggccgaggcgagaggatcacaaggtcaggagattgaggccatcctggctaacacggtgaaaccctgactctactaaaaatacaaaaaaattagccgggtgtggtggcgggcgcctgtagtcccagctactcgggaggctgaggcgacagagcaagactccatcgcaaaaaaaaaaaaaaagaaatggagagagagctgcccagtgaagtctggatttccatcttctcttgaaaagctcggcttgaattcccatgtggccacagccacaggcacccaggagcgacttcccatggaggcggtgagggggtggtgctgatgggtcccagcacacctgagccctcccacactgggcccgccatccccttgtctgtgtgacctgctcctgtaatgctggagcctaggaaccctcttctagagtaacagctactgaggtcagtgtgagcctccagaaaaacagcaggcagcaaggaagatgaagggcacccactgacgagcagctcccgctcactagcggcagattttggggaggggctggggtcctggggcaccaggcaccgtgggcccaagcaggtgtggggctggccaagccactgtgtccacatcctgcagtgcctggagagggcagcagccttcacgccccgccgcccgcctgcaggaagaggttggtctgagcctccagaagccacctgctcacctggctgcaccgtcacttcagacagggccgacagacaagccttctttctctggtcgcctttagggtagggcctgagaaacaggaaagaaattcttgctttgtctcctggaggaactggctactgggggacagcccagggcccctcctgcctggattgccctctctgtccctctcttcccggctctagctgctcctagcgcagccaggcaccactggcagcgattcttgccctgcattcctcatggagaatccccgacagccccggaagggctgttttctggcaggctctgcccctgctgtgtgcgggggtgtgtggctgggggtggtgggggtaataatgcctgccacctgctgccacccaggaaacgctagctcccgtccttcatctcttgggttagaagctgccagcactgctattctcagcacccagcccagaaaagggcctcaaagtgaccaaggtcagagcagtgtacgcaatggagacagcccagccggcgtgcccagcattgatgactccagggtttcatcccttatgaatgcacaaagccaccaacatccaaggatggtgtcaggtccacatgaatggaaggtctaggaaaacgatgacaggagctgcaaaggcagtctggttttcctgacaccaagaggatcgatccttcagagtgtggagagggcagggtgacctcaaattgtggagccatgtgctaaattccacaaatctcaggaatgaaactaagctgtgtttcctgaaactggcgtggccgtgcattctgccataccttcaagagccctgactcaccccaagcagtgcttccccacccaccctggctgtccatcagaaccaccagcagccccgctgctagagactctcattcatctggttggggccacgcacgggtatttttaaagcttcccaggcaattctgttaagctgcagggactggaacaagattccagaaggtggtttccgaagcactgcacttacttgatgacagccgacacgttggtgatcttgttaaagaaatcaaactcccgctggtaaaagtccttcgctgggcccgacaaggagcctgtgttctcctctactaactgctcccggaggtcgccgatgtcagctgccaaggaaacaaagaggctgagtctctgtggctgtggcagaggcccctcaggaataccagccctgtttcccaggccccagactggcggtgcccagagtatgctctgcaggcttggtgagaccataacagctgctgtgtgccccttttgctgtgttgacacagccgacactgctgggaagctaagctggtgcctaagcggagctcaaggtaggggccaagcgcacaagtggacgtggaatcctcactgctgcacacgctacacacgcaggaagaaaaaagcccgtgtcatttatgaatgtcacagggcatagaatcctcactgctgcacacgcagggagaaaaaagcccgtgtcatttatgaatgtcacaggtgaagcaatgaaaactaattcttattaaactctaccctgaatacatgtctttttttttttttttaatagaggcacacagtgggcggggctctatattaaatagtgtctctcactattcaaatcccaggctgaatttaaattcctgggctcaagagatcctcctgtctcagtcacctgagttgctgggactacagctagtaggtgggactacaggtgcgcatcaccacatctggcttttaaagtatcctttgtgatgaaacgggatgtgcacgaagcactcttgccgcatctaaggcaggcgctgtcctgagaagcacctggagcttgtctgattttggagcctggactaacctttttcacagacctttgtttttacttgaagaaatgactgacagacaacatatagctattcagacttagggatgtggcagatgttttcctgaaaatgaacaaaaaataaatcttccactcaaaggaactgaaacatttttttggaaaacttggatctgctgctgtgagctcaatagcttcccttaaaaactctttctgggccgggcgcggtggctcatgcctgtaatctcagcacttcaggaggctgaggcgggcggatcagaaggtctcagccaggcaatgtggcccacacctgtaatcccagcactttaggaggccgaggtgggcggatcagaaggtctcagccaggcaatgtggcccacacctgtaatcccagcactttaggaggctgaggcgggcggatcagaaggtcaggagtttgagaccagcctggccaacatggtgaagccccgtctctactaaaaaataaaaaaattggccgggcacggtggctcatgcctgtaatcctggcaatttgggaggctgaggtgggcggatcacgaggtcaggagattgagaccatcctggctaacacagtgaaaccccatctctactaaaaatacaaaaaattagccgggtgtggtagcgagcgcctgtagtctcagctactcgggaggctgaagcaggagaatggtgtgaacccgggaggcggagcttgcagtgagcggagactgcgccactgcattccagcctgggcgacagagcgagactccgtctcaaaaaaaaaaaatttaaaaaaaagtccgggtgcggtggctcacgcctgtaataccagcactttgggaggccaaggcgggcggatcacgaggtcaggaggtcgagaccatcctggctaacacggtgaaaccccgtctctactaaaaaaatacaaaaaattaggcgggcgtggtggcgggcgcctgtagtcccagctacttgggaggctgaggcaggagaatggcatgtacccgggaggcagaggttgcagtgagccgagattgtgccactgcactccagcctgggcgacagagtgagactgtctctcaaaaaaaaaagaaagccctctctcgtctctcagtctgtgcttagtaatcagctaggcgctgagagaacagggcatggcctccttacagaggtttgctgcttctttgcgtggcatgttttcatttggcattcccttccctggaatgctctgccctgtccaccctgcatgccggtgcagcctttcagactcagctcaactgtctcttttccagaaaaccatctctgattccccaactctggatgggccaagtgtctgtaccggaggactgctcccacagttccctcaaattgaaatcacctgtccatttgactgcctcctacaagacaacaacagaccataccccagtcatgtaggtgtgcaccagcctcagcccaatcctgggccgtcagctgctcagaggggtgtgtgaacgcagctggtgccagtgcagggaaagtgcggtgagtggagtctgctcagctgcctcgggtgcgtgtttatgcttctcagctcaggccagaggagaagcagagccaggcatgcaccggcctccaatgaccgtgcaacacagtcaaggccagggctcaggggggtctaactgcttttccgtccctacctctggcaccctcagggctgcccacgttgcacccctgtcctgcctgcctccaccatgagcagctgcactgttgagggttacctgggggaacaagctggctggcggtcaggtacttcttatctgagaacatggcggtccaaaatttaatcatgatgcttatgtcttcacgcagccgcttctctccttgagtaggaaactttgggggacagcttcaaacaaccataagaggacaacggctgagtgtctggagtcagggactagaggccagtcacacaaagcagtgagaaggtgatgcagacaatttcttaatgacaaaaggtcagcccaaagccagtcattagcaaggatgatctggcccattcccatgggaaggtgtggtggctcgggagccctcttatgccctcctccctcactgcccacagcagcccctacagctttccactgaagctgcacttgtggcagatcagggcaaggaagctgcactcacacaacagcacagcctatgggtgcagagccccaggcagtgggtgtttgcaattcttcgtgcaataagccttcacattaacagggaaattaaatggacgcacttaatctcctaaatcagttgaactgagggaaaatttgcctacatctcgctgggaggctagctctaagtacacgggacacatgcacagggctgaagggtatttaaatccacagggccagggatactgaaggaggaggttggtgagcacaactgggcaactgtgtattcctgtgagtgacttcctgggggtctggggcgatggagcacttggaggggctgggccgtccctggatgccgcacagcacatcttgggggagtacctgaagtagtcaaaggcagtggagtagatcttctcgcgaagcacattgcggatggttgcatttggaaccacatcggcatgcaggagggacagccccagggtcagcagcctgtgagggagccccggacccggtcagagcaggagcctggcctggggccaagttcaccttatggactctcttccctgcccttccaggagcagctcactgaaatgtgttccccgtctacagaagtaccgtgatacacagacgccccatgacacactgtacacaccaggggccctgtgctccccaggaagagggccctcacttgaagcggggcccgatggccgccacatgccggttcatgctccccttggccccaccgatgttcagggacatggagcgctgcagcaggctggagaagatctccacttggtcagagctgcagtacttggcgatctcaaaccgctgcaccaggaactgagcgaaaagaggaagacgctgtggtggtggggctgagccgggctaaccctggggccggcagagacagctgaggaggggttctgggctgactggccgagcttgccgaaggccttgggctcggctacccccaccccaggaacagtcctggccccccaggtggagcaccccacagccttggtcggggaacaggcacgtacgtcgatccagatgtagtggggggtcacttcggggggacagggtttgggttgacttgcttccgaggcagccagggggtctgcttcctttatctcagcagaaaacaggccaaatttctgctccactgtcatgtgccagcccctgccatctcccgcatgaactacaggtacagaaggaatgttagctcctctgtgaaacacaaaaaggggctactgtcaagttttctctaattaaaaaaaggaacacgtgctcactgaataagatttagaaaccaagaaaagtatgaagaaaaaaatgaagatcgcctatagtcccacatcccagggtcatctgtgtcagtgcttggtgtattttctccagcctctcgaggctgcattctgttcaacccggttcaccgtgtggacattgcaggtgtgaggtggcagcacccgggatgtacctgatgccctgacaggcactgggtaggtgactcttctctataaccctgataaccctctgtggctgtgagcgggaagacccctctgtgggctgctgagctggcaagggcagaagagggttctggatccagggcctggctcctcctctccaccccacacagaccctacccgataccttcatcccgctaaccagattaggaaggcccatggagccgaggcgagcctgcagccaccatggccaggcctgggagcccagggtcaggctgctcccatggcccagtcatgctcagccaggtccccattccgtgggggggcatgaggggtgcccagagggagcagcatggtgcccgggagacacctgggtgctgcagagagtaagaggtgcagctcacacatggaaagcccccatgatttctgggtgtttttacaaggagaccaacaaacagcatttggcatctggccaaagaggattctatccctctgttgtcccagcagcaccagcttctacaagggctccaagcgcctgtgcagaggtggcaacgaggcctagtgagtagaacacacaccgcggctccctccccagtacccatcccctcccttcttcctcatgaggtggatcagggtggccacgtggccagtcacagggctctcagccagggtccctgctggctgaggcggccactgttctccccggccactctaatgagccagggagagtgaactgggcaaggccctgggaacacatgccagggtgagcttcataaggtcaaggcagctggcctctgccctttgcactctgtccttgtcttccttcctgctgggaggcacagaagccatctggaggctgtgagggtggagacaaaggccacataagcccaggatggccaggagccgacaggagcctggggcggggctctgtctgctgcttccctctaagctgcccatggggtgaggactcctgggggacgaggcactacagcctgctttgtgtttcctgcagaccgattagtcttatggaagcagacaagggagcaaaaaaatggcggtgggggggaccccagaactgccacggacaagaagccatcgaagagacacactcccatctatttgttaaacaaccacatcctggtggctgcctctgtgccagggcctcgtggactctgggcatggtgctctgaatgaagacaaacatgaccacacagtctatggtggggaccacagacaacaagaaataagctacacacactgagaaacactaagaaacagcagtgcgagtgagcgtgtggccaggtggccagggagagccctggcaaggaggggacatctgagatgagccctggaggagacgcaggagtgaggcgcaaggcacggccatctgagaagagggaatgcatgacgcggcctatggtgggagcagcccaggagggcagcttcaaaagtgaaactgatgggatgtgctgagaatcatccgtgggaagtgcaagcaggaccccagcatggccacagcacagcaagcgaggggaagagagaggatggaagtcaggtgggaagggggcttgcaggtcacagaaacaagcccaccttcgagtctgtaggggggctctgattcccccctggcttgcgccaaccgcatgtggagaaggggaagatgcctggggttggggagcaggaggccaggccagggggcagcagctgggatgctgggacttgtcagatcctggataaacctcaaaggtgaaggtgatgggatgtgctgagagtcatcagtgggatgtgcataagagggagtcaaagatgtctgagcagagagaaggacctcgctggcatctacagtgaagggagggacctcgctggcatctacagtgaatggagggacctcgctggcatctatagtgaagggaagggtcacgctggcatctacagtaaagggagggacctagctggcatctacagtgacgggagggacctcgctcacatctacagtaaagggaggggccacactggcatctacagtaaagggaggggccccactggcatcaacagtgaagggaagaaccaccctggcatcaacagtgatggcggatgggcgaccagtgcagcggtgtctggagctgaggtcggacccattagttggggctgctaatcagttcaccatgcaggccgtgggccaagccactgaagggatccacctggactaggagtgactgggctgggtaagcagtggagctggccagagtagccaggcagggaggaggagccctggggcatgccagtactgagaaggccctgagctcaagaaggtccctttattctggaggatgaaagggctacaaaaattacaaaggccttaagtccctgggaaaagcagttaggctcccaaaacagctgctttcaagacccagaactctgaaggaggctgtgagcagctttccctgagctgatctgtcctcctaccatctgggacctgctagtgatatctgtactccaactgccctgcccccaggggtcaaccaacccactcctatctgaggacccactcctatctgaggaccagacagagaggccagaggttcaagggcacctggactaaggaagtggagaggagagagacagatctgggctccagagccccaggtacaatgtgagggctgacacgtggtcaggagcacccccagtgccctgtgaaatgggaacggctacagcccctactctttttcttttttttttgagacggagtttcgctcttgctgcccaggctggagtgcaatggtgcgatcttggctcaccgcaacctccgcctcctgggttcaagcgattctcctgcctcagcctcctaagtagctgggattacaggcacatgccaccacacccggctaattttgtatatttagtagagacagggtttctccatattggtcaggctggtctcgatctcccgacctcaggtgacccacccgcctctgcctcccaaagtgctgggattacaggcgtgagccactgcgcctggctgagcagcccctactcttaaggcccaccgaggtctgaggctgaagcagcatatggaaaggaatcctgaccatagcagcactgtgtcctgacagtcacaatttgtggtgaaaccagggctttctggtgaccccagaaaacatcagtgccggctctgccagcacccagacacctggtaccccgagactggcaaggggactggaagagggcagtggcctccaggctccctccacactgcccagtgctgtgtgcacacaaaggaccacgggtcagacagatagaggccgagctgtggggctgtgtgccacccagaaactccggggaaaggggccagtggcggtcccccctcccctgcgcctcaccagagtgccaagggcccagacaccatgtgagcagcagccagcggggcgggggggcctcctgagcccgtggccttcctgggggtgcatcaatgcctggtcacctggggaagagaagacgaacacagtcacccagacagccatcagcgaagaagggagggaagggcgatgaagggacgcacctgggggtctctggctggggcaccaggggcagcccagcaggagactgtgaccacagagcctggtagttggatctgacagccaggaagagtaaggaccagcgaacaggtctagggagttcggtgggtgcaatacctgcccctctaacacaggacattaaggacacccaggggccacctaggccagggggcgctggtggcagacacacaattcttggcctgcgggtgtggtagcaggaggcctgggcagggcccttcccaagctggccacatttacataacaaaaggtcaaaattggagccacttgtgcaagggctatttataagaaccagtctcaaccgcttttggctcccccgttccttcccttcctgatctgctctcaccgcctccctgcccagagggcccagccccctagcccgcctggcctgaccacatggccttccctctccagaggtttcactgcctaagggctcacccaagctgcaggcctgggctttcaataccggcccaccaaagccttgggcagctgccgccaggaaacgaggggttccctcccacccccagagctctgggtcctgcaggaggggggatcctgaggtggtgggtccttgcaccccacacctgccagcctgggcccccacggaatagagccggggtcggggaaggggcgtgcagcggcccgtccccgtttccccttcccccactccacccccagggccagggaggctcagcaggtccctcaggaatgtgaccagacccggggtgccggcccagagctgggaggcctaggctgcagctggccagctgtctctccagcccctagtgcagctcccctctgggtggggggtgtgaggggagggggtgcatggctggtccaggaccccaccaaaggcccagagggcagcagaaccagctctgttggtaggaagcccaagggcgtccacagttagcaagggttgggcccagtgggctaatgctgggatgaggccagtagggcaggggccactgaaacactggcgggagcagtcgaaaaactgggtagagggtctcggtggcacactggaggcaatcagataccaccatccagccctgtgccacttcatctgctccccaaccactgcccctcaggacccagtcaaccatgggtagagcgcatgccaaactctgcagccaggggtcacctgaccttgccagaggccaggccagctactggatgccgcgcagggagtgggtggcagaataggactggggggcacctgagtgccatgggggtgggaacaccctccgtcagtgcccactgcctggccctgtcgggcactttacaagcccaaggctagcactaggtctccccaccaaggaaggatggccccaggctgggtcagctgtgatgtagaacagggcagggctcctccctgaaccctccacttgagttagggggtgtcagagccacctgcagaaagttcacagcaagcacaatgccaccatgcgtgccatccacaccagctgggccaagtctgggccacatctaggccgccactgtgtctgcgagcagcaatgcagcctcaccccatggcggggcagggggtggcacacgccatcctgctgcgaaacgcctactaagcactgctccttccttctcagccacagagctctgccctacccgctcaccgctggacatgaaacagcaagtgcctatcctggagggctccgcctggggagtgccaggtaactagaaacacggctctgggtgctggcccggatgctggtgctcagccctggaagcagctgactgcaggctgcgatgagaatgccacctagcacccagcagcccctggcagcaggcccgggcagcacgcctatcagcccccaggctagcacgcccagccctggcctactgcccatccagaaacgctggctcccaggacgcccaggatctgaggcagtagggcagcaggcctgggctatcggggccagctgggcattcgcctaaggctgtgacccatcccctccctaggacagagccttcaggggtccaggggagaggcaagaagggtagcacagaaactatctcccaagttaggatccctcagctccaggattccccctgtaggtggactggccccagctgggaaggacaagagccccagcagctggagggagggccagctctctctgcggaatcctgaaggtctgcaggaaggaacacaaagcctcggggttaccttcccaggccatctgttagagcagacacacggccctgtttacggaacagccaacatgccaactgctctcctttccttcccctcccagtccccgccacaaaaaagccagaaagccatgtccccagacactgagggcaggcccagggcccaggcaggtgctagcgggctggaacagcactcagatactccagcctctcaagccactggtggcacatgcccaagctctgtagaactgggccagccacagcagccccacccccgctctgttcgccctcaaagaacttacagtaaggcagctgctctgcaaggcccagtcagagcctacccggcccagcaagtccattctgtggcaagaaaaaccttggggacacacatacccaactgctaagtaagattatctctggggagcgggattacagaaaaaccatagtatctgtatattatgttcatttctgtaatactcaacattttaaaaagtattacctttttttttttttttgatggaatctcattctgtcccccaggctggagtgccatggcgatctgggctcactgcaaactctgcctcccaggttcatgccattctcctgcctcagtctcccgagtagctgggactacagccgcctgccaccacgcccggctaattttttgtatttttagtagagacggggtttcaccgtgttagccaggatggtctcgacctcctgaccttgtgatccgcctgcctcagcctcccaaagtgctgggattacaggtgtgagccaccgtgcccagccaaaagtattacttttaaaaccctaaaaatacaaagggcagaaatgatgcagagacatggatgaacctcacagtcgtggcactgagtggaagaagacttttgcgagagtacagactgcatgactccatttacatcaagttctagaataggcaaaacggactgagggtaaaaaccagagcagaacaggctgtgagcgacaggtgaggactgtccaggatggggcgagggacaagcgcccactgcctggccctgacaggcctatccaggacggggcatgaggaactctttggggtgagggcagctctctagcttgctgggaatctgggttaaggtaaatgaaaatacaattttaggcccttaattgtatgtaaactttacttccaatgaaacctccagacagaggctttcacaggacattctcatctcagaagctcagcacgataccctggaaacaccaccagctaacctttcctgggcactgttgtatgcccgaccatgtgctatgtcactggagccgcagggccacccaggagcctgtgcgttctgtccatgtgatcaggtgggctcctctcaatcttcacacagcacagctgagcctcaaacccagcactcaccctgacctctcacctccccacaaggtaggaaaacctggggctgaaagtgtgcagggacatgtcatctttagccttgggcaaaggcaacctttcccactgatgatttccagatcacccaggggtattggttctgcctcaattttccaactggcacagagatcaagggcgacggtgaagcagattggaagggcaaagacgccacggtgggaacaggttcctatccctcccggctgctctccagctgggtggccctcagtgcatctccagagggcagtcaaaagccccaggccaagaccaccctgcactctggatccctctactcgctcaccaaacacagaccagccaaataaccaacggggatggcagaggccagggcactgtgcacccctcgctgcctcctgacactcgaagcagccccccattgggggacccactagcccatgatcctacgcgagcgaggtcaggccacacctgcccgtgtgtggagcctctggtcagtccacatggctgcaggggcctgtggggaggctggaacagggttacctcaaggcctttcttctaagcacccagcaaagggcaggagagtgtgctctagtcagcatctttcaaaggccaggagagaggaggttttcagatcaaagtgatccctgctgaggcagaaagcagaaaactccagccccaattctgagaggcactgccccaacccagcctggatacccaccttgcctagaaccttggcctccaagaagccaggcattcagaactgctccaggtgctgggcctccacatggctccttctggaggccatgactctgggagacaggaacacatctcacgcccatatccaggcccacaggcgggggtcaaactcagggtcaaactcatctcagccacatgataaccctgccttcagactgaaacttctggctcacgcccagccaggagggaggcctggggagaagggtgaagaccaggaaagggcgccaccccaagcaggccatcccgcctagccctcctaggatccttctcatccaccttcctccctggaagctatcctttactaccaagaaaggggcttcctgcaggaggcctggagctatgctggaggactgaggagaagctccccccagcccactcccaaggagcagcaccttaaccacctcccagcctaaacaaaagtaacagtgaaatgagaaccctccagctaacgccaagacagctgagagtgagcagggccgcccacggcccgcccgagctccactgtcaggtgggagggacaagcatgccaggctgagaagccatgctaggcagggcagggccaccaggcaacttccacaacccagaggtctaagtacatctgaccagggtcagagagagccccagacttgctgccactgctcccaaacttcagtctaaggtcagcatcggccctggttccagaccaacccccaactatagtcacctcatacttcaggtgtggccgggacagatgcagctgcaacgggtggccctgtgtgagctcagcctcttcccaggagcccctaagccatgggagagactgcctggaaggcacaaggcagccaggcaggaggcagccagtatccagaagtgccccaaggcccagcccctggacacaccaaccagccctgcacagtcacaagcccaggactttgttcatcctatccccatggcctggagtcctccctgaggaagccttggtagacaagagatagctccaaggggcgaaggctgcacctcgcccaccgccacagccctgtatgagatggcagcctacatgtgggcaggtctgatctcctcaatcttcccacaggcccagtgagcggggcgttatctctgcagtttcagataagaaattaaaggttcttgggggttaagcaacttgcccagggtcacaagagcatgtaggtagcagagtgaggacctaaagcctgactccagtgttgtagtctgatgacccccccgcccaacgcaggcagggccagggatgccactcacacatggcttccaactgccaagctgcttgggggagctagaggaggcaccgccctccatgcactggtgtgccaggagcagggactccagtctgcacctccaccctcactcccccaccccccagcaccacctgcctatccacagcagggccccacctgggtgtattctcccaaactcactgtgagggcatggggtctgcccagctcctccaccagaagtgacaaggtggagcccccatgcagcctgctttggaggcccaggttgtgcttgctgctcctctgggaacacccccaccctccatgacctccttccctgtcccttcaggaatgggctggtggtgggtggggctcactgctctgggcaagcccagccatgtaatccagcccagacctggatgccggccagcagctcctggctctcctcccagaccatcctcctggaaagcaacaggctccacaaatgccaggagcccagctctctccaacgcagcttctacaaaataaacactcgggttccactcaacacattggtgatgcagcgattgggacctgaggctggcctcctcctcctctgctcctcaggccagccctgtggcctaaagtgagggaggtagcatccaccccagcccagtgactttcccaagcccatcctgaaatgcccatgggacctactgatgacctcgtactgcccacagcagggccaagccctgcatggtccgagccacccgcccatgggtactgtcccttctgaggtgaggaagcccgggctaacaccccagcacaaggaaaaggctggaatgggctgctgagaggagagctggaccgaaagtgcctccaaactgtgcttcccccagaaggtacagcctcagtcccctccctctcctcatcacttccgggtttggagccagcaaggaatgaggccaggaagaccttggagacctgcagctgatttcccctgctagtgctggcaccaaggagggccccaggcctggcacagtctggctgacagttctgagacaggatattggagacaggcaggggaacattgctttaacaagcagaataacggccaggtgcggtctgtaatcccagcactccgggaggctgacatgggtggatcatgaggtcaggagatcaagaccatcctggctaacactgtgaaaccccatctctactaaaaatacaaaaaattagctgggtgtggtggcacgcgcctgtagttccgctactccggaggctgaggcagaattgcttgaccctgggaggcggagcttgcagtgagccgagatcgcgccactgcactccagcctgggtgacagagtgagactctgtctcaaaaaaaagaagcagaataacaatttaaggttgtgatagtgactacgaatgctgtgctcacctccaaactccatcccaacactaccctgccccctaagaggggcctgagcatggggtaaaaggctcgctgacagccacagagcaggagcccacgcaagaccaccagaggatgtgcagctgctgttcctagtaggtgaggaaaaagcaggaatctggcatccacacatgtcaggaggcaaaacaggccctgtgctggtttctgcagtcctctccagcccacttccctgctcttcttgctcactggccatgacccaagaaacagcagcagcaccaccagggatcttgttagacacgcagaggctcagactccatccagccctaaccaccagaaccctgggggctcaaacacacagtcaagtctgagaagggctaggttagaagctttttttccttcttttgtttttacctggacaccactgattggaaagctctctacggcctgaaagccaagcgctccacaagtagtaaacgctcaagggatgggcatcaagtggaaggagaaagcccccaaaacgaagatacatgtcccatgtacacaagctcacaggctggtgaatacaaacggtagacctagaatgtgccacaccaaggctgagcgtgttaccacaggtaccagaatggtgaccacgctggagggttccacaaaccctgatcagagaagtaggcgtgagtggcaggcagagaacacagctctgtgtggcagggagggaggacaagcagtggcagcacagcagacaacaggtggaaattctacatgaaaggcactaaatgggcgaggaaagcctgggccgcccaggtggaagggactatcgtgatcatctctctcaccctagggacaccttaaaaggaggtaactgagccccaaagggaggcacccagcacagctgagtcacagagctgcagccatccaacccacagctccaggagggactctccaacttcacaatttcaaaatcaaccctagcagctaacaatttcttaatgccaagtaaagactagaattagaaacaaacagaaaccctatcatcttctaccatcattacttcacaaaagaaaacatttcaatgatcaaagagcaggaagaactactggcagtcctgcacctatgcagttctccaggcctggcaaaggctctgaggcaaccagcatgaaggagccactgcaccgtctgtacgcaacaccgcctgacccccgggctgggacaagactgagatgacatgctgaaagggaatcagaaaaaacaaaaacacaaaaattcaacaacagatactaaagacgggattttgactagccaaacaaagactaaaagagtatctcccagggatgaaaggaaaatggggatgtttttaaacaagaccaggactgttccagaaacaataagaacgtcaaagcccatcaggaaaaaggtaacaccaaatgttggccaggcagtaaggcaaccagaagtctcacatactttataattttttatttttttgagagagagtcttgctctgtcacccaagctggagtgcagtggcgagatggctcactgcaaccttcgcctcccaggttcaagcaattctcctgcctcagcctcccgagtagctgggattacagaagtgcagtgcgccaccacccgcagataatttttgtatttttcgtagagatggggtttcaccatgttggccaggctggtctccaactcctggcctcaagtgatctgcccatctcagcctcccaaagtactgagattacaggcataagccaccgcacctggccagaaaactcacatggtttagaaaacccttggatggcacaatctaaaactgtgggcccaaggccgtgggtggtggctcacgcctgtgatctcagcactttgtgaggccaaggtgggtggatcgcctgaggtcaggagtttgagaccagcctggcaaacatggtgaaaccccgtctctactaaaaatacaaaaattagttgggcgtggtggcaggctcctgtaatcccagctatttgggaggctgacgcaggagaatcacttgaacccaggaggcagagcttgcagtgagctgagactgcgccactgcactccagcctgggcgacaagagccaacttcgtctctaaataaataaagcaaacaagctagctagctagctagctgtgggcccaaaaactcacccaaggtatacgccaacaagaatgcacacgtatgcacaccaaacaggcaggcacactcatgaaggcccaacaatggaaaacaactatgcccaccctgagaagggacagctgcaggtataaaagactatgagccagcagtgaacaggacagaacgtttaggttgaactgtatgaatttaccttttaggggtaaaaaaacagctggctgctgataatttcacatggtttgacttacaaacaacgcagatgaatctctcaaatatacttttgagcaaagatgccagagccaaaaagactattacagttccatttgcatacattcaaaagcaggcagcactaatcttatgggtgggggttgagagtgactacaagcttcaggatacgtgaggggcttccagggttgtgtttcgcactctggatgctagttacaagggcataatcatttgtgaagaactcttggagctgtgcacacttcttacgtaggctgtccttgaattcaatacgtgcacagaaaccttcagaagggaagcagagatcaacttcatcctgatcagcaagtagactcagtccaggcagcaacctctcctggacccccaaccaataacaacaacacaggaagcaaaatattggcaggacagctggcaacgcggcaatgtccaggatggagtgcccatcctagaggagggagctcacacaagccagccaggagcccacaggaaacagagagactactgtaaatccttattaagagcagactcatgtctgctatctaaaagataaaaacctgataatgtttttaagttgtcctaaggtccaattgactttttttttttttttttttgagacagagttttcctcttgttgcccaggctagagtgccatggtgcaatctcggctcaccgcaacctccgcctcccgggttcaagcgactgtcctgcctcagcctcccgagtagctgggattccaagtgtgcaccaccatacctggctaattttgtatttttagtagagacggggtttctccatgttggtcaggctggcctggaactcccgacctcaggtgatccgcccgcctcggcctcccaaaagtgctgggattataggcgtgagccaccacacccagccccagttgacacttctaaaggagaaggggttctgcaaatcctgaaaggcaagcccaggagaaacaggaaatctgggagcacggcaagcaaggttcaaacaggacaccaaataattcccagcaaccgcctccagcaggtcctggtggcagccaggtagggcaggagccagctgggcatatcaaagggaggaagccaagaagaaaatgggcgagactctcagggatttggggtcaaaggaagccgctgggagaaggaaacagcccacttgctccttcataggtaatcaacacacaaaccccccagtgcctcaaatggctcaggagctacagccaaagatcaaggatcaagttattttactccaagaaagaaaaaaaaaagaaaaagttatacattcggcatccattggaagttttgtgattgtttggagacagggtcttgctctgtggcccaggctggagtgcagtggcgcgatcatagctctaatttatgggctcaagggatcctcccgtctcagccttttgagtagctggaactaaaggtgcatgccacgatgcccaaccaatttttaaaattttttgtagagatgaggtctcactatgttttccagactggcctcaaactcctgggctcaagtgatcctcctgcctcagccttccaaaatgttgggattacaggtgtgagccactgtgccaggccttaaaaagcaatttttacagataaaattgggcaactgctatggaaaatattacaatctatggtcctgtgcctgaaaagcctccaagtgtgatactttatagagaagaggtctctcctgtccagtaggtaacttgaaagtgtctaagagacaagtgcccaagaactcaaagaatgagagagggatccattcaaactcagggagaaaaatgctcacaaagtttcactgtacttctaaactgagtctcagtggtgcattaaggaactggatttagagacagaaaacaaaataaactggcacttctctgcctcaagaagcatagcttgggggtgaaaagtcagctacttagaaagcagcaaaaacaaaacccagaaacccacccaaatgctcactgccagcaggacaggtgattatgtgtggatggcgccaccttggacactgaaatggagaatgggaacgcaggaactgctgctcctggtgtcccaagagtgcaggacacccggctcccagcgaactgagccaaaatcattcgcagtttcaggatccagacaaaggtgggaaaccgacaaaagccagcgaatggctgacccgcaattcagaagactgttggcttctagagggaagtgggaataagccagggagaagtgcatggggtgtcccaggaacttgggaggctatttcttatgtggccatgagggaacaacggtgtcacgcttagtgggacacccacgattcaaccaatagtgggtttaccactacttatctattctttaagatttgtgcacacacatatatacgtgtaatttacctttgtttttttttttttttgagtattcctctgtcgcccaggctggagtgcagtggcacaatctcggctcactgcgacctctgctgcccgggttcaagcgattgtcctgcctcagcctcccgagtagctggggattacaggcacccatcaccacacccagctgatttttgtggtagagacagggtttcaccatcttggccaggctggtctcaaactcctgacctcaagtgatccgcctgcctcggcctcccaaagtgctgggattacaggggtgagccaccacgcccggcctatttacacctttgtaaataacttcttagagttcaatggctaagtatactaaggaagctgagcctgctctgtgcagaagtctcaaaagaaaggaaagtcgggtgtggtggttcatgcctttaatctgagcactttgggagattgaggcaggaggatcgcttgagcccaggagttcaagaccagcctgggcaacaaggcaagaccctgtctcatttataaaacaaacaaacaaacaaacaaacaaaaaacagagagagagagagaaaagaaagagaaaaaagaaagaggaaagagacctccctggaaatcccaatccagggagaagccaagaggctaaagctgaggtgcactcacagagcacctccctttcaccacccgagagatcacctggtccacagccgtcaaactcagcaaggccacacacttgggcagctatgacaacaatgcacaaatgagggctttggagggctcagttcccacaagagataacccagaaaatatcaccctgtcctaatcatacaaagcaaaagaacctggggcctccacacctggggtagcaggtatgcttcactcaacagaagttgtccaggagggagaaatcccaggcaacctcccaaggtctacaggagaaagaagggcagaatcagagccactctaagtgaaaatatcagcgtttagaacacaatcacccccctgcaacccctccagccaaccctcgcctagtccctgtaccctccaattcagagtccaataaccctgagttatctttctcaacacccatctcatcaagccactcccctgcttaaagctttcaatgggccgggcatggtggctcacacctttaatcccagcactttgggaggcccaggcgggcagatcatctgatgtctggagtttgagaccagcctgaccaacatggagaaaccccatctctattaaaaatacaaaattagctgggcatggtggcgcatgcctgtaatcccagctactcaggaggctgaggcaggagaatcacttgaacccgggaggaggaagttgcagtgagccaagatcgcgccattgcactccagcctgggcaacaagagtgaaactctatctcaaaatacaaaaaaaaaaaattaaaaaaataaataaagctttcaataaattcctgatgcctagcataaagtccatgctcaggcctggcatgcaaagcacttcccacaggggcatcaagcccacctcatcccttccacagacacacctgagagctcctgcaggccgtgccctactctgggaggagcctgccccctcacgactccctcctctgtgaagccagaactgcctctgttgtccccccgcttccaacgtcagcaccagctgccaagctgcttccctcctgcctacccccaccaccccatagaccagtacccaaagttagaccctgtgtcccaagcagccacagcagcaggcatgcagcaggcactcataaacattcattaggtgagcaaatgctggtcagacccaatgctgagaagagacagagtgaaacaacatgtgaaagataaggaggcacgtggggaagatggaaatgtccagtaccctccttgccactggttctaaaattgtgttgtttacattctgaaatagtcagggctcctaacgagcatctgcttatgtggcttctctattactgttttgtggggttttttctgagacagggtcctgctctgtcacccaagctgaagtgcggtggtacaatcatagctcactgcaacctcgaactcctggcttcaagccatcctgcagcctcagcctcccaaagtgctgggattacaggtgtgagccactgcatctgggctgttgctgtatttgatgttaccatgtactacaacagtgccctcttattcagtttttttttttttttttcctgagacggagtctcgctctgtggcccaggctggagtgcagtggcgtgatctcggctcactgcaagctccgcctcccgggttcacgccattctcctgcctcggcctcccgagtatctgggactacaagcgcccgccaccgcgcctggctaatttctttttgtatttttagtagagacggggtttcaccgtgttagccaggatggtctcgatctcctgacctcgtgatctgccgcctcagcctcccaaagtgctgagattacaggcgtgagccaccgtgcccggccaaaaaaattttttttaaaggctgagcacagtggctcacgcctgtagtcccagcactttgggaggctgaggtaggtggatcacttgaggtctggagttcgagaccagcctggccaacatggtgaaaccccatctctactaaaaatacaaaaaattagccaagcgtggtggcaggtgcctgtaatcccaactacttgggaggctgaagcaggagaatggctttaccccaggggagggtgtggggtggaggttgcagtgagccaagattgtgccattgcattccagcctgggcaacaagagcgaaactctgtcttaaaaaaaaaaataggctggacgcagtggctcatgcctgtaatcctagcactttgggaggccgacgcgggtggatcacctgaggtcaggagtttgagaccagcctgcccaacagggtgaaatacaaaaattagccaaatgtgttggtgcatgcctgtaatcccagctactggggaggctgaggcaggagaatcacttgaacctgggggaagcagaggttgcagtgagccaagatcacgccattgcactccagcctggacaagagcaaaactccctctcaaaaaaaaaaaacaacaacatttaaaaaaatacaaaaattagctgggcgtggtgacaggtgcctgtaatcccagctactcaggaggctgaggcagcagaatcccttgaacccaggagacggaggttgcagtaaggagagattgtgccactgcactccagcctgggtgataagagtgagactctatccgaaaaacaaaacaaaaaaagggctgggcacggtagttcacacttgcaatcccagcactctgggaggccgaggcgggcggatcacgaggtcaagagatccacaccatcctggccaacaggtgaaaccccatctctactaaaaaatatatatatacatacaaaaattagctaggtgtggtggcgcgcacctgtagtcccagctagctagaaggccgaggcaggcaaatcacttgaacccgggaggtgggggttgcagtgagcagagatcgcgccactgcactctagcctggcgacagagcgagactgtctcaaaaaaaaaaaaaagaaaagaaaagaaaaaaagaaggatagcattgctttacacttttataaatctctttaatgtctagcctaatagaagaagctggattctcatatctcctgcattcagtctgttaggatatgcggttttgattaaagtctttaaagaaatttggccttacacagaaagaaggaaggagtattttaataactttttcagaaaactgtctattcttcattgatattacactaaagctcgacaaatgagtttcttaaaagttgctatgggccaggcgcggtggctcacgcctgcaatcccagcacttcgggaggctgaggcaggtggatcacttgaggtcaggagttcaagaccagtctcgctaacgtggtgaaatcccgtctctactaaaaatacaaaaattagccaggtgtggtggcaagcgcctgtaatcccagctactcaggaggctgaagcaggagaattgcgcaactgcactccagactagcaacagagcaagactccgcttcaaggaaaaacataaataaaagttgctatgtaggccaggtacggtggctcacatctgtaatcccagcactttgggaggctgaggtgggcgatcacaaggtcaggagtttgagaccagcctgaccaacatggagatacccagtctctactaaaaatacaaaaattagccgggtgtggtggcacgtgcctataatctcagctacttgggaggctgaggcaatagaattgcttgaacccgggaagcagaggttgcagtgacccaagatcgtgccactgtactccagcctgggcaacagagactccatctcaaaaaaaaaaaaaaagttgctatgtaggctgggcacagtggctcaacacctgtaatcccaacactttaggaggtcgtggtaggaggactgcctgagcctaggagttcaagaccaggaagatcccatctctggaaaaaaaaaaaaaaaacagctgggtgtggtggcacatgactgtggtcctaactactcgggaggcttatgaaggaggatcatttgagcccagaaggtgaggctgcactgagccgtgattacatcatcactgcactccagcctaggcaactgagggagaccacatcgtcaaaaaaaattaaaaataaaaaaaaaattgtaaagcctcatgccgggcatggtggctaatacctgtaatcccagcacttcgggaggccagggcgggtggatcacctgaggtcaggagttcaagaccagcctggccaacatggcgaaacccagactttattaaaactagaaaaaattacaccaggcgcagtggctaatgcctgtaatcccagcacttcgggaggctgaggcgggcggatcacgaggtcagaagttcgagaccagcctgaccaacatggtgaaaccccatctctactaaaaatgcaaaaattagctgggcatggaggcgcatgcctgtaatcccagctactcgggaggctgaggcaggagaatcgcttgaacccaggaggcggaggttgcagtgagcgagatcgcaccactgcactccagcctgggcgacagggaaagactccgtctcaaaaaaaaaaaaaaagaaaaaattaaccaggcgtggtggcaggcgcctgtaatcccagctactcgggaggctggggtaggagaatcgcttgaacccaggaggcggaggttgcagtcagcgagatcgcaccactgcactccagcctgggcgacagggcaagactccgtctcaaaaaaaaaaaaaaaaaagaaaaaaattaaccaggcgtggtggcgggtgcctgtaatcccagctactcgggaggctgaggcacgagaatgacttgaacccaggaggtggaggttgcagtgaactgagattgcgccactgcactccagcctaggcaacagcgagactccatctcaaaaaaaaaagcctcatgcatccttcctatttcatcacacagaaaagtaaaaatatgtgtaattaaaggtctagatttaatactcagtcatctgtactgcctcccctggacatgtgtagaactggtgggtctcagcccccagtgctggctaacagtggggaacacaactctggcagtgcaagtgtccacccagggcagaggccagtgatttttttttttttttttttttttagatggagtctcgctctgtcacccaggctggagtgcagtggcaaaatcttggctcactgcaacctccgcctcccaggttcaagccattctcctgcctcagcctcctgagtagctgggactacaggcgtgcgccaccacacccagctaatttttgtatttttaggagaggcggggtttcaccatgttggccaggctgatctggaactcccaacctcaggtgatccacccgccttggcctcctaaagtgctgggattacaggcgtgggccaccgcatctgaccttgtaacttctaaatatactgaaaaaggtatcggggaccctcagggtctgcaaacaactttgagaatagctgacaagcactgcctcaaatatttctaacaactcgtttacaggcaaggagaatgaggcctggagagcttaagagactggcccacggaggaagcaggagtcatctttccacaaaactacacttccccaaaagctgaactcttggacaaggagcccactgccaaacctaagagtaacaaatttcagcaaataaaaggaagtgccatttccaatggcatcctcgaatactctaagaggcggggctggcagaatccatcaacaggcctccagaggcctgctactaagagccagcaacgctgctgaaagcggcactgcctctgcaggctgtgtgaccaggacccggcgggggccctgcacctggaagcagagggggtcggtgggggaggggtgctaccaggaagcaagatgtgcatgctgcctgctgggggcatgaagtcaaagtcccctcctgcccaaagtggctaggccagccctaggctgccttatcagcatcaacacatgcctggaatgtgggactttggcaacaaccctctcccttcggccagcacggggctgacgcctggtccctgggctctggttcacagtcagaggacaaccaccttgaagcaccagaacccgcacccccagcccatctaccagaagacaatctaccaagagtcaccgagaggagctatcctgcctgtgtccccacaccaccaagggccgtgtctgagcacctcgtttgtccacactcagagaatctcaagagctcagctctggtccctgcaatgtccagaccatcccccacatggctctcctggaggtgttcggcaaaggcacaggctgccgtggggcagaagattcccacataccagacagtaaggagctgcgtgtgactggaaggatgaggacgacccagagaatgctctctggcccctggtccttggggaggaatgggggacctgcaggggaccaccttcccactctgggagccagattccctggctttgtccagagcagccaacccactaccccactcaaaatgaacacctcagctgccctccagcccaagcactgcgcagagtaaggagtcctcactcacaaatgtgtccgaggctttcacacacttcacctggagcttcgccactcacttcttagatgtacgactctgacttctctgagccacttgtacaacgaggactgacaagatgatgaggaccacaccggtgtgttctgacaactgaaccgggcatagaatgcccactgccaggctgagcccaggaacgagcccaggatgagtgcttaccctcttcaccactaccttcctagccttctgtcagaactccgtggggaccatcctcttcccatcttctaagccaagtaccctggtacaagccagacagaaactataatagcagctgcttccataaaggggaagggccatggggtcccggacagggctggggtgaaggggcacaagacctagggcaggaatccacccccagatcactcactcaggacaggaccacctggacccagctaccaagatgtgcaccacccccttccttctgagccccttttcccatctcctctactgcccctggccaggttgctgtcccacctctaagaggcaagatttcctacccaggatgctgaccaaaaccacacccaggggcctacccgtcccctcacatgataggctgctcctagctggcaggagccgtcttatagcctctctccctcaaatacaaacaaaaccccagaacaacctattgttctgttccagcaaagggggccaggcccagccaggccctacctgaagctctctgtctcccgtcccccttcagtcccctcccactcgtccttctctgcccctattagtggcctcatataccttgtccagataacacagcccaagaaaccaacctcagggacaaatctcttctcttccagggagaagaagacagaggtcccaggagtcccaggggcccccattactggccacctccgctcaacccaaactgcactatgtgaggtcccgccagactacatacaggccaacgagagcccaagaatgcagccaggaaaccaggccaggcagactccaaaagcccgtgctacggggtcagtaggacccgcctacagctgagggctataggcagctctccagaggacctcccaggagaagccaacagtgcacatgggctaggttcctcctgctgttcaccctctgtgcccagtaactacccaggaacaggcatgactgactctgccaactcattcactgggtaaccgctgaccccaccaggccctcggagtaaagcagttagtgagaaccgcaggtaaaagcgcgggctactcatccctccgcctgtggattctattatcaacaaagatgcatcacctgctagaagagcggttctcaaacttggctgcacatcaggttcacttcaaaagcttcaggaaaagctagtgccttgggcccaccccagagacaggtatagctcaaggtgagaaccagagcaccagcaggcaggcctctgccaggcagcatgggcaacgtgtgctgggtgaatgtgcggcctgcactcatcacccagaagagccccactgtgtccacacaaggacaggccaccgaagtcccagtccccactctcccttctcacttactttgtgaatgagagctcaccaacagtttaccgtcttccgagtgctgcggcctcaccgcccgacccgcagcaggggtgagggcttgcaaaggccatgcaacagatcctccccctcaaaggggctcaggcctcagtgtggtaatgggagcggccccttcccacacttgtcagagaacccacccacccggtggaatgaagccgaagcccaagccgcagggcaacagcccgggacggcaggggacaagtctgtacagcagccacacccctgccagagccaggagctcttccatttccacagcaggccaactctcacctggaagcacccacctaaccaaacccaatccctgccttcttttagtcacactgggaactgccacaggaaggctggggactccacatactccctcctcaccacaccccatgtgtgatcacccttaaacagaaaacatgcacctaagatcctacgatgcgctgcccacctcacaaaaaaccggtgcctctaggtaagagcacctagctgacccatccctgttccctctcaccattagaaggacccccaagtccccctgttctaacaccgaggctgcactcccactctccacccactaacattaccataaaaaataaattgaatagttagaaggaggggctccccaaagcctggccaccttcccgagggtcccaagcagtttcttggagtccctctccccactcagtcccgccacacccctctcaggcagtctggcccttccctcctgaactttggcgggctggaaccagctcccagcctctcctcccttatcaagctcactgggggcccacacagagctcccatccccaccagcttttctcgctttgccactcccagctaaaactgggctcaaggcaagcaagcctgcagtccctcagtccctcggggcccagcccctcctcagagccctcccccagcccaggtccctaacccttagggcaaggcccctcccagcaggaagcgaaccctggcggtgccaggcagagtcaaactggaagggctggttcagaagcccctaaatgggagccaggacctctcttagggagggggctttcagccccatcctccctagtgcgatctcagatctctccagacaccacactatatgggcctccacaggcggtggagtcaaaggcatttaccctccagcccccagcaagctacttaacttccaaaagcagctccttccctcctccagaggagaacgggccgcgtgctgaactgcaagcgcctctatcaccccgcccaggcaagtctgtgagcaccagaaagcaggggccaacatgacttggtctaaaccaagggggccaggcactgactttgcgctcagaaaatgtggcggaatgaataaaaagcttgaaaaagagccgcatacatgcctggctggcagtggggtctcccaagcgggcttcacagctcacacagtacccgtgggtccgcgtcctcagtgctctccagctgtctccactgccaccctctaccctaccactgccttttaaaacccagtagcagtcacttcctggttaaaacccctcccctccaggccaaccccaacccacatggcatccagggttctcagccagcccacggccggctcctcccacgccaccgctatgccctctgcgctccgctagatgccagcccttatcaccccatcttataatcatttgttgagtgtctgccttccctaggctgagctccagaaaacagcgatacatgaatgtaaactccagttctgttcccattgtagaaacgaggcaggagagtcaatcactgctcaaggtcatgacgggagtaaatggcagagccagcaatgcactacagactttgcgaccgaccaagtccagttcccctctcactgccccacaggggtccgtcctaggccaggctcggaggagacaagaagggaggaacccaatgtgttctttcttcccgcggtgaaagctgcctcccaggccagcaagagcagcccagaagaagtgccccactctcccagggatcaggtactgggggcagcgggcaggacaaggtatggggtggggctgactgctccaggccaacagaccaagcaataaggttggaaccacaagtcccctgggtaaactgaactttattccttcctcacggctctcactctccagaactgccccgccagctcttctccaggggctggctgctgattaaatggcacttccccacccctcagatctgaccccgcaaacaataaggacttgaggggaggcggcaggctatcagctcaataatgcaaaaccctgttgctcctcgtccacaacagctgacttcaagtggatgggaggctgcgcttattaacaaaatgagaaatctgatctacggaaagaaaacactacgtgaggattaatccgcgactgcagcttgtggagaaggctgggctgctggccaagaccaaggatcgaggatgggatcgtgcctacctgtccccagagcaggtatcatgcagcacaacaggactcatcacccctgccccacctgcgccttctcttctccttccagcaacttcgacaatcatttcggttttgctttaattaaaggcctgactccctcgggctgcttcttcctctacacagaggcagcaaccagagggagatttttcttttcaggaatcggtcgtaaaaactcagtgactaatctacaagttccaacaactggcagaaaaacaccgcagggagaggttgctgggcacacagcagcactcagagccaactgaccagagaagctgggccacaggcactctactacaacctccctcccccagcccgacactggcctgccgacccacctgagagctctgacctcccaaggcaggcagctggggagcctcttcccagccttccaagtctactgctcgtcctgtgggacccagagatcttcacagtctcaatggcacaagacggaacgttcacttccaggcaacaatcctgggccacaggactcagttcagcccccaagtatcagactcccggccctgttcttggtgttcagagcccactaaaccagcagtcttgccacacagctttgtctccagaggccagctcatctgctttttttcacactactccagcaaccctgctccaccaagcacgcacactctccttgacacagggctccagaccaaccacatggcctgtgctcctgaaaatgcctgcctgaaggcccagggagtccagacactggcagatgagaatggacgaaaagaagccaagccagaagccaggaagcaataaatgctagacccagaaaggccttaggtttgagtgacccagctccatccctccatcctggatccttggaggacagccccaagttcagcctaggagctcccaaggcccctccactacctgccagctctccgacagcacaagagacacagcaatcccacatcagtcaacaacccaccgccacaggattcctaggggcaaggctctgcccctccccccagcacatatgtcagaggggtggcttccctgggttacacccctcctgctgttgggggagtggggggtcggggaacacagctttccagatgtgcttggcaactcctactagaaaagactaggggtgcgggggacaggagaagacatggataaataactttaacaccgctccaacccatccggctcagcactgggctcccttacacaggcagtcccaggcagttctgggtggggccgttgggagcattatctggcctcattccctcctctcagcaagtcactgccccccagggagaggcattcccccccccccccaaccacgcacacacccaggcctgtgtgaatatgaaccatcttggaagataaacagagagtgacaagctggggcccctcagccccctccctcagccagccggtcccttccccctgaaagccgaccccctcccccaagcccatctctcttcctgccaagcggctgcctacaggagaggtctgggggcagggcagcgagcccaccagccgcagagcccggccctctgggagcggcccctccaggcccgcccctgcccctgccgtggccagtcttcccgcggggaggaggcaagaggagaggagaccgcagacggtgcaggaccgcagtcctggaaatcgcaaaatcctctagcgagggggcggccgcgggcgcagggccgtttgcataatgggagccctcccgcctgtcaggcagcgcagctcgcccgacgctgttcggattagattgctaatgaaaaggcacaaagagccggcgcccgctcgcccgccgacccccgctccgcagacccgcgccgcctgggcctggcgcggcccggtgggctttgtgccccgggtgccccaccgcccgcgcccctccgggcatctggcccacaaagcccgggcctgccaggggtcccgcgtgcgccccagcccaggcccgccagacgctagcgcgtcccccacgcgcgcagtcccacgtcgcccgggcgcgcgcgcgtccacgcccctctccccggggacgcgcccagcccgcggccccggcccccgcccgctccccgcgacccccgccccccaaggccgcccctcacctcgtgtgcgtcggcggcggcgctccgcccgccggccggccggccctaccagcggcccttgtcctcagcgcccggctcgcgccgcacgcgcccgccccgtccgcctgccgccagcccggctcggctccccgcctagcgcgccccgagcgccgctcacagccgcccgcccagcgccatcttggaagcttgtgacgtcggcgccgcccgctcacccctgacccacatctgaatgggcgagcggcggggcggggacagggggcagctgggggcgtggcctgtgaacaggggcggggcctcgggggcggggccgggccggacagcggtcccagcactaggcgggcgggctgccggggtccggcgccgtggggaaggggtgcgcgggaggagacggggacccagaccccggacatctaaccggactccgacctcaagcgccagggcaggaccgcgacctcgcccctgaaatacccgaaccgcataccggcccccgggacagggaccctggccccccccgacaggctgacgcccaccccctcaaactctggtggacttacccccttttagccctaccctgacccctaggagccccgaattagggacctctatcggcctacgcgccccctccccgacccctttgcgacccctgctcgacgctccctgcggttgcccgaggctcaaaggcgcagccagcagtgactgcaagctcgggggtctgggctcctggggaagcccgggctggttgggtgcaaaagagaaggggcgcccctcccgtgaccccagcgcccctcgggcccccgcgggcgcacccccgcgaaccctacctgctccgagggcgcggaggacccagcacgctgcgctcagccagccccttccggtggccgcagcccctcgcaggccccaggggtcaagcgcctgcccgagccggcccaccaggacccgggctcccggccgccatgcagatagccttcccaggggctgggctggcctgagccgccactgcttctctagggagctagttaatggacctctctctactttgaacaccaaacaaaggaacacaccgctatcgaggtcgcccaagtccaagaggagcccaggtctgccttacagggaagttgtgccccagctccagtcaagatcaaaaaccagtttcaataacccttcgccaagctgatgatgcaacctttctttcctaatggatgtataggtttaatgtcatcctaacaacatttcttagacttcacaaaattctaagttcacctggaaaaataaatagccgaaaacagctatggttttccccccttgggaacaaaagcaggcatgagggtagacttgccctaacagatatcaaaacaaattgtaaagctaccgcaggcatttcagtgtggtacagaacaggaaatagaatagaaagcctagaaacatcctagaaatggtaagaacacaatagatgaaaaaggaaatatcaaacatctgtggaaaaaaaagagctatcaaacatccctgaagaagaacaagaatattccacaaatagagcctagcagaggactcactatttgaaggaacgactgaaaaaaaaagtcaaccattctactaacccaagacatataaattaaaactataggccgggcgcggtggctcacgcctgtaatcccagcactttgggaggccaaggcgggcggatcacgaggtcaggagatcgagaccatcctggctaacacggtgacaccccgtctgtactaaaaatacaaaaaattagccaggcgaggtggcgggcgcttgtagtcccagctactcgggaggctgaggcaggagaatggcgtgaaccccggggggcggagcctgcagtgagccgagatcgtgccactgcactccaacctgcgcgacagcgagactccgtctcaaaaaaataaataaataaataaaataaaactataagaagctgggttttctcctaaacaaattaaaaatcagtttcaagtgataaccttcaaacacaaggtctgataggtaatcactctcatatacttttggaagcacataaatcacctcaaaattcctggacatgagtttggcggtatgagccaaaagttgtttttttggggttcttttgtctttttttgttttttggagactcggagtctcactctgttgcccaggctggagtgtagcctcaaactcctgggatcaagtgatcctcctgccttccaaagtgctgggattacaggcataagccaacgcacctggccccaaaaatattttaaaataattataccctctcagaccagtattccaggattctgttctggggaaattagccacgtttgcagaccacgtacttattatctgtctctctacccataagtaagtttgtacctgtaagtttggaacccatgcctaggagcacacctgagacaacaggcattccacggtcccttgtttcatctgcatttgaaaactaatgtggctggctcatgcctgtaatcccaacactttgggaggccaaggccggcagatcgcctgaggtcaggactttgagaccaccctggccaacatggtgaaaccccgtctctactaaaaatacaaaaattagccggatatcgcggtgcatgcctgtagtcccaattactcgggaggctgagacaggagaattgcttgaatctgggaggctgaggttgcagtgagctgagatcatgccatgacactccagcctgggcaacagagggagactcggtctcaaaaaacaacaaaaaagataactaatatatgataatattttttaagtgtcatgtataatagtgaaagaaagcatatacaggcggtggctcacgcctgtaatcccagcactttgggaggctgaggcgggaggatcacctgaggtcaggagtttgagaccagcctggccaacatggtaaaaccccgtttctactgaaaatacaaaattagctgggcatggtggcgtatgcctgtaatcccagctacttgggaggctgaggcaggagaattgcttgaactccagaggcggaggttgcagtgagctgagatcctgccattgcactccagcctgggcaacagagcaagactccgtatcaaaaaaaaaaaagaaaaaagcatatacaaatttctcacaatggggttaaatagtccacataatggaatgtagattaggccaggagtagtggctcatgcctgtaatcccaacactttgggaggccgaggcgggcagatcacctgaggtcgggagttcgagaccagcctgaccattatggtgaaaccccgtccctactaaaaatacgaaaagttagctgggcgtgattgcgcatgcctgtaatcccagctactcgggaggctgaggtaggagacttgcttgaacccgggaggcggagattgcggtgagctgagatcgcaccattgcactccagcctgggcaacaaaagtgaaactccgtctcaaaaaaaaaattagccaagcatggtgtcacatgcctgtagtcccagccactcagcaggctgaggcgcagcacgagagttgcttgaacctgggaggcagaggttgcagtgagccgaggtggtgccactgcactccagcctgggcgacagagtgggactccattttaaaaaaataaataggccaggcgcggtggctcacgcctgtaatcccagcactttgggaggcccaggcaggtggatcacgaggtgaggagttcaacaccagcctggccaagatggtgaaaccccgtctctactaaaaatacaaaaattagccaggcatggtgacgggcacctgtaatcccagctattcgggaggctgaggcagagaatcgcttgaactcaggaggcggaggttgcagtgagcccagatcacaccactgcactccagtctgggcgacagagtgagactcggtctcagaaaataaataaattaataaataaataaattaaattagtaggatgggcacggtggctcactcctgtaatcccagcactttgggaggccgaggcgggtagatcacccaaggtcagaagtttgagaccagcctggccaacatggtaaaagcccgtctctactaaaaatacaagattagccaggcatggtgacgtatgcctgtaatcccagctacttgggaggctgaggcaggagaattgcttgagctccagaggcggaggttgcagtgagctgagatcctgccattgcactccagcctgggtgacaagagtgaaactccgtctccaataataataataataataataataaagtaaatttttaattaaaaaataaaatttttatttatttatttattgagacagagtctcactctgtcatccaggctggagtgcagtggcatcatctcagcttgctgcaacctctgcctcccaggttcaagcaattctctgcctcagcctcctgagtagctgggattacaggcgcccaccaccacacccagctaatttttgtatttctagtacagacggggtttcaccatcttggcaaggctggtctggacctcttgacctcatgatctacccgcgttggcctcccaaagtgctgggattacaggcgtgagccactgcgcccagccaaaaataatttaaaaaaaaaaaaaaaagaagaggccaggtgcagtggctcacgcctgtaatcccagcactttggaagactgaggcaggaggatcacttgaggtcaggagttcgataccagcctggccaacatggtgaaaccccatctctactaaaaatacacacaaaaatattagccaggcatggtggcacacccctgtagtcccagctactcgggggactgaggcaggaggatcacttgaacccaggaggtggacgtttcagtgaaccaaaatcacaccactgcacactccagcctggtcaacagagctagaccctgtcttaaaaaaaattgtattttttgtacaaaaaaattagccgggcctggtggcagatgcctgtagtcccagctactcaggaggctgaggcaggagaatggcgtgaaaacctgggaggcggagcttgcagtgagccaagattacgccactgcactccagcctgggcgacagagcgagattccgcctcaaaaaaaaatttttttttaattgcattttttaaatgcatgcaaaaatattgatatatggaaaagcaactgaagaaaataaatcaaaaatatttacggaggttctctctggaagttgggaattttttttctacacatgtatactttagcgtgtgtgttatttttattttatgaaagtaacatttctaatcggaacaattctagagatgctgaagcacattttatttttattttattatttatttttgagacagagtctagctctgttgcccaggctggagcacagtggcgtgattatggcccactgcagcctccacttcctaggctcaagtgattctcccagctgggactacaggcatgcaccaccacacccggctaattttttattttctgtagagacagggtctcactatgcttcccaggctgaactcaaactcccagactcaagcaattctcccacctcagcctcccaaagtgctgggattacaagcatgagacaccatgcccggtaattttttttttttttttgtgcagatggagtctcgcgctgtcacccaggctggagtgcagaggcgcgatctccgttcattgcaacctccgactcccgggttcaagcgattctcctgcctcggcctcccaagtagctgggattacaagtgagcaccgccacaccaagctaatttttgtagttttagtagagatggggtttcaccatgttgccagggttgtctcgatctattgacctcgtgatctgcccacctcggcctcccaaagtgctgggattaccggcgtgggccaccgtgcccagcccatgcccagcaattttttaaagttaaattctccctcctcctccaccctaatcagtcctttctgaagtaacattaacagtttaactctcttctctgacatcaatatgtatctactcaccttacaaaaaagatcctactattttgaaatcatagacatttttctagttcatttccataattcattcttttttttttttttcatgtcagacgggtaatgtgcctatgtcgtaacaagatttgaaggtggcggccgggcgcggtggctcacgcctgtaatcgcagcactttgggaggccaaggcgggcggatcacgagttcaggagattgagaccatcctggctaacacagcgaaaccccatctctactgaaaatacaaaaaaattagccgggcgtggtggcgggtgcctgtagtcccagctactcaggaggctgaggcaggagaatggcatgaacccgggaggcggagcttgcagtgagccaagatcgcgccactgcactccagcctgggtgacggagcaagactccctcttaaaaaaaaaaaaaaaaatatttgaaggtggcacatcttacatgggaacgtgtgtgaacacataatcatcatgcttatgaactacaaaaggatcataattcattctttaagagctgacaaatgttccagagtatggagcttctgtaatttattcacacttcgttaaccatggttgttcagtttatttacagtgtggtgctttttgttttcttttttctttgttctttttttttttttttttttttgagatggagtcttgctcctgtcacccaggctagagcgcaatggcacaatctttgctcactgcaacctccacctcccgggttcaagcaattctcctgcctcggcctcctaagtagctgggattacaggtatctgccaccatgcctggctaatttttgtatttttcgtagagacggggtttcaccatgttggccaggctggtcttgaactcctgacctcaagtgatccacccgcctcagcctccctaaatgctgggattacaggtgtgagccaccgcacccagcctacactgtggtgctattaaaaaatatttttaggctgggcacagtggctcacacctctaatcccagcactttgggaggccgaggcaggtggatcacttgaggccaggagtttgagaccagcctggtgatcatgaagaaaccctgtctctactaaaatattagccaggcatggtgtcacatacggataatcccagctactcgggagtctgaggtgggagaatcacttgaactagggaggcagacgttgcagtgagttgagatcatgccactgcaccccaggctggacaacagagcgagacctcgtcttaaagtaattaattaattaattaattaattaattaatataaataaaatagcagatttcaaaaatttgttctccctggcagcaacccagtaaagctagatctgggcggaaggtaatatggaaatataaaaactacagattagcagggatgggaagacccgccagaaatgggttcattttgtgtcctcactccctccggattctctgtgtgtctagtccaagatctaaccactatgatctgctttcctcatccatttgggaatcagggcaccacccccttgggaggcttgaatgacatgaggttgagcaggcagagcacggaactcaggctctggtgagccctggtacagtgactatgattgttgtgtcatgtaggaagggtctgttattttaccattatctgttttcaataaaaaacagaaagaaaacaaatatacaaaatacccccaaacagtaaatttcagcttcttactatgacagctagatttagcatttaacagtatgcccaaatttgaatttcggataaacaaccaataatgcttaatataagtatgtcccggccgggcgcggtggctcacgcctgtaatcccagccctttgggaggccgaggcgggcggatcacgaggtcaggagatcaagaccatcctggctaacacggtgaaaccccgtctctactaaaaatacaaaaaattagccgggcgcggtggcgggcgcctgtagtcccagctactcgggaggctgaggcaggagaatggcgtgaaccccaggaggcggagcctgcagtgagctgagatcgtgccactgcactccagcctgggtgacagcgagactccgtctcaaaaaaaaaaaaaaaagtatgtcccatacaatatcacttctcaccttcccatatcccaagctcaagacaccttatatacgccatgatttctcctgccatctctgggcattcacaccagggctcctcctgtccaggccagccttctcccttctcccacctgtgcctggtgaacaactcagttcagacatcatctcttgtaggaagtctcctgtgatcccaggctaatcaccctgatacagtcctgaaatactgctgagcagttggcatgagggcaggaaggcttggtcttgttcactcttgtatccagcttatacatggcacaaagtaggttctcaattaaaagtcaaatgaggggccaggtgcagtggctcacgcctgtaatcccagcactttaggaggccaaggcgggtagatcacctgaggttgggagttcgagaccagcctggccagcatggtgaaaccccatctctactaaaagtacaaaaattagccagacgtggtggcaggcacctgtaattccagctactcgggaagctgaggcaggagaatcacttgaacccgggagggagaggttgcagtgagccaagattgcgccattgcactccagcctgggcaacagagcaagactccatctcaaaaaaaaaaaaaaagtcaaatgaagtcgggcacagtggttcgcgcctgtaatcccagcactttgggagactgaggcaggaggatcacctgaggtcaggagttcgagaccagcctggccagcatatgaaatcctgtctccactaaaaatacaaaaaaaaaaaaaaaaaaaatagctgggtgtggtaatgcacgcctgtaatcccagctatttgggaagccgaggcaggagaattgcttgaacccgggacacagaggtaacagtgaggtgagatcatgcaactgcactccagcctgggctacagagcaagactctgtctcaaaaaaaaaaaaaaaaagtcaaatgagaccactcatggtagctggcgcctataatcccagcactctgggaagccaaggcgggaggattgcttgagtccaggagtttgataccagcctgggcaaaacagtgacatctcatctctacaaaaaatttttaaaattagccgggcatggtggcactcgtctatagtactagctacttgggaggctgaggtgggaggattgcttgagcccaagaattcgaggttgcagtgagctatacttgcgccattgtactatagctgggcaacagccagacgcggcctcaaaaaaaaaaaaattttagccgggcttggtggcatgtacctatagtcccagctactcagaagctaagacaggaggatcatttgagcccaggaatttgacgctgcagtaagccaaggtcacaccactgcactcccgcctgggagactgagtgagaccctgagtctaaaacaaataataataaaaacgaaaatgaaagtcaaatgaatgaggccaggggtggtggctcatgcctgtaatcctagcactttggaaggctgaggtgggtgggtcagctgagccctggagttacagaccagcctgggcaacatggcgaaaccctgtctctacaaatacaaaaaagaaaaaagccaggcccatggtggtgagtgcttgaagtcccagctactcaggagggtgaggtgggagaatagcttgagctcaggaggtcaaggctgcagtgagctgagattgcatcactgcagcctagccatgatgacagggcaagacccagtagaaaaccaaggttagagaggttaagtcacctgcccaaggtccgtagctaacctcagactccagcccctcagactgacatgagctcagttcaccctcttaggaacaccatctgaagaatgcatccccagcaagcctattccctatagcaaaggccaggcctgtgatgggtgccccgctcctcaccacacacctccctgtcaagtcaccactccttcacccctagcagagccaggcaccttgagcccaagggaggccactcatggaactgtcattcaaccaacagatgctgacagcaatgatgaggtgggcactgggctagtgaacagcacagatgtgttccctggcctcagaagcccacagactaaggagaagacgacagaatactcacaagggtgctggggctgggcaaaaaggtgcaggctgctttgtctggtcataagaggggaactgacttccctggtctgaggagccaaggaaggggccgtgcccttgccatgccctctgcctgccatgccttgctgttcttcagtgcctgctctaaggtcactcctagtgtggttttctctggctgctctttttttttttttttttttttgagacagagtctcgctttgtcacccaggctggagtgcagtggcaccatcttggctcacagcaacctccgcctcctgagttcaagtaattctcctgtctcagcctcctgagtagctgggactacaggtgtgcaccactacgcccagctaatttgtgtatttttagtagagacggggtttcaccatattggttggccaggatggtctcaatctcttgacctccagatcaactccccttggcctcccaaagtgctgggattacaggcgtgagccaccgcgcccggccactttttttttggagtctcgctctgtcccccaggctggagtgcagtggcgcgatttcggctgactgccagctccgcctcccgggttcacgccattctcccacctcagcctcccgagtagctgggactacaggcgcccgccaccacgcctggctaattttttgtatttttagtagagacggggtttcaccctgttagccaggatggtcttgatctcctgaccttgtgatccgcccgcctcggccttccaaagtgctgggattacaggcttgagccaccacgcctggcctctttttcttttttgttgagacagattctcactctgtcgcccccaggctggagtgcaatggcgcaatcttggctcattgcaaccttggcctcctgggttcaagcaattctctgcctcaagcctcccgagtagctgagattacaggcgcccaccaccacacccggctcatttttgtgtttttagtagagacagggtttcaccatcttggccagactggtcttaaactcctgacttcgtgatctaccagcctcggcctcccaaagcgctgggattacaggcttgagccaccgcacctggccatgctctttcttttttatttgtatttttatctgtttcttagagacagggtctcactctgtcatccaggctggagtgcagtagtgtaatcataacccactgcagcctcaaactcatgggctcaagggatcctcctgcctcagtctcccaagcagctgggactacaggtgtgcaccactatgcccagctattttttttttttttgagacagagtctcgctctgtcgcccaggctggagtgcagtggtgccatctcggctcactgcaacctctgcctcctgggttcaagtgattctctgcctcaacctcctcagtagctggattacaggtacctaccaccatgccaagctaatttttgtatttttttttttttttgagatggagtcttgctctgtcacccaggctggagtgcagtggcgcaatctcggctcactgcaagctccacctctcaggttcacgccattctcctgcctcagcctcccgagtagctgggactacaggtgtccgccaccatgcccggctaatattttgtatttttagtagagacggggtttcaccgtgttagccaggatggtctcaatctcctgacctcgtgatccgctggcctcggcctcccaaagtgctgagattacaggcgtgagccaccgtgctcggcctaatttttgtattttcagtagagacacggtttcaccatcttggccaggccggtcctgaactcttgacctcatgatccaccggcctcggcctcccaaagtgttggggttatagacgtgagccaccgtgtctggcctggctccactttcttagggagctttgcttgccctctgcttggggtagtttgtgaattcagtgctctctctctcccaggtcctgggtctcctgctcctgatcaatctgccacgtgccatttgatctcagagttgtctccaccattagactggcagggtctgtcttctggggtctgtgtgtaggatacagtggccccaggatgggtaaaggaggggacccagttgttcttctgtgataggtggagacaagggccagcagggctgtttctcggtgaaacccatggggagatagtcgaaccaggaaccaaatccggccgggcgcggtggctcacgcctgtaatcccagcactttaggaggccgaggtgggcggatcacctgagttcgggagttggagaccagcctgaccaatatggtgaaaccccatctctactaaaaaaaaatatatacatatatatacaaaattagcctggcgtggtggcacatgcctgtaatcccagctactcgggaggctgaggcaagagaatcacttgaaactgggaggcagaggttgcggtgagccaagatcgcaccattacactccagcctgggtgacagagactcagtctccaaaaaaaaaagtccaaaaattaaaaaaaaaaaaaatgccgaactcagtggctcacgcctatgatcctaccactttcagaggccgaggcgggcacggtggcgcgtacctgtaatcccagctactccggaggctgaggcagaagaatcacttgaacccgggaggcagaggttgcagtgcgctgagatcgtgccactacactccagtgtggtgacagagcgagacttggtctcaaaaaaaaaaaaaagtcctggctgtgccactaggccagacgccctagaactgacttctatggacctcagttttcatacctgtgaaatggaactcagagccatatctacttcattgggttgtgtgaatgtgaggtagttacaggatggagcaggcagaaggtcagcacagcctcagtggttggaggagtgggggtcaagtggacagagagggtaccccagggccagaggtagaggcaaggtgaagcaatgcttcatttccctgctgaggttcctctctagcagtttggaggtggggcaggagtggagaaaacacatcccctcctcaatatgggctgaggaacagggttcttgaggcaccaagaacctctttggggctctggcttgcctcctgtagtgaaagggatgggctgtgtgcaatgaactcacacctgtaatcccaacactttgggagacagagtcaggaggtccagaacagcctaggcaacatagcaagaccttgtttctacaaaaaactttttaaaaaattagccaggcgtggtggtggcacctgtagtcccagctacttgggaggctgaggtgggaggattgcttgagcctggagaggttgaggctgaagtgagctatgatagcaccactgtactccaacctgggcaacagagtgaaaccctgtgtctaaaataaaaagagggcctggcgtggtggctcacgcctgtaatcccagcactttaggaggccgaggcaggcagatcactcgaggtcaggagttcgagaccagcctggccaacatggtgaaactctgtctctacagaagtacaaaaattagtcgggcgtggtggcaggcgcctgtaatcccagctgcttgggaggctgacctgggagaatctctcgaacctgggaggcagaggttgcagtgagctgagatcacaccattgcactgcagcctgggcaacaagagcgaaactccgtctcaaaaaaaaaaacaaacaaataataaaataataataataataataataataataataataataataaagagggtgggagtggaccaaggcctaatggcatggaatttgcaaactttatcttcctagttttctctggggagccttcctccatcaccagggcccagcagggcctcagatggcggggggtggggcgggggctacacatatccctcatggccaagatgctaggaagcccctgagctggggcaacagcctctggtcacagtcatgagggaggctgggtgcagtagcgcttatcttgcctgaccttgtggagactgaccactccctccttctggaaaacgttgccccctgccctctccaaggcctcctccttcttacatcccctggtcctggctagggcctcagcacccaattctactccttgacccaccaccctgtggtgcttttgccgggccccagcccacagccatctgccaaacacctccccctggagtccctgcggcgtctctgactcagcaggtctgtgcctgcccctgctgttccccccacccagtggctctgcagagcaccctgttgcccaagccctgagtactggccactcccagggcctcgccttcccccaccaccagcaccaccaatttgaattcctatctctccctctggcctcctccctagacccaggccctgccccagggtgggggaaggaatcctacagataagggcattggtcaaagggacacacctgggttcgggcccccagctctgcccccaacctgctaaatgaccacacccctctccaaatctgagttattccctatgtaaaagggggaaataattaaactagctgggtatgctgtgctgagcaatatgtgagctcaggaaaggtcagttttccaggggaagtatggccgctgagagcctcagtctagtgcttctcattcacgagctggttggtgcctttcctaagttggaaatgggttagtccacaaatcccgttgcctggtccatgccaggtccaggtacctgcattcagggtgcagggtggagtaagacagtctgaagggtgaggtagcaggatgaatgagtaattcctgggtgcgttttgggattatgcctaagggctgtccgagcacgtgggaggggtagctaaatcctgtaagggaggggagaatggggaaggctgcctgcaagaggtggtggagggtgctttcaaaggatacctgggagtgagctggctgtaggcacagggcagctggaaggccaattttagggaagaggaaattgaggctgaaagtcaaaaaacaaaggaactgcctgaggtctctcaactgagaagtgagtgggccagggttcacattcagcccccactccattctcaggctgggcaggaaggtactttgccctcaggagggcaccttcgacccaaagcaccctgaccaagaggctgtgcaccgtggcaaccctaagactgaggcccaggtcctggagttccaccaaggtaggtacaaccagccaggccgtcagtgacaggaggatttactggggcttctagggaccccgtgaaagggcaaaaagacggcacagaagcctgtggatatcagatatagatagtgagggctagggctttatggggagggtggatgggccctgtgggcgggggatgtttaggagatcttccaaacagagcattccagcctgggggaacaacccattatagaccccacccagcaccgaagacagggacaggtggggctgagcctggaggctggcaggacctgtgcggccggctgcggtgtcagcaatgccaccgtgtgtggaaccctctgtgcctaggttcctggagccagctccacctggcaatgtgctttgtttcacaagactagagttggcccatcttgttccgcctcagatggaacacctgacctcctgcacaccccacccagcctccaaattcaaccaccccagtagtgagacagggagagtagggtgtgaccagaaggtggaatgagcttaaaataggctgcagagatatctctgagcttttaaaaagtcgtatctttcatatcgtgttcttgtgaaatcttctccagattttttacaatgactctgaaattgatcagttagcctcatgctttcaaaatccatagccgcagtgagcgagagggggcaggtcagctagaggtggagggggcagatgggccagaggcgcctgggcaggggtggatggggcctggacaggcttagtgacccttgcaccagaactctccggacaccgccccttcgcccactcgttaggctcctctgccttcgggccggctgggctgcccatcccccctcgttcccctcctgggcaggtctggactggacaggttttgggcctccaggtcgtgcagtcagtcagggaaggggcctggtgcaggccacagccaggcatccacctccttcccagcccacccctaccccccagcagcctgccaacttgctagacctgtgcggccttcccttctgctgaaagtctccagattctcagggctctgcacggggagccaagctggggcttagaactgtgctcccttgcccccacccccgacctgtgccctcatcagctttctttttttttcttttttctttttttttttgagacacagtctcgctctgtcgcccaggctggagtgcagtggtgcgatctcagctcactgcaacctctgcttcccgggttcaagcaattctcctgcctcagcctcctgagtagctgggagtataggtgcgtgccaccacaccccgctaattttttgtatttttagtagagacggggtttcaccgtgttggccaggatggtctccatctcctgacttggtgatccacccgcctcggcctcccaaagtgccgggattacaggcgtgagccaccgcgcccggcctattttaaattttttttgtagagacagagtctcaccatgttgcctaggcttgtctcgaactcctggtcgcaagtgatcctcccctctctgcctccgccgtagctgggattgcaggcacaagccatgacgccccccttctcatcagctgtctgggtctttctcggggtcctgacaccaggccaagtgttctgcacacctgacctgctcaaaacaaaaccagttctgccacagtctgggaaaatgaggctcagagaggccttgcagctgtctgtgagcaggctggcatttggatccagtgactgggttctggagcccagtggctctgtggccctgcctctccagccttatgcttctttaaaactgcccatggcctctgaagttgaggatttaggggagcagggctgccagaggggtgaagaaggagatctttctgtgggtgggtgtcagaatgaccaggcctgacactggtccctgctcccctggaaggacagcccctctcggttatgtggggggtgggctgcctagggtgctctggggagaagggagggagagaatggggctggtcgggtggggtgtggattccaggcctgcttggtcaaaaagatacagtatttcctattcccccttacactgggcaggcaggtgtggcccaggcagctctgccaggtgtgcagcccctggagaatgaccctaaagtgcacctaggctgccccctggcggcagcatgaggtcctcctccctggacttgtaaccctcccagggggaggaggtccacaccagctgatgggttggcacctgtccccagtccctttcttctttcctgtgccactgctcccagagttgcccaaaacacacgatcaggtgcagtggcttgaacgaaaccctgtctctacggaaaatacaaaaattagccaggcatgttggctcatgcctacagtcccagctacttgggaggtttaggtgggaggatcgacagcccaggaagtcaaggccgcagtgagcagtgagctgtggttgcgccactgtactccatactgtagcctgggtgacagagtgagaccttgtcttttttttttttttttttttgagacggagtctcactgtgtcatccaggctggagtgcagtggcgcgatcggctcactgcaagctccgcctcccggattcatgctattctcctgcctcagcctcccgagtagctgggactataggcgcccctcagcctcctgagtagctgggactacaggcgcccgctaccacgcctggctaatttttttgtatttttagtagagacggggtttcactgtgttagccaggatggtctcgatctgctgacctcgtgatccacccgcctcggcttcccaaagtgctaggattacaggcgtgagccactgagcctggccgagaccttgtcttaattaaaaaaaaaaaaaaaaagataaaaacctaggtaacatgctggggggtgatgagggttatggaggaaaataaaacaggtgggggctggagtgaagagtgggggtgcccctcataactctgacaaagactacaacgcagctgtcagaaaaaaagctgatttgaggcaatggtcagggaaagttgtgaaattaagtaaaaagtgatggaacaggctaggtgggaagtggtggctcacaccaataatccaagtgctttgaaaggccaagcaggaggatctcttgaggccaggtgtttgagatcagcctgggcaacatagcaagaccctgtctttacaaaaaatgtaaaaattagctggaggctaggctcagtggctcatgcctgtagggaggccaaggtaggtgaattgcttgagcccaggaatttgagaccagcttgggcaacatggcaaaattccatctgtacaaaaaaattgccaggcatggtggctcatgcctgtaatcctaacacttagggaggccaaagtgggcagattacccgaggtcaggagtttgagaccaccctggccaacatggtgaaacctcgtctctactaaaaatacaaaaattagctgggcgtggtggcgcatgcctgtaatcccagctactcgggaggctgaagcaagagaattgcttgagcctgggagacagaggttgcagtgagcctagatcgtgctactgcactccagcctgtgtgacagagcaagactatgtttcaaaaaaaaaagaaaaattagctaggtgtggtgacatgcacctgtagtcccagttactcaggaggctgaggtgagaggatcacttgagcccaggaagttgaggctatgatcgtgctactgcattccagcctgggtgacagccagattctgtctcaaaaatcaaaacacaacagggcacagtggctcactttggccttccaaagtgctgggattacaggtctgcaccaccatgcctggcctgagagtgcatgaattaaagtttctattctcttgctagtctgtcattgcttccctagtgtgtgggaaccatacttgtccccacttctcagtcagagagcagcctgccaacctccaagtctcttgcccctgacccaaaaggtcccaggctgtcctctcggcagaagcagctgtcttgtggcttactgtgctcagactccatttctaggctgtgggctcatcagggatctagtgctttgaaaaagtgtaaaggagagcagcagtattattcacaatagctaaaaggtagaaacgaccaaagtatccattgacagatgaatggataaacaaaatgcattacatacacacaatggactattattcagccttaaaaaggaaggaggccaggtgtggtggctcacacctataatcccagcgctttgggagactgaggcaggcgaatcacttgaagccaggagttggaaaccagcacagacagcatggggaaaccccctctctactgaaaatacaaaagttagccaggtgtggtggcacatgcctataatcccagctactctggaggccaaggcatgagaatcgcttgaacctaggaggtggaggttgcagtgagccaagatcatgccactgcactccagcccgggtgacagagtgagacactgtctcaaacaaacaaacaaaaaaaaagaaacgtgtggtggaagaagggaagaaaattggccaggcacactctggtaggggatggttggatgatgaaatacagacaatagaaaaacctagataaagacctggcgtaatggctcatgcttgtaatcccagcactttgggaggctgaggcggaaggatctcttgaggccaggagtttgagaccatcctggtaaatatagtgagaccccagtctcttaaaaaataataattggctaggcgcgatggctcacgcctataatcccagcactttgggaggccaaggcgggcggatcacctgaggtcgggagttcgataccagtctggccaacatggagaaaccccatctctgctaaaaatacaaaattagctgggcgcggtggtgtgtgcctgtaatcccagctactcgggaggctaaggcaggagaatcgcttgaacctgcaaggtgaggttgcagtaagctgagattgtgccgttgcactccagcccaggcaacaagagtgaaactccatctccaaaaaataaaaataaaaataaaaataaaaaagaaataggccgggtgcagtggctcacgcctataatcctagcactttgggaggccaaggtgggggcggggtggatcacttgaggtcagaagttcgagaccagcctggccaacatggtgaaacccaatctccactaaaaacacaaaaaattagccgagcatggtggtgggcacctgtaatcccagctactcgagaggctgaggcaggagaatggcttgaacctgggaggcggaggttgcagtgagccaagatcaccccactgtactccagcctgggtgacagagtgaaactgtctcaaaaaataaataaataaataaataaaacttttaaaaagtaagaagaagaagaaaaaaaatatatggaaattaaaaaacaagaaaaaaataataggccaggtgcagtggctcatgcctgtaatcccagcactttgagaggccgaggtgggcggatcatgatgtcaggagttcaagaccagcctggccaacatagtgagacctcgtcgctactaaaaatagaaaaaaattagccaggcgtggtggcgggcacctgtaatcccagctacttgggaggctgaggcaggagaatcacttgaacccatgaggcggaggttgcagtgagccgagattacgccattgcactccagcccgggtgacagtgcgagactccatcaaaaaaaaaaataaataaaataaataaatattaataataattttaaacaattaaaaaatatgggatttttttgagacagagtctcactctgtcgcccaggctggagtgcagtggcatgatgtcagctcactgcaacctccgcctcctgggttcaagtgattcttctgcctcagcctcccaagtagctgggactacaggcacgcgccaccacgcccagctaatttttgtatttttagtagagacagggtttcaccatattggccaagctggtctggaactcctaaccttgtgatccacccgcctcggcctcccaaagtgctggaactataggtgtgagccactgcacccggccaaaaaatatgttttttaaaataatagagatgaggccgggtgtggtggctcacacctgtaatctcagcactttgggaggccaaggtgggtggatcacttgaggtcaggagttcgagaccagtctgggcaacatggtgaaaccctgcctctactaaaaatacaaacctgagctgggcatggtgacgcatgcctctagttccagctactcgagaggctgaagcaagagaatcgcttgaacccgggaggcggagactgcagtgagccaagatagcaccactgcactccagcctgggagacagagcaagaccctgtctcaaaaaataaaataaataaaataaaataaaataaaataaaataaaataaaataaaataaaataaaataaaaaataaaataaaataaaataaaataaaataaataaaatagatgaaggccaggtgcagtggctcacgcctgtaatcccaacactttgggaggccaaggcaggcagatcacctgagttcaggagttagagagcatcctggccaacatggtgaaaccctgtctgtactaaaaatacaaaaaaattagccaggcattgtggcgggcggccaataatcctggctacttgggaggctgaggcaggagaatcacttgaacctgggaggcggaggttgcagtgagccaagatggtactactgcactccagcctgggtgacagagcaagactctgtctcaaaataataataataggccgggcacggtggctcacacctgtaatcccagcactttgggaggccgaggcgggcagatcacaaggtcaggagatcgagaccatactggctaacatggtgaaaccctgtctctactaaaaatacaaaaaattagccgggtgtgctggtgggcgcctgtagtcccagctacttgggaggctgaggcaggacaatggcgtgaacccggtaggcggagcttgcagtgagccaagatcgtgccattgcactccagcctgggcgacagagcgaaactccacctcaaaaaataataataaaataaaataaaaataaaaataataataatagagatgaggttttgccatgttacccatgctggtctccaactccttggctcaagtgatccatccaccttggccttccaaagtgctggaactacaggcttgtgccaccaccctggccttaaacaattattcatgaaaggaaggaaattctgacacatgctgcaacatggatgaagctcaaggacattatgctaagggaaggaagccaaagacctgccagccgaggtcccagtccgtcaagggctccagtgagcgagcaggattgagcaggtccctgggctgagcagtgggaactctgctttgctgtgagtgtggcacgggtggcggcagactgtggagtgcaggctctgtggagcaactggacactctgttgaacgaagtgcaaggtggtaggtttttgcttttttttttttttctgagacagagtctcactctgtctcctaggctggagtgcagtggcatgatctcgactcattgcaacctctgcctcccgggttcaagcaattctctgcctcagcctcctgagtagctgggattacaggcgcgagccaccacacccagataatttttaaaatatttttggaagagacggggttttaccatcttggccaggctggtctcgaactcctgacctcgtgatccacctgcttcagcctcccaaagtgctgggattacaggcatgagccaccgcgcccggccacaaggtggtagtctttctcaaggacgctggggcaaccccattgcgtcttcaccaacaccctggtacagatcctgcagctgcagtctaccccgcatacaacatgttcaatgatccctagctagacaaggcattgaaaactattccataggccgggtgcagtggctcctacctgaaatcccagcagttttggagcaaggcgggtagatcatctgaggtcaggagttcgagaccagtctggccaacatagcgaaacaccgtctcttctaaaatacaaaaaattagctgggtatggtggtgcatgcctgtaatcccagctacttgggaggctgagacatgagaatcacttgcaccaggaggcggaggttgcaatgagccgagatcacactactgtactccagcttgggtgacagagtgagactctgtctcaaaaaaaaagaaaaaaaaaattagctgggcatggtggcatgcacctgcaggcccagctactcaggaggctgaggcaggagaatcgcttgaacccaggaggctgcagtgagccaagatcgaaccactgcaccacagcctgagtgacagagtgagactccatctcaaaacaacaacaacaacaaaaatcaactattccttgggaggcagaggcaggaggatggcttcaggccaggagttggagccaagctaggcaacatagcgagaattcctcatctctacacacacacacacacacacacacacacacacacacacattaattagctgggtgtggtggcacatgcctccagatactcaggaggctgagcgggaaggatggtttgagccctggaggttgaggctgcagtgagccatgatcacgccatgacagaatgaggaccaggtggaagaactgaaaacgctggggatccacacatccgctccatcctttcagatggaaagaaataccaagactcaaaaaaatgagggtgcccaggtcctcactgagcagagactcactgctaaaaaaaagccttacctatttgggttttcactagtaagcagttggtttgtaagcagttggtgattttagtttgtctgggtttcagccatgaatattctattgtaaacttaattataacaactgcactgtaataattcaatgtcctattatgatgttgttatagacaaaatttgcctttacattgtcatttattttattttatttttcttttgagacagggtctcactctgtcacccaggctggagtgcagtagctcaatcttggctcactgaaaccactgcttcccaggctcaagcgattctcccacctcaccttctcgagtagttgggaccataggtgtgaaccaccatatcaggccaatttttgtatttttagtagatacggggtttcaacatgttgcccaggctggtcttgaattcctgtgctcaagcgatccacttgcctcgcctcccaaagtgctgagattacaagtatgagccattgacatttaatcttccttccttccttctttccttccttccttccttccttccttttctttttttgagatggagtctcgctctgtcgcccaggctggagtgcagtggcacgatctcggctcactgcaagctccacctcctgggttcaagcatttctcctgcctcagcctccggagtagctgggactataggcgcaggccaccatgcccagtgattttttatttttattttttttgagacggagtctcactctgtcaccagcctggagtgcagtggcgcattcttggctcactgcaacctccacctccagggttcaagcaattctctgtttcagcctcccgagtagctgggattacaggcacccaccaccacacccagctaatttttgtatttttagtagggatggggtttcaccatgttggtcaggctggtcttgaactcctgacctcgtgatccaccaacctcggcctcccaaagttctgggattacaggcgtgagccaccgcacctggcctacttttttaaacttaaattttaaaaaaaattaagtttatttttaatgtgatttatttatttatttattttttagatggagtctttctctgtcgcccaggctggggtgcagtggcactatcttggctcactgcaacctctgcctcccgggttcaagtgattcttctgcttagcctcccaagtagctggggctacaggtgcatgtcaccacgtccagctaatttttttgtatttttagtagagacagtgtttcactgtattggtcaggctggtcttgaactcctgaccttgtgatccgcctgcctcagcctcccaaagtgctgggattacaggtgtgagccatggcacccggcctatttatttatttattttttaattttttttgagacggagtctcgctctgtcacccaggctggagtgcagtggtgcagtctcggctcactgcaagctccacctcccgggttcatgccattctcctgcctcagcctcccgagtagctgggactacaggcgcccgccaccacgcccagctaatttttttgtatttttagtagagatggggtttcaccgtgttagccaggatggtctcgatctcctgacctcgtgatctgcccaccttggcctcccaaagtgctgggattacaggcgtgagccaccgcgcccggcctctttcaatcatttctgatgacaccggagaaggcagtgtcctttccttattgtctctttttttttttttacctgggtattctggaagtgtctttcctctgacagtgttgttggacgtggggaaacaaaagggtatcaaagagagggagagaaggataaagaccacccctcattcccgccctcccagaggggcagcctggggagtctatggaggaggtgactttgagccatgatgtgaccttagatgaggggcctctctgagcctcaggaagctcttctgcaaaatggggcaaataaagaaatgccctctgtgtgcagtggctcaggcctgtaatcccagcacttcgggaggccaaggcaggagaatcacttgagcgcaggagttccagaccagcctgggcaacatagtgggaccccatctctaccaaaaaatttaaaaattagccaggcatcaggtgtggtggctcaggcctgtaatcccagcactttgggaggttgaggcaggcagattgcttgagcccaggagtttgagaccagcctgggcaacacagtgagacccctgcttctacacacacaccaaattagccaggtgtggtggtgcacatctgtagtcccagctacttgggaggctgaggtgagagaatcatttgagccctgaagctcaagactacagtgagctgtgattgtgccactgccctccagcctgggcaacagaccaagactctgtctcaaaaaaaggaaaggtccaggcgcggtggctcatgcttgtaatcccagcactttgggaggctgaggtgggcggatcatgaggtcaggagattgagaccatcctagctaacacagtgaaaccccgtctctagtaaaaatacaaaaaattagccaggcgtggtggcgggcgcctgtagtcccagctactcaggaggctgaggcaggagaatggcgtgaacccgggaggcagagcttgcagtgaactgagattgcaccactgcactccagcctgggcaacagagcaagactccatctcaaaaaaaaaaaaaaaaaaaagtggaaaagaaggccggacgcagtggctcacgcctgtaatcccagcactttgggaggctgaggcgggcagatcacgaggtcaggagtttgagactagtctggccaacatagtgaaacactgtctctactaaaaatacaaaaaattagccaggtgtagtggtgtgcacctgtaatcccagctactcgggaggctaaggcaggataattgtgtgaacccgggagacagaggttgtggtgagccgagattgtgccattgcactccagcctgggtgacagtgcgagactctgtctccaaataaaaaaaaaaaaggaaaagaaattccatcccaaggtgatccctcacaggaagtgactcagaaaagcagtgagctacgaaagctatctgaatgaagcaagatcgtcatgtgggagacactgactacccactcctagcaaagggctcagcagcacacggcctccctgcggggatgccctcggggaagatgtggcccagaggagttttttgggccttgctcctcagtcctggctcttagtaggaccctctgcagccaaactagcatatcctgagccaggctgaccttaaaaagtaagcattcagggcctagggaccttgggcaaagcagagaagctggtgtcagatgaggtgcagcaggtacagtaggataaggtgttctcaggtcgccagtgcagccccaagatgagcctgcagtattttccttacatgatctggtcctactgtgggcagcgctgctgcccagagcctgagaggattatgaaaacatggcaacggaagtgaggccaggggacacagcatgggggcatgaggagcaggggacagcgggtggggctagaggagagggaggtttagggaggcctctgctgctgtgactgtgagccccagccaatgatgacgtggccaccgcacaatctgagttctgggaaccatgtgatggaatgtgttctgggaatagactgcagccaggaaaaaaaaagcagaagggtgcaccctcccttcctcagccaggaaaacatttctgtagcccttgcggacccaatgcgcagaagtgagagggaggaaagccaggctcatgtttccttggttgtgcttcaacttctaaaatatgttttttctatgaacattttaatgaggggttggacataagacagaaaaataacattctgagagctcgtttggaggttctagcaggggagcgcagctactcttatactcttgactgaagaccgatcgtcctctatcggggatggtcatcctcttccattgagcacacagcttctggagggacgcacatggagtggtgagggaggaaggggatacccgcctagtcagccagatcagccgaatcaaccctgatgatcaatggggtgacacatgtcgcagccagatcaccctcacatcccaaaaataacactcagattgctttttcttttttaagatgtagacttttcttgagactttcgtacaaggcaatggacagataaccttaacctcccagagaaaacacacattggccacagaaaaaggcgcttctccgtatacctgccatagttatcagcaactttgaaatggcttctcagactctcaggggttggcttgttgtgtttgcttttgcaaataactcaggcttaagtcctgctactttcagagcctaggggacgcttaaggactaccatcagtttaacacagtggcacttggagcacatgctacttatggtggtgaggaggggtgctggtgtgagggtctgaacgcttgcttctcctctggcagggtgtgagcagccagaggccactacctgggcaaggatgcttgctcagtgtccatggagggacatgtgatccagcaggtgggcaggaaccaggcccctgtggccgcccaactctccataatagaatccttggtcatccatgggcccgtaaaccatgaccacgtctcctgccctcagcgccagcctgcccttcccctggccccccatttgcccatccccaggatcatagtccagagctgctatcatgatctttggagtccacagtgggagtctcttggagttcccctggagcaccagggaggaaccctgggggatggtgagcccctgaaagtcctcgaggtgggccacagaaggcaggttcccttgggccggagaacgccacctcctatcagtctgctctgtccccacctccatctcagccactaggcgcccggggatattgcccacttgcctgttgcactcgctgaggtagaaatcatgggtgtcctgagagccccacactcttagcaactgccttttctggaagaccagctcctcctctgcagccttgaggttggcagacatcaccagggggttgtaatcagagagggccacaaagaccctggctggagtgttggcccccgtccccagctgttgggggccacccctgggcatcttgatgactttggcggatggagctggacacagtgccgagctgggctcatggagctggcaccctctcttcacccccagagcttgtccttgcctgctgtggggctcaggctccctcctctcctctcgcctctctgtgccccacagatccaagcacagtgcctcctgctcctccttcaaaacgttatggaagtcagatgcatactgttggctggcgcccagctggggaggtgtgaacccttgggcatcttgcttttgccgaagtaccctctcaagggcagccttttcctgacacggttctttcctgggcccacactcggtgcgtagatggatgaatcctggagcagggcttttgctggtgcccatgtgctgggagcaattttccttctccccaggctggtcactgactgaaggtggcctgtggttctggggactcttctgaaagagcaggtcctttctacagccctcccaggcctctgcaagctcctgggcttggctgccagcccctgaactcggacattctccttctgagcccaggttggacactggggattgcctccttgggggttcttcaaagaatgcttctaggaacttggcctggggctccccgcagcttccagggttgtgggggctggccttggcactcggaggagccagtgacagcttctgggggcagacggggaaggtgactctgtaggtggatgggtcgccacaagtgtagctaaagggtggagtctctggccatcggtgacacatgaagaagtcctcggggatctgagcaggcactgaatccagggactcaccacagagtgacatggttctcactgagaccttctgccacgtgaggggcacctgtagctgggagaattccaatagggtgctcccagcagtggcatcggcgacctcacaaaccttaagcccatctgcatacacagcataaccggtgacctggactccattggaggacccagctgagtcaatggtcacagggagccagctgaccaccaggacacctggcgaggcatggcgctccaccagcacatccagcggtgggtagggaggtcctgccaagagtgtgtcgaaggtgacggtggaggacatagttccccaatacacctgcagcaagtcccgtggcagccgcacctccacccgcgcccggtagtgcgtgccggggcacaggccctggaaggtgtagcagctcacgcccgctggggtcagggcatgctctcggtcatcaagatataccacatgggggtggcggtggctgctgtagacccaggtgatgttggctgatgtggctgtgacattctgcaggtgtagctgcatgggagccatacggagcacccctttggtccccagaaggggtctggagaggccctgcttccccatgctctgcagcaagcccagctggcaggcttccgtcttggtatccaggatctctgttgctacttctgtcttggagcccaccctgaccatctggcacagccctctgtccaccactccctgggctttcccagataataagctgtcttcctccagagcttcatcctgccccgctgggagttgactggggccaagatcaggggatttggcaggcaggcagcctgggatgtagctgtccggaatctgctccacgaagttggagggcaccagcccccgccggccatcctcaagctccccctcatagaagccatcctcatccatgtccccgaagatatatatgtagtccccagctgtgaggggcagctcaccctcagggtgatcattgggcccctcaaatgggttgtagttatactgagccatgaagatcttgagcttgggggcagcaggagccgccgagccccccatttccagggccagggacacgctgtcaggctccaggtcatccacctcactggctgtgtccctgtccagagtaggggaggacggcacggtggcccacatcgacccctcagaggaggagtttgactgggagctggttttcttggacagaggttggctggcagggactgtctctgaaacttgggggacactggctgactccccaagggcaactgggctctcctcgagggaggcttcccttttctcctgtatgtctctgttgggctgtgacactgcgtagtcttcaggccgtgcgtggaacttgggccttctgctacctttaacttgggactccggcatttgactggtctcccagggctgttcaggagggtgaccaggccgacactggagcgcctgtatctccttccaggaaggatggaggtcacacagggccttctgcgggtcgcgttgcagctgctgctgcctgtcctgcccgcgcgccgcctgctgcagcagctgttcggcgatcaagccggaggcatcgcgctcttgacacgcgcggcccaggtggccgcgcacttcgctattctcagcctccaccttccgcacccagtcggtcttggcctgcagccgcccattctcctccgccagccaggcgtttttgagcagcgccgcctgcagctgtgtctcggcctcctcgccacgtcgccgcgccggggccgcctgcgcgcccagctcctggcactcgcgccgccgctggtccagctcgcgctccagcgccagcatctgccgtcgcacctcctcgcaggttgcgctctggccgcccgcctcgggccaagcgccaccgttgccctgctgaagcatcaactgcctctgcaggcgcagcacttcccgctgggactcgcgctgcaggcggtctaagtctctgacgttgagccactgggtgcaggggccgccccttccagtatgcaggtcgctgcagggacccgaggcgacacgcgcctgcaggaggtggcactcctgccgcagctcttcgatctgcttgtccttggccagcggcgcgctcgcctgctccgacaggtcccgagcgcgctggcgggcaaagacttggcacagctccaggccggcgcaactctcgccgggtataggcgcgctcacggcccggaggttggtctcctgcagcttgcgggcgcggtcagctaggcgccgcgcgagcccggtcagctccgcgcgctttaccttgagccgcttcaccttctcgtctgcctggtaggggcagcctgcacgccgcagctgcttgttctccgcttgcagggtataacagcggcgcgccagcacccacaacgccttggccagcagccagttcagctttatcagctcgtggtggcccaggcccgggggtgagggagtcaggacttcgcagggctggctctcagagccttctcctccccgcgggttgctgagtttcctgtgggctgacggtggtggtggcggcgggagtggcgatggtggcggcgagagcctccgggagccaggggtggaggtgtctggtgaggagggccgctcctcggatttggaggccttggggaggctccgggtgctgtcaagcgagcgggaacacgcaggtgcgaagcaatcaagggagctggcgtgcgtggagagcaggccgtctggggagctggagcacgcagaggacaccaggcctagcgagcgggagcgcacaccgacttcagcactcaggctgtctagagatccgagttggcaggcgggtttgggggcgtggcaagagccgctggaggtctggggcagcggttcttccaaggaatgcacagcttgggggtccggtgatcccgacaaagccgggtgcccgcggaagtgcgccaggatgtacttgaggaagagctggcgctccacctccagcgccgcctgcagatagcggatgcgcgccgcctgctcgccgtcagtctgccagcgaagctgcgccaacacttcctgcaggcgacagcggcactgcgccgcggaaacctcggacgcccccgggcggctacagtggccgcggttcaccagctcctcggccagctggcgctgcagctcccgggcttggcgcaccacgccatcgcgctcccggtgcagcagctgctgcagctgccgctgctcggcctccttccagcgcagcagctgccggatctcggcctcgcgttcccgctgcatctcctcttgcagctgccgcaactcccggctgcgctgtgcctcccacttggagcgcagacggtcagccagctgtcgccgctcccgctcggcctcctcacgcagctggcgctcccgggcagcgaagcgccgccgttccgcccgccagcctgcccgctccgcctccagctccgcccgtagcttctccagctcccgcctctggttctccagcactgccgccgccgggctggagcagcccggcttcttgggcgacgcgcccaaggggctgggcgagtccttggccattgcggccgcggcccggctggtctccagacttcgcctggcaggcctcagctcgccaacggccgccgccgaccgcccggcgcgccccttccggcgccccctgggggtctccgcgtgccccttccgcctcttggcatgttcccccgcctcctgccgcggatgtctggcccaggcgcctctccacctggcaaggccagggctggactcccacacccctgctcaaactggcccatgtcccttccaggatgcacgggggcttttccggtccctacacttttcctgcttctagcaccaagtcccttgtgaccctccccaggcaccctcccaggcactgtgcagtcccaagcaggccgcggtgccccgagggaagtctgggctgctgctcctgtacttggagaaaggggcagggtgtgtgtgttaaggccacccatggggtgtgggcatacctggtcgtgggttcaggtggtgtatttgggtcaggtggctggaaaatgcagcaggataggcctcaacttggctagacctggactccccaggacccttcagccccctaacagccctgatcacccaactggtcatccaccttttgaggaaaggatgtgcctgatacacatttgtgttactgcgcagagtcggctcagaggaggtgtaagcgaaaagaccctccccagcaaggtggcatagggacccagggccagataggcatgaggggcactgcccaaactggccatctggcctgtctacctcccacatccaggtaccacctggtgacaaacactggagccccagtgtctgggctactcattggcatcttaggtagaggcctcaggatgggccaggagtgagggtgaggcttcagcagaaatgttggaggcatcctgagctgcagaagaaacacacacacacacacacacacacacacacacacacacacagctgcagaagaaacatacacacacacacatactgagctgaaggaatacacacatacactgagctgcagaagaaacatacatacacacactgaactgaagaaatacacacacacacacacacacacacacacactgcctctctgactggtggccacctgtgtggcttgggagctaagaagccctgcttcagtctggctcctctttgcccttcctgtctgctcctggtgccaagtggcttttgggagacatggatggacacctgatacctggcagtctgcatcgagacattgatttttttttttttgagatggggccccactctgtcgccaggctggagtgcagtggcgcaatcttggctcattgcaacctctaccttccacgttcaagagattctcctgcctcagcctcccaagtagctgggattacaggcttgagccaccatgcccagctaattttttgtactttttagtagagacagggtttcagtatgttggccaggatggtcttgaacttctgacctcaagtgatccacccgcctcggcctcttaaagtgctgcgattacaggcatgagccactgtgcccgacaagaccttgatattgaagtcacatcagaggcccctttgcttcttggtctgtcgtgtctccctgtccccaggaagcacctgggacctctcacaactgctgtgttcactcagcttatggccctcctttacaacactcaagtttttcaaatcagtttccccggaacccacagaacatgcctttaggcagtgtcaagtaacaagaacatcgggaattatggctccagatgttcttttttttttttttttttttgagatggagtctcgctctgtcgcccaggctggaatgcagtggcgcaatctctgctcactgcaagctccgcctcctgagttcacgccattctcctgcctcagcctctcaagtagctgggactacaggtgcccgccaccatgcctggctaattttttttgtattttcagtagagatggtctcgatctcctgaccttgtgatctgcccgcctcagcctcacaaagtgctgggattacaggcgtgagtcacggcgcatggccctttattttattttattttattttattttattttattttattttatttgtgagacagagttttgctctgtcaccaggctggcatgcagtggcacgatttcggctcactgcaacctccaactccctcgttcaagtgattctcctgcctcagcctcctgagtagctgggattacaggcatgcgccaccacgcccagctaatttttgtatttttaatagagacagggtttcatcatgttggccaggatgatttcgatctcctgaccttgtgatccgcccactttggcctcccaaaatggtgggattacaggcgtgagccaccgtgcccagcccagatgttctttatgagaggtgaggcagatgtagtgtgtatgtgagaggaaggggaggtgagatgcagggatggccttagccttgaactggtgctgggctcctgggcatggtagccacagggaggactatcttgagagaatcttcatcacagccctgttttacggaagagaacctgaggctcagtgagagccactggcttgccagggcacatgggcaactgaggcagagctggtgggtggggtttcacagcctggatgccctgctgcagtctccagtagggcctcaactgtcaggtcaggagggcaggctgggccgggcatggtggcacagacctgtaatcccagccctttgggtgaccagggtgggaggatcacttgagcccaggaactcaagacctgcctgagcatcatagagagaccctgtctctacaaaaaaaattttagctgggcgtgctggtgcatgcctgtagtgccagctacccaggaggctgagatgggagggtcacttaagcccgggagtttgagactagcctgggcaacagagtgagcgagacccagtctgcatttccagctgagatgaaatgattgcttgagcctgcaaggtgaggtcaaagtcgcagtgagctgtgatggcaccactgcactccagcctgggcaacagagcaagactgtctcaaaaaaaaaaaaaaaaaaaaaaagcctggtgcggtggctcactcctgtaatcccagcactttgggaggccaaggcaggcgtatcacgaggtcaggagatagagtccatcctggctaacatggtgaaaccccgtctctactaaaaatacaaaaaattagccattagccaggcgtggtggcgggcacctgtagtctcacttatttgggaggccgaggcaggagaatgacatgaactcaggaggtggagcttgcagtgggccgagatcccgccactgcactccagcctgggcgacagagcgagactccatctcaaaaataaaaattaaaattaaaattaaaaaaagagagtaggctgtcaccaagaaaaaggacactggggtggatgggtctctgggaaccccacagttaccatccagcagctgccccaaagtatgtcaaaagcattcgggaatgttggttgagtggatgagcaaagccaggcttccccagggctgggtttctgccatccctgttctcatcatgttgtgcagtgattgtccagtgacctgcctgtcacccccatcaactctgatcttggggagagcagaagccatgttttcccttgtccctattgcatccgtgcatgtgacttagcacatcactggtgcccaagacatatgagaatgagttgcagggaggcaggagtccctgcatgagctcaccatgctgctgccttctccaggttcaactttctcacctattaaatgaaagagatggtttcttttttttttctttgagatggagtctcactctgtcacccaggctggagtgcagtggcatgatctcggctcactgcaatcttcacctcctgggttcacgtgattctcctgcctcagcctctcaaatagctgggattacaaacacctgccaccatgcctagctgattttcatagttttagtagagacaaggtttcgccatgttggccaggctggtcttgaactcctgacctcaagtgatccacaggcctcagcctcccaaagtgctgggattacaggcatgagccaccatgcccagcctgaaagtggtggtttcaaactgggttctttagggctccagggttccttggaaatatagaactgctgggcacacacctatactcccagctacttgggaggctgaggcaggaggcttgcttggatccaggacttctggattgtaatgtactatactgatggggtgtctgcactaaacttggcataaattggtgacttcctgggagcaggaaaccaccagcttgtctaaggagaggtgaactggcccaggttagaaaaggagcaggttggccgggctcggtggctcatgcctgtaatcccagcactttgggaggccaaggtgggcaggtcacctgaggtcaggagttcgggacccgcctggctaacatggtgaaaacccgtctctactaaaaatgcaaaaattagctaggcattgtggcgcatgcatgcctaatcccagctacgcggcaggctgaggcaggagaattgcttgaatctgggaggtggaggttgcagcaagctgagattgcaccactgcactccagcctgggcgatagagtgagattccatctcaaaaaaaaaaaaaaaaaaaaaagaaagaaagaaaaaggaaaacgaaaaggagcaggtcaaaactcctgtgctggctgggcgcagtggctcacgcctgtaatcccagcactttgggcagttcaagaccagcctgaccaatatagtgaaaccccatctctactaaaaatacaaaaaattagctgggtgtggtggcaggcgcctgtagactcagcttctcgggaggctgaggcaggagaatcgcttgaacccgcgaggcagaggttgcagtgagccaagatcatgccattgcactctagcctgggtgacagtgcaagactccatctcaaaaaaaaaaaaaatttttttttttgtaggctgggcgccgtgactcatgcctgtaatcccagcactttaggaggccaaggtgggtggatcacttgagatcaggagttcaagaccagcctggccaacatggtgaaaccctgtctctactaaaaatacaaaaattagctgggcatggtggcaggtgcctgtaatcccagctactcgggaggccgaggcaggagaattgcttgaacccaggaggtggaggttgcagtgagctgagatcacgccattgtactccagcctgggcaacagagtgagagtctgagtcaaaaaaaaaagaaaaaaaattaacaacaggccagatgtgacggctcatgcctgtaatcccaccactatgggaggctgagacgggcagatcacttgagctcaggagttcaagaccagcctagacaacacggcaaggctgcatctctataaaaaaattacaaaatttagcctggcatggtggtgcacgcctgtagtcccagctatttgggaggctgagatggaaggataccttgagcctgggaggcagaggttacagtggactgagattgtgccactccacttccacctggacgagagagccagtccctgtttcaaacaaccaaaaaaacaaaaaacccacccccccaaaataaaaacaataataataataaaaataaataaaacagaaataccataggccttttgggaggaggtatgcaggaagcggatggggagagacagtgcccctacttgcttcaatgggcagatctactctttttttttgagacggagtctcgctctgtcacccaggctggagtgcagtggtgcaatcttggctcactgcaacctccgcctcacgggtttatgccattctcctgcctcagcctcccgagtagctgggactacaggcgcccgccaccgagcccggctaatttttgtattttttagtagagatggggtttcaccatgccagccaagatggtctcgatctcctgacctcgtgatccaccctcttcggccttccaaagtgctgggattacaggtgtgagccacagcacccggccggcagatctactcttaagtgtcacttatcagattcgaagaagggttttggtttaataaagcgttatgctccttgaaacaagtttcagaacccctgggttagaggacctcttgcccattgtgtgctcacacacacacgacacacacataccccatcccagtacgtaatgacttccctgacccggagagaaggcgatatgtcccccttacatctcagttggctccacatcgccagctctgtattccactttccctctctctacaaccccagtctatgacttttgggccatggagtctgggttcctgggcaacctggttcacatccttctcctgccggcatggcctggctccatttctgttcggctaccaaagccccaagctttgtggagcctgcctggccttgaggaggggaatgggctccatcctgagagcctgcaggagggtttaagcttcccatcccccattgctacagtagctcccccagcttttcattccatatcctttatttttatttattaaaaacttaatttttggccgggcgcggtggctcacgcctgtaatcccagcactttgggaggccgaggcaggcggatcacgaggtcaggagatcgagaccatcctggctaacacggtgaaaccccgtctctactaaaaatacaaaaaatagccaggcgtggtggcgggcgcctgtagtcccagctacttgggaggctgagggaggagaatggcgtgaacccgggaggcagagcttgcagtgagccaagatagcaccactgcactccagcctggcgacaaagtgagactccgtctcaaaaaaaaaaaaaaacaaaaaacacttaatttttttttttgtagagacagggtctccctatgttgcctgggctggtctcaaactcttaatctcgagtgatcctcccacctcagcctcccagagggatgggattacaggcatgagccaccatacccagccacatattttttatttttgtttctatgtgttttctgtctgttctttgctgtctcctccatgtctagaacagtgcctggcacatgataggtgctcagtaaatacaggactgaagaagacagaggcagacaggccagatgtggctgctgtccttagggaattgacagtccatgatctatgagaatgagctgcagactgggaggcaggtgtcccagcatgggctcaccaagctcctaccctctcccggtccagctttctcacctatgaaataaaagtgaagctggacatggtggcccacgcctctaatctcagcagtttgggaggccaaggtgggtggatcacttgagatcaggagattgagaccagcctggctaacatggtgaaaccccatctctactaaaaaacacaaaaattagccgggcgtggtggcagttgcctgtaatcccagctactcgggaggctgaggcaggagaattgctttaacctaggaagtggaggttacagtgagctgaggttgtgccactgcactccagcctgggtgacagagcaagactctgtctcaaaataaataaataaataaacaaacaaacaataaatgaaagtgatggattacatgaatggttttcaaactgggttcctcagggctcagtttgggggagaatgcaaaggttaaatacaaacaacaatggaatgtagtaacattggcgcttgggcgagtgctctgggtgaggaatgtggtgctcatggggagaagagccgcatcagagcaggcttcctgcatgaggcaaggaggaaacacaagagctgagagctgaaggagagggagtgagggctgccagaggagctgggaggcgatttcaggcagtgggaactggagctgcaaacccccagcctcctgcagtctggctatctgtaccagccctcacccatgcccaccaccctcagggcactcacatcccttcttgcactgatattttcccgtcctatcatgaccctcgtttgagggtgcagggaggactggagctcagagagggagggtcacctggccagaccctaacccgctgagttccagtggagttccttccatcccccagcactggatggggctggatacctggagagggaccgtgctgctcttcctgggccctgcagcctgcctggctggtccacatcttcctgggccaggagggcagtatggtgcgagcttctagctctctggctggggccccctggcctactgggctggcttcctgccctggtggccctggcccagctccccagctcatgtgcctctgcagcgagtggtcagccccttcccatctgcactttacaagcctcatcgctgaatcctccccatagccagagagcctggcactctcctctccagagaaggaaactgtccagggtcacacagggacttatgggcaggtctgtgtgacctgagtctgggctctgaactggtgcttgcagggtcttgccctctggctctggcagcctgagtgttactgtaatccctgagcctttgaacaagcaggcactgcttcctgagatccccattgctgctgtcagcgtctctgtttcccagctccacactgctgccaggacagacgtatcttctgtcttgtagcatctccatttctcttccctttagatctatttttttttttttgagatggagtctcgttctatcatccaggctggagtgcagtggcacaatcttggctcactgtaacttctgtctcctggattcaagcgattcttctgcctcagccttccaagtagctgggattacaggtgcatgccaccacgcctggctaatttttgtatttttagcagagacgaggtttcaccacgttggccaggctggtctcaaactcctgacctcaggtgatctgcccacctcagcctcccaaagtgctgagattacaggcatgagccaccgctcccgggctggatctatttcaatcaccctccttcctctgcagcctgaaacttgaggctttgcccacttcccaaaggcacgagtagcaatgaccatttgttctgtcatttggccatagctctaggtcagaggacagtccttcatcaaatgtttgttaagcatgcaatctagacaggggaggacaagggccaagtaatgtgttaatttcttcattcactaagcacagagaatggagtagaaggaaggtggaaaggagaaggaaggaaaagagagaagaaggaggatagaaaggaaggaaggtgggagggagaaaggaaagaaagagggagtcctttaggttatctaagtcccctcaggacttggtctggccctcacagttcaagaacagacttgggcttgagcctctgaccagccagatgactgagaagctgaggaacagcttgagcctcagttttttcctctgtaaatggggttgatagcagttctgacccagcgggctgttgggggagtcacagagatgctgggtgctgcctttgcactcagaagggtccaggctaggtgtggtggctaacacctgtaatcccagtactttgggaggctgaggtgggagaatttcttgagtccatgagttacagaccagcctgggtaatatagagacaaactgtctctataaatttttttcccaaaaattagccaggcatggaggtgtgcacctgtagttctagctgcttgagagtctgaagtgggaggataacttgagtacaggaggttgaggctgcactgagccatgatcacaccactatactccagcctgggtgacagagccagaccctatctcaaaaaaaaaaaaaaaaaaaaaatcaaaggggtccagcagcatcttcctgtcagcttacctaagggagcatgataaattgagtccctgccacgatggacatggggagtgtagtgggagggaatggcaaaggcaccacaggcagagggaacagcctgggcatagtggggggtgtgatgtggcacagcactgattgtgggaagcgagggatgtgggagatgaggcttcaggtagtcagagggaggttgaggcaaagcctcacctgcatgctctagatgaggtccaattcctggtacccagctcctagcctagtaatgggccacttctcccagggccacagttttctctcctatcaaatggaacatgttagcactgctctatggtgccaatgaagggtataagtgtccagtgcccatttcctgccccagcaaaggcactttcttttccttgtcctcttgcctactggggaactccttccatccctggttcctcccccagcttctgcgaggcccctcctctgagcccccacacctcatcaaaccctcaacaccgtctggtgttttccttggtgcctcttcaagatgctgtgagctccttgggggcaggtggtgcctgtgtacctcttttttttttcttttttttttttttttgagacggagtctcgctctgtcacccaggctggaatgcagtggcgcgatctcggctcactgaaagctccacctcccgggttcacgccattctcctgcctcagtctcctgagtagctggtactacaggggcccgccactgcgcccggctaattttttctttttttctttttttttttttttgagacggagtctcgctctgtctcccaggctggagtgcagtggcacaatctccgctcactgcaaactccgcctcccgggttcacgccattctcctgcctcagcctcccgagtagctgggaccacaagcacccgccaccacgcccagctaattttttgtgtttttagtagagacggggtttcaccgtgttagccaggatggtctcgatctcctgacctcatgatctgcctgcctcggcctcccaaagtgctaggattacaggcgtgagccaccacgcctggccttttttttttttttgtatttttagtagagatgggctttccctgtggtcttgatctcctgacctcgtgatccacctgcctcggcctcccaaggtgctgggattacaggcgtgagccactgcgcctggccctgtgtatctgtttttctggaccgccatcatgttcaggaaggcatcgaatattttgtccgcgactgcaatcacacactgcatcatccctgaaacgaggtttccacggataaggtgcagcaacagagagagaatcctagcaactttcaatcattttcttttgaaatggttttagacttacagagagtggcaaagacagcacagagctcccatatacccttcacctagcttccctggattttaacatctgcagtaaccaggctgatgtgtcaaaactgagtcagatattgatataatcctattacctaaacttcagacttcgtctggatttcccaggtctcccacacatgccccgcttctgttccagcatccaacccaggacaccaggtggcatttaatctctgtgtctcctactcccttccaatatgtggtgactccccagtctgtcaatgtcttttgtgactttgacacttttgaagaacagttattttgttgaatgtcccctaatttaggtttgtctgatgcttgcccatgataagactagggttacaggatttgagggagaactccatagagtggatgtgccctttctttttttctttatcatttttttgagattgaaactcgctctgtcgcccaggctggagtgcggtggcacgatcttggctcactgcaacctctgcctcctgggttcacgccattctcctgcctcagcctcctgagcagctgagactacaggcgcccgccaccacgcccggctaattttttgtatttttagtagagactgggtttcaccacattggccaggatggtcttgatctcctgacatcatcgtgatccgcccgccttggcctcccaaagtgctgggattacaggcgtgagccaccgtaaccagcctgccctgcgtaatttttgttgtcgatgatccaaagtgcacccactcgccatctctggtagctgggaggagcaggtttttgggtgaaggtgaaagagccggagttggggatgtgtgtggctggggggtacaggtgcgaccactttgcagtccactcctgtgagtagggcattcctgagggagagaaggcctggttagccctggggctccttcaaggcctggccccaggccttgatacctagagcagcctgacacatgtgtggatggactgccaggcggtccccttaggaggggctgttctagcagggaccctggcttgggtgaccaccacctcctgccacactccaggatccctgtccctgctggaagccgggcccagggccatgccagccgtgaggggttcctcatgagcctcctccccgggacccaggccccatgcagctgccccctcccacctgcctgacccccctggcctgcacttccctccatccgaatcctcaatctccgcctggaattcccttccctcctcaaccccacctggaaactctcctcctcctcccacacagctgggactccctttctcccacctctgggggcccaaagctctggatgccaccctagccctcagctggcctcacctgtctcctcatagccccacagcttgatggtgtctgtgtgggcagcgcctcaacgtgccaggtcaggctgaggttgcctgaggtgttggcggtgccgtagtattgccaatgcatctcgttcatcaactcactcttctccttcatcaacactttgttggggtgcactgggcaggggaggtgaggggtgagtgagggctgggcccagggaagcagggaggaggccctgaggcttcaagggctgtgggagcctccagggccaatgcatggcagcagctgggtgatggtctctccggccctcatggcagaaaaggacgctgaggccggagaggcaggggcctgccctccctccactgcccacgcctctagcctccacctggcttctcccctgccctggtgtggcggagctcagtggataggcactggcccacctctctagggacccctgcagctcccactcactctgggctgggaccgtggtctggatgccagggagtggaaaggagctgaaggaactctcgcaggcgggcaggcctcccaagggattggttcagccagagaggcaggacacggacgggccaagtctcggtgtgcatagattagcgctggggaaagtccccgtgggggcaggctgtgggcagggaggagggctcaccagccagccaagtgcccgcacgagggaaggagtggccatcgtccagtgagatggtgaaggggacgtggccgctctcatagagcaggggcgacacgaagtgcacttgcccggaggagtccacatggccgagggtctggatgctctcctgtggcatgcaaacctgtgggcctggtggtggtaggaggtgctgggccactgcaggctgagcatctcgacagtctgggcccccaacctccctggggaacccatccaaccagctgtcctgtgccctcctgcctgtcctgggtctgaggggctccattcagcctgccagtgggtctgagccctcagcatgcacagggatgggggcgtggggccccagtgcccggcctcctgggcctcccaacctgcagatcacactggtgtctgtggggctggacatcttgaagtgccgcaccacaaagtccttgccgcccatcatggagactgagtagggcaatatctccaggcagaagtcctggaaatccaagcagcaggtaccaaggccggagcacgtcgggtggcaggaacatggcctgtccagggcgccacagcgcatggagcagctctcttgggcatctggaggagaggatgctgagggcctggcctggcgggtgctggactggctgccccatgtgcagggcctgtctctgtttctcccacagcccattagacagcagcatccccaggaaaatgctggccgggaactgcacaggccaccacgttgatatggtagaaagtcacagggcccgtggggatgggatgaatcttagcatagaccatctggctgttgccctgactgatgggctagaatgcagcgagaagaggcaaaaggctgcacccgctcagccctgcagggtcaggagaagccccctgggcatgactgcccttcagccaccaagtcctctatcccacaggcgggggtcctcagagggccacggtagctggagccctcgacctctcttggctccccagggtgtctgtgaacagtgcgccttctgggggccctgaagactgcagaagaaccccttttgcttgcctggactggggtgggggatacagctgccaagagtcccattcgaggcctggtagggaatggtgcagggtctgaacttgacccttctcactctcccaggggctgcaattgagaccccaaagagagctccgccctcagggcagaaggccagggctgctcccctcctttctggggggaggagggacatttcaagcaggtgtcccagcagtggggaaagggaagtgggggtgcacactgcgaggggctgtgggtgctgggcccaaagcatctcctatgggccatgacacccacggcagggccacatttccagggactggcatggaggaagagttgcagggagggactggggcaggtgcgtgcccagctgggggccctgaagggagacaggtcccatccccgggctccagagatgccaccacccagggaagccttggctgtcccagccacacctaatcctgccgctcagagtttgcataatttaatcagtgttcacctcccttcttgagcagatgaggaaactgaagctcagatgcggacaggcaaggccgagccaggcccttggtggcttctgggagcccctgcagccagggcgggtggtaagggctgtggcctgggactggtcacttgggccctgccacctgggctggacgtccagacaggcgggtggtcctctcccagctgcagcttctcaaggtgtccaaaagggacccttgccacacttgcagggagtcagagctggccccagggcatgagcttaggccatctggtctgtgatctgccccagcgcttgcggccaggccagcccattgttccccagcctgttctctctcttgcctgggtggtgcctgctgggaaccacagggtgttggcagccacccatggctccagagaggtgggcccctactgaaagtgttagaggcatgtgctgggggacttggctcctgagtccccacacagagctgttccagggaagccacacccgcatttgatgtcttcccacctcccaaagacatttggtgagaggcccccaagaccttcagcttctcaggactgtttccagaggggagaaagtcccttaacccacaacggtgctcagggtacctctgcaggtgagtgtcctgtaagtggatgctcaggcgctgagccacggagagcctgtctcctggccccaggctggcgagggcattcatcccaggcccagggctgaggttgctccctacagcactgggtgcaggtgtccatcctcctgtaggtgaggctccgggtggttcgtctgagacagttcccaggaactggaggagggagagctgctgcttcctgtttctggcctgggaacccttgctgtgcgtgtctggagacgatggaagtccggtaggggctaggtgtgcagtctgggaagctccataccacaggccctgccgtcagctgagtaactgaggctggctcatctcagccccccaaaggtgggttcagccagacccatatggggccgccaagcctctggttccaaaagggcagtgcccagccctttaggcctttcttcttgggtggtgggtgtgtccagcccatgaggggcacagggcagtgaggagggtccccatctccatcctggacagagagcctgctccatgggaggtcccaggggccaggagggcccctgtggtgctgggaggggaagagagttgtgaagggtgggtttgggtccctggaacctgtgcatccccaagacagatgggcctggagccttcgggggcggggccagctctaggggcttgtttaatgctctgtggtggctgccttaaaatacttaatcatttttggtcaggcacggtggctcaggcctgtaatcccagcacttcgggaggcctaggtgggcggatcacttgaggtcaggagttcaagaccagcctggctaacatggtgaaactccgtctctactaaaaatacaaaaattagctgggcgtggggacatgtccctgccccctgccccttgtgcccgccctctccctccccctgccccttgtgcacaccctctgtaccccccttcccgccccagcctgtgtttgcagtgctacagggtggctgcagccttcgcctcccacagctcctcaaggtcagagggctgggaacccctgggatgtggctgggatgaggaccctgcccctcgtcaggcatttccaggcaaggggcacagagacacagccagcccagcagctgagcccctcctatcaggccaggtgggaaactgaggcatgaacacaaccccagactggaaataacaaagccatcatgtactgtgtgcctactgaatgccaagccctatgccctattctttaatgtcatctttaatgagatgtcttcactcagttcaccacatgatagtagacaggtatttatgatgcgcctactgcatgctgggcacttttctgggccatgaggactcagggaggtccctgctctggtagaagtcaaacccgacaggagacagagactagggccccacacaccaggaggaagaacccagtgcagagagtgccagcaggaagccacaggggcagggaaggcgctcctgggagggtgggtggctgcgtcctgaggctgagcagggggagccggcctagggacaggatgtgcgcaggcgtggagcaggaagttcctggaatgatgggcaagagggagcaggtcactgggggcaggtctaaatactgggggctgcattgggatagcagaggcctcggacaggcccgctcagcatgtagactcccctccctggccccttccctaggatgacagtggaggtccatccccaggtggtggtgaggacactcctgacacagagaccccagcccagctggcaggggaaggggagccctcaaggacccctgtaggttggggcatgtcccgccaggcggccctccatggtgcccagcagcagccctgcttgcggaccctctttagtccccactgttaaaaaaataattcagtgaaaattgacactagctgggcatggtggtaggtgcctataatcccagctactcgggaggctgagacgggagaatcgcttgaaccagggagtcggaggttgcagtgagccgagatggcaccactgcattccagcctggtgacagagtgagactccgtctcaaaaaaaaaaaaaaaaaaagaaaagaaaaaaagaaaaatgacacttgccaaagcgccgtagggaagactgtccaggaccgtgtcactaggcataagggaccacggcgatgagattctgcagtgggtaagagactgggctcagcctcgaagacagcatgggcaagtgggatcggaccgtcaaggagcagggggaagactatccaggaccgtgtcactaggcataagggaccatggcgatgagattctgcagtgggtaagagactgggctcagcctcgaagacagcatgggcaagtgggatcggacagtcaaggagcagggtggggggcagtgcatggaaagtgactaagaggaagcatcagcagccagggattctggcttaactcccctaacagaattcttgctgaaggccggccaggatggccagaccgcacctgggggacagagggggaacccgatcagatgtcaaggacggggggcttctcgctaaactgactttgcagaattcttgctaaaactagagtttataaggaagtgctcagatgtgcctaggagaaggctcaggagcctaaataaagcttgaccaagcagagaatctttgtcaccagcttggtgagagtgaggcccagagtgggtcagggcttacctgctcaggttgtacaactgggaggggtccgtcaggagcctggagtcttcccactgggggctgagtctgggccctcagggcacatataggtagatgctgtcaggcccgacaccccatgcagtgcagactgggatgctggtgcctgtggcacagactggtcagacccaccccaggctagacattccttgcagggagagctgaggctgttgatgccaggaacagacaaacaaggtcatcaccaggtaatgagctcgttacccacatcaggcaaggccattgctgggtaatcatttggcctcctgcagagccacctgccctgggacggttcccagagatctggctagccagtgccacaggaggccggggcacagttccagggcctagtgggcaaggcaggggtattcagggacaaggtgcacctgagtccccacaggaagccccagaccctgcagtaagacctggaacaagtcattctcctctctaagctctcaaagaagaggtcagctcaggggtcggggaggcaaggtctcctagagtagactaagctggccgctgccatgctaacacacaccctcccagccagccgctggtcctgacagatgaggaaactgaggctaggtgttttcatgaggcctctgaacccagaacccagtacccagtgtcctgagcaaagcccaagccagacctgccagcttatgtgtacagaggccccactatgcagcctgcactcctggggcctaaaaggaccatcacctccccttctaagaggctgggcacaggggctgggtcccagccaggccacccttcctcctcctccaaaggcccagcagcagctgctcccagagcaagcagcacagtcgcagcaaaggctggacaagtgtcctgtgctctgtggtctgagcagagggccaggggccgtgacccacatggcccctccaggagcagctccaagatgagccttcctgtccccaccagtgtgtccgggacctcagggtggatcagccgcacctgccggctgctcctgttccttgctcttcctggggctccccaccacctttgggaggcagctccaagaccctgctgcctcccttgcttaccctcaggcccctgctgggtgtgccccctccccacacagacccctgagccagcttcgaggactctgcctgcatctccacgtccactctgatgactgtgaagctacagtcacactctctgcctccacccccgccctgccgggtccctgcagcagctctcagaggcccccacagcccctcccacacacagagctcgcctggccctgccgtctgagcgctcccctggctcccaaccgcccttgggctctgggacataaaacctccagccaaggtggctgccaagttttatttaatagccatagagcacaaaagggatgacaattaagtcacacggagagactgccccatcgggacccctggccaagctaagcagaggagccctggggtttcctctgaccccccactgtgaatgcattactgacgggcaaggtggccagttgcccacccagcctgcacgtctgcatgcacagagctacagcctgggcccagggacagccccgggagccggtggcttcccacaggcacagccagcctccccacccccaccatgcctggcccccggcccagggcacactgaggggaacaggaggggaaggagcaggccctgcactggagcctcagtcagctcctctgtgccaggggcagctggagctggctgaatttgaggaacttcccggaggaactggagagcagacctgtgtgcgcgccccgctctgccacgttccctgagggacacactgctttgaccagcccccaccccatctcctctccgccagtccccggtgtccaccccagccccgctaccgatgaagctcaagccagggtccccatcacctgcttcacggccatccctgcacttgagctcaggggctcagggttgtgctgacacgcctgcctgtccacccctcaccgacacctctgcagtcctcctcagggcccaacagggtccccaggaccccgctcccattctgcccttgctcctgccaacctgtcttctctatgcccatgactttgggaccctctgccataagtaccagcccccacatctgtagcctctgcaggaacaagccctaatctggactcattgcaatggctcaggttctcttccagcctgtccatagacctccaggcagagatcacaaaactaacagctctttctgcaaatctggactctctcctgcaccttcgccaccatccaggcctccctgtcactcctcctggggacctcagagatctcttcatttcacaggtgaagacttggctcagagagggcagagcccctgggtcacacagcccgtctccagtagggctggggaaaagaacccagggcgctcttgttggcagtgttttaatgactggggggagggagagaatggctaatgaggctctagggatcagcagagccagctgctggaggtcccagaggacgggtgactcagcaggaatgggggagtctgaggggttgacagagtgcccaattctcacctcctcctgcaccttccagggagacgagctgcagggagtgattgagtggatgaacatgactagagggacccagtcttctcctcagcagctgcttgaggacagtattagcggtcccctcaatcccccccccaacacatgcacacatgcactgatctgcaggggccagaccccagtggacccggggacacagcttccaggggctgtcttgccatgtcccttcccagacctgcctggattcatgccaggccaccctccacaatttgctgagggaggccccagggtccagggcacccagagtgctaactagcccctgggggtacagggagaacagcatgctgtgtgggggatactactctgcccatacctagggccctgtggcggccacaggcagcactgcttatgcagaggcactggggtgagaaggagtagggtgcagtagtgagggctccacagagggtggaagggctgcaggggaaggcagaccagcagggatgccatgagggcctcagatgccaggctgcagaggtggaggggctggccagctcctctccccagcctcctactgtaaaatgggagaggatcccagccctgctgattcatccactcactccatggcaagacagccactgacagctgtgtcctggggcccacccgggcctggcctctgtgcaggctagcactcagcatgcttagtgccacactcggcccaggagaaatgacccagccctgggctcagagaccccacagtgggtggatggaaaacagagtcatttaaatacaactgtgaagggtgctgtggaggaggggctcgaggtccccagtgtgggatggggtggtcatggaacatttccctatctaagtgggaaaagtgagagccaccaggaaaatggcaggggttggggggagaggaactgtgcaaagacccagaaggatgaagaagactgttggattagaggaggttaaagacacagacaggcttggacatggtggctcatgcctgtaatcccagcactttgggaggccaagacaggaggatcacttgaggccaggagttcaagaccaacctgggaaacacagtgagaccctatcactacaaaataaataaataaataaaataaaataaataaaaataaaaataaaaaaagccgggcatggtggtgcacgcttgtagtcccatctactcagcagactgaggtgggaggatcgcttgagcccaggagatggaggctgcagtgagctatgattgcaccactgcactccagcctgggcaacacagcaagatcctgtttataaaaacaaaacaaaacaaaaaacccagcttgagatggccagggatttccagaggccctaggcgggccaccttggagagtaagggagaccctgaagagctcgcatggaaggaccagcagcttggggctggagatgccacctggatggattcctccagctgtgtggactaggggacagggtgaggagataatggcctggactacatggaaggacgtcgccctgagccattgaaaagggctgtggggtccatgaccactcctggccttcccttgactatgatggagacagtagcttctagtgtaaaatgtgagctcagttcctgactcgtgtctagcgggtggtgcctggtctttggctggcgatgctccatgtcacctatgcccagaaactgggccatgccctttgtgaggacctgcccacaacgtcgttgttcccgcagggtccccggggaaccgggctgcccgggacccagccctgccagggttccctgcggcccaggccggaacccccagggctttggtcgttcccaaagccgtcccgcgggccccctccacggtgcgtcgcctgggccccagcgatggctaggctgcagcctggggctcccggccatcccgggcgctggcggcggtggaggcagcagggcggatggcgacgcccggccgcccgtgggcccaggcgcgtagtgcgtacagagccagcgaggtgctgcggcgcgtcacgggccgccggcgggacccggggccgcaatccaatgggccgggccgggaagacgcccgagccccgggccggctggctcgcctgctccgccagctccgggccgaagcggcttcgcggtccgaggtgccgcggctgctgaagctggtggagcgtgcgggggccggggcggcgggcgcgggcgagaggaccggcgcgcacagccgcggctccgtgtgctcagtatgcggggagccccgcggcagggccacctacccggcgggggtcctggaggtcagcgagcggcggctgcaggagggactcgcggcagtgcgcgaggagctgggcgccgagattgaggcgctgcgcgcggagcttcgagcggagctggacgctctgcgcgcgctgctgccgccgccgccgccgtccccgcctgcccgccgcgagccccgcgccgtcccccgcgccgcgccccgcggcccgaccctgctgcggacgctcggcaccgtgagcgccctggtcgccgcctccaggcccgcagacgacgccccggacggcccagcagaatgcggagcgcaccgagccccggccaggaagaaccacaagaagatgccagtgccgcctggggccccgcaaggtggcggggactgagggcggccgcacaagggcagcctaggcgaggtgcggaaggcgtcgcgctggctactctggtacccccaggacggggcaagtgagcagatcggtccccctcgtgtagcgtggctctgagtcagaagggtgcccgggtgccgccagttagggctccggtactggagggagggggtgggcgcgggacgggcggagggtgggccacgtgcgtctggggagtgcggatgggagccggggtccttgcgagagactgagtccggctagagaacagggtggagcccctttggaccttagagctgggcctttgggccttgggtctgggtcagcctttgggccagggctgggtcagcctccaggggaacagccgagactcctcttccttggggtgactgcacgttctttttctttcaaggtctcagtgacgaggcagggtctccacgcactggaatagtgtcaaaccacacacaagggcacagaacccagggacacagggcggctgagacacgcagctggtgatggccctcaggacggtgtcaaccagtatgtaatcacattccacacggcaccaattggacagcggcctccggtcagcctcactctgactgcaaccccctctcactggacagcatcacctggacacagagcctcacctagtctgtgtcccgtggacacaactttgctttggacagtgacaccaagaatactcacccctttacttagccagaccacaggcagccaccgggacacaaacatctctccagagtcaccctccacacagactccacagcagaactcccagggaggcactggggcatggcttcagagcaccaggcagcgctccgcggtgcccagcacccgctcagccagggcagcctgcagcggagcctggagccagcagcttctcatctcttggcctcgggaaatgtagctggagtcatcatttagcagagcacggtgtccctgggttggccacccagcttagttttaaaataaaataatgtaatcttggcctaatggtggaatttctgactgctagatgttctccttccatctgaccaggggattcagacacaatgtataggatgagggtgggggcccttctccctctgagaggaacctggagaggcccgggttctgctgaggtaggagagggtcactcagagggctcccacggaacagacaggcacactgaggcctcagtgggattagggcaggaaatgcccctcttgcagtgggggaccgcgccgggtcacgcacccaccccctccaggccacattaggctaaggtcactctgtgcattatttcattatttcacacggagggtcgcccacggttgacagaaccacaagctgagccccaggcgcatcagagcgcagtgcacacctgctagggtgggggaagagcggggggctgctgcggggaccgaggctctgggggaggccaagactgtgtgccccttaagaggctgctgtgggccaggcgcggtggctcacgcctgtaatcccagcactttgggaggccgaggcgggcggatcacgaggtcaggagatcgagaccatcctggctaacacggtgaaaccccgtttctactaaaaatacaaaaaattagccgggcgtgatggcgggcacctgtagtcccagctactcaggaggctgaggcaggagaatggcatgaacccgggaggcggagcttgcagtgagctgattccaccactgcactccagcctgggcgacacagcaagaccccgtctcaaaaaaaaaaagaggctgctgtgggcggaagttacccgtgagcggtatggggtgaaagtgggagggtccagcctggggcacggtgtggaacagggtcatctgagggtgcagggcaaagagatcaaaacggggtgggagaggggcagcgcctgcgggaggagccaggcaaggcccggggaggggtgtggggggcgaggggggacggtggctccacctgcacccaccggatgggtatggggtcctcgaagacggtccagagcaccgtgggctcgcagtcaggcggggtcagtgacccagcgaagcgacagtagctcgaggtgttgggccgcatcgacgccagcaggaaggtggacatcagattcactgagagccccaggcggcagagggagggggattggaaccagcctccccgtgccctgctggtgccatccccagcaaaccccccgcccctgagccggaaaacgacccggtggctcctcacctggctcaggcaccttcctcaagcccgacactatggcgcagaagttggtgttgctacagtcctgctcctgggaggggctccaagtgcaaggggttctgagtgggggagtctctgaagagggaactcagctgggatactctaagcaggaggctcccagtggcaggaggcatctggcatctgggaaatggggtggagggttctcgccgccactggccctgccgattcaggcattcccaccgccctatcctcccacagatcctatagaccctagagatccccccatggactccacaggcctagcctgtccacttccaggatccccatggaccccttttttggaaacatacatagaatcacagccctgccttcaccgccagcagcacctccagcagcagggcctgcactcgagcccatcaccgtggcgtggtgcctcctccatgctctggtactttgtgttactgtggaccacatgcatctgggggtaggcacagatgtgggagatacccagctgcccccaccttgctctctctcatctccgtgggagcactccggccaccccaccttgtgcccaagtctacctccatagcctggcgctgcctgtccaggctgtgctctgagtctgctcgcctcgggccccccccccgcccccagctgatgtgcagccgcagtgcgcggtagacaggcaacagcagcccagcctcccaaatctccaggtggttctgaggatcagtgtccattcagagtagcaatgaaggggaggaggcacacgacaccctctctacctcaccacctgcccaccttgtgccattagagcacagggtacgagcagaggcccttcctcaggccaggctgctccccagtggggccccattgcctccatggaatggaacccatggtgtccatggctcctgctggtcagcagagcagagttccacagactgcaggggaaaccctcccccacacacccagcatggcatggaagaaggcagagggcagccctcctggggtggggctctgagcccagctgtgtgtggtcagggatcctggccctgccagagaccctgactcctggtcctcaggggccatggctggttgtgatttgtagggtgggacctggcacctacacagagggcgcatctggactgctgtgtgaggatgctcctttcctgtgaagctagcccctgtggagggtttttggccctgtaggatgtctcagctcccgtgtgtagggggtcctggtccctgtgtacactcaggagctctcatgccctgtgtggggctcctgctcctgcctaggaggggtcctgaccacagggtgctgacctgtgtggctgtcattctccagggtccaagggcctggaggtgctgagtcatagcctcggaagatgaagggccctagggtagagttccgccggaccctgtgaaagtcaatgtcgatgagggactggcctgggcccccacaggcaggggccagcttcttccagtgggtggggactgctggaacaaggactggggcctttggggtgggggtggggtcagggaggcagcctgggggtgcagcagagagtggcccccatacacccagaggatagcccagcctcaggaaacccagctccctgcttcccccacacctgaacaggtcacagcatcccccttctcttgtaccctgcatctggcctatccatctagtctcccggttggctgccccatggtgagatgaaggcaaaagagtctctggcacacagttgcacacccacactgggacctctatcacctgcacacacttgggctggccacagtaacaggcacaccagccttgactgactcgggaccggcgatcacagcaggcccagactcacacacagggggacagtcacgcacttgcacctgatgcccagtcagtctactggggcagacgactacagacagaaacctgcaaaggccacagagtgcagggtgcagactgtctcttggccactcttgcaccactggcacatgctctggtggtcccaggacacagactgatctcactcagcctcacatgacactctgtcctcaccacacttggggtcctgggagtcgtagcaccaggcacctatagagacagtgggcaggaggctgagctgagagaccagtcatctgggtcctctccaagccccatcccatcagctggggtccaagaatgaagtaggccaggggcttaggccaggggaggccagtgaagaaccttctctcctgtcacccctaccccagtattttctctccccagtccctccccactcccagtggcaagacctaaggggtggtggagcatggcaagagggtagattggagaccagacgggaagagtcctggtgctcactctcagagtctgcgccacaccagctgcactgcaaggcgagcatgatgccaggggcgtgcgtggctcagtggcagccgcagctaggaaggactagaaagtggctagacctcggagccaagatgctggcctggctactacatatttattcattagctagctgggctaggggcgtggctattgaggagaggatgggaggggtcggtgcccaggcagggccaccaggaagagcgcgagcgctccaaactcacccaggtgtgctgtggtcccagggctgcactgatgccagcaacaatcgctgaggttaatcctgcaggggaggggtgacctattattatccccacttacagtccaggaaacagaggctggggaccagaatgacacaccaaagccaccagcaagaaaggtcaaatagtgagggcaccttgaaccccagcgctcatgactttcggggcaaggatgggaggaaggtgtaggatgtctcttgccccactgtgggcctggaactgccaccccatcccaagaccacagcctccctcctgcccaggcccccctgcggatccaggccaagacggagccctgcaggaggtcagaggaggggacttctttgcaccctgcgcctctttccaatcgccagagggcagggccctacccacattggggatgggaagtcaaatgcagaagttaggtgaagtcagttcttggatactcctgtactgtcaccctggtcttatctcatgccttagcccaagctgtgcacacaatggggtcctaggtccccctcacctcccagattccaccttcccagggatgggaccccctagaaccctcgggggcctgggcagtggccttgctggctcttgccttcctaggagctgagcaggagctccactctcagcagggcagttcactgcagcctctgcttcctcagctcaagccatcctcccacctcagcctcctgagtagctgggaatgcagacacacaccaccacgcctggcaaatttttgtatttttagtagaaacagggtttcaccatgttgcccaggctggtcttgaatgcttgagctcaagcgatctacccacctcgggctcccaaagtgtgggagccaagatgggaacccaagcatacggccccaatgctgaggctctgaactactgacctgccctcagcactcagccttgggatcatgagtcactgtgcaagggagttccaacatctgcatgtatgtctggaatgatctgagcctgcagagttcctacacactggccacattatagggtggtgtctgtggtcacacagctcaggtcaggtatttattagtacatgaatagcttagctgtgtcatagtctttatgtgaaaggcacataaaaggcactttggcaggctcaaagtgtggggattataggtgtcagccaccgtgcctagcccactggatgacttatgatatcatatgtgacattgtgacatcatgtgagtcagggatgtaccccgttctcagctgctatatgctatgttacagtgacagaatgggaatgaagaatgtgtcccactctctcagctgttgtattatatcatacaaggtgcagtgactaagtgtgtcagctgtgtcctcatcctacatagcatatgagagtgtgtgacgggagataggatgcagacctgagaagcattaaacacctaggcaataaaggtgccagcatcagctgagagcgcaggtagacctcagtcacatttgttactgtgtaactaaaaatacaaaattagctgggtgaggtggtgcacgcctgtggtccccactgctcaggcgcctgaggcaggagaattgcttgaacccaggaggcagaggttgcagtgagctgagattacaccactgcactccagccttggggacagagtgagactgtatctcaaaaaaataaaataaaataatctaggacaaccaagagaaggactcaggctcaccttactctatgtcacatgtgatatataacacttgagggggacacacacttgtcactttgtatcactatgtcctatatgatagccaatgataacccaagagggggaggcagccttgttcacaccatgtcacttatgatattatatgacatcaaggagcccagacctcagttgcattatgtcactatggcacatacagtatcatgcaacaactgacagaagggttgtgggcctgattcacagtgtatgtgagtcacaaatgtcacttatgacaccatacagcaggtgagaggggatagtcattattcacctcgggtcacattgtcacacatgataccatatgatagcagagggggatgcagaactgagttgtattatgtcgctatgtaacctgtgatagatgatagctgatgcgggtgaagaccaaagttacattttgtacctacattatatgaaatatacaacatgcacgagggaggtgcagacacaaatcacactgtgtgctgtatcccatatatgtgtttaatttctgtgtttaagagagctgggttcatgaatgaacgtagtcactgcaccttgtatgatataatacaacagctgagagagtgggacacattcctcattcccattctgtcagtgattgaccacaccttgtgttaactgtatgagccactgtgtttggccgtgtatagcgcacgtggcacattgttcactgatacatatttgctccgtactgaagtgaggcagatgcatgagtgattgagaataatgctaccttggtgaagcattccatttagaagcatgaggttcaggtactaccatcttctgtgatacatatttaaatgttaagtttaacagttaggtctaccatgagtgaatgagccttgcattatctttgagaatcgatgtgtttagcagggtgtggctcatctaagatagccttctttaatgcatgttcactatctgtgtttattagaaataggtttgtgaatgacttagcatagtgttttccctatgaaaccctgtttatttatttatttatttattttgagatggagttttgctcttgcaacccaggctggagtgcaatggtgtggtctcggatcactgcaacctctgcctcccaggttcaagcgattctcctgcctcagcctcctgagtagctgggattacgggcgtctgccaccacacccagctaatttttgtatttttagtagagacggggtttcaccatgttggccaggctggtctcgagctcctgacctcaggtgatcctcctgcctcagcctcccaaagtgctggaattacaggcgtgagccaccacacccggccaaaaccctgttttaagaagtgtgtggtgcaggtactacattctttgttgttccaagttcaaaccctgtgtttaacagagataggtgcaagattgcctaggtgtagcgtagactcttggaaatactgtggttagcattctgtgttttctgtagcatagtttcagtgatgcctgtttagatagtttatcagatctaggtactagtgttatgtcagcgaaacactgtttagctgcacgcggtgcatgtaatactttgttcattgatatttgtttaaatcaatcagtgtttaccagaactagatatgtgagttactgagaatagcctaatctctgaaaatgttttccagcctatggtgcatgtaatatactcttctatggtacctctttccaatgtttttattgtggcaaaatatacataacagattataccatttttaagtgtagaatttagtggtagtaagtatagagagaaccttaaaagcagcaagagaaaagtgacttctcatgtgcaagggagcctctagaagattatcagtggatatttcagcagaaaccctgcaggccagaaggtggtgggatgatacattgaaagtactgaaagagtaaagcctgccaactgagaatactatatttgacaaaactgtccttcaaaagtgaaggagaaattaagacattcccagataaataaaagctgaaggagtttattaccactagacctgaccaataagaaataataaaggggccaggcacagtggctcatgtctgtaatcccagcactttcgggggccgaggcaggtggatcacctgaggtcaggtgttcaagaccagcttgaccaacatggcgaaaccccatctctaataaaaatacaaaaattagctgggtgtggtggcacgcacctgtaatcctagctactcaggaggctgaggcaggagaatcacttgtacccgggaggtagaggttgcagtgagctgagatcacaccactgcactccagtctgggcaacggagcgagacttcatctcaaaaaaaaaaaaagaaacaataaagggagtccttcaagttgatatgaagggatactagacagttgctcagcctgatgaaaatataaaggtaaatacataaagattaaaacctgtattattgtaatttttgctaataactcaatttttaatactttaatggaatttaaaggacaaaagcataataattataaatctatgttaatggatacaaagtatataaagtttaatttgtgacatcagtaacttaatagtggggcaaagatgtaaagagtagaggttttgtatgtgattgaagttatctgtttaaaataataagataactttaagatgttccatgtaattcccatagtaaccacaaagaaaatacctacagaatatatgcaaaaggaaatgagaaggaaatcagagcatagcactacaaaaaatcaactataacacaaaggaagacaataagggaggaaagaaggacaaaaaggctctaaacatacagaaaacaatgaccaaaatggtggtagtaagtccttcctaatcaataatttcattaaatgtgcataggttaaactcccaataaaaagacataaatcggctgattggatttaaaaaaacgggattcaactatatatgctgtctacaagagactcatttgaaatccaatacaaatgggttgaaaaatgagagaatggagaatattccgtgcaaaaagtaaccaaaacagatcaggaatggctgtacaagttatggctgtacaagttgttgggttttatgttactgaagaatgaacagagatgagtaagtggaggtgttatgtaaaggcatactgtactcaaaatctgaagacctgcagcagatttaaattccagctcttattataactttttaaaagattgtgaaaatatcaaaatatagatgaatcaagttttaatatactgtatgatgggtggatgaggctgtccattgtaccatttgtttgaattctcaggcatggtttggcagtgcaagaactctgtaacgttaacaaattcaataaaaagtaaatatatggaaaaaaaagtatagacaaaatagattttaagtaaaaaactattacaagagagggttctgggaagaaagtggagtaggaagcactgggaattcatctccccacctagaaaataatcacactggcagaatctgcctgatataactattttggaactctagactctatcaaaggaggcttgtaacctccaaatgaaggcttaaactataatttttacttaattttggtcaatttcagctcttagctcagcagtggctacccaatccccatgccccagcttcacggcaagaagctttgcatgtgttcctgaagcagcttgtaccaagcttgtgggaacaatcatgggcaataagcactctgtcctccaagtgttagcatctgcgttctggttgttgattgctacttttgattatggaagggcaaacacagaggctggcagccattattgctcacaactccccactccactgctgcaagcccttaccagactgaagcaacttctaggagatagaaaaggccagaaccccatttcccttccccttcattgttctcttttccttttttgggagccaaacattaaagactaggacactcaaaagcaatggcatacccagaggaaattaaagttaccacacatccttggagagaggagtgtgtgcccagggaaaggagcagcttcagacctgagaagacctcaagcttacaactcaggttgatcctcagcatggagacaacctacaacaatgtaaaacataacaaaaccccaaaacagcaaaccctgaggaagaggagagtctcatctccagagttactgcattattatattcaagtgtccagttttcaatacaaaacacaaggcatacaaaaaacaagaaaatatggtatttcaaaggaaaaacaacaacagaaactgttccagagaaagaccagatggtaacctactacacaaatactttaaaacaactttcttaaagatggtcaaagaactgaaggaagatgtggagaaagtcagtaaaattatgtgtaaacaaaatgggaatatcaataaagagatagaaaacctaaaaagaaaaaaaataaataaattctggaactaaaagtgtagtgattgaaataaaagttcaccagagggattcaaaagcagatttgagcaacagaagaaagattcagtgaatttgaagatgggacacttgaaatgatcaagtcagaggaacagaaataaagatgattgttgaatagcaagcagacattgtggaagtcccaaaagaagagagggaaaggggcagagagatcatttgaagaaataatggctgaggctgaacacggtgactcacacctgtaatcccagcactttgggaggccaaggtgggtggatcacaaggttaggagttcgagaccagcctggccaatatggtgaaaccccgtctctactaaaaacacaaaattagccaggtgtggtggtgcatgcctgtaatcccagctacttgggaggatgaggcaagagaatcgcttgaacccaggaggcagatgttgcagtgagccgagattgtgccattgccctccagcctgggcaacaagagtgaaactccgtttaaaaaaaaaaaaattagctgggcgtggtggcacgtacctgtagtcccagctactcaggaggctgaggcagaagaatcgcttgaatccaggaggcagaggttgcagtgagccaagatcacaccactgtactctagcctgggcaacagagcgagactctgtctcaaaaaagaaaaaaaaaaagctgaacacttcccaaatttgatgaaagacatgaaaataaatatccagaaaactcaatggactccaagtaggatgaaaaaaaaaaaaaagactcatactgagacattataattagccagtagggcctcttgaaagcaccaagagagaagcaactagtcacatgctaggaatatataataggattataagtagatttctcatcagacactttggagaacagaagacaatgggatgacatatgtaaagggctaaaagaaaaacaaccactacctctcaaccaagaatcctatatccagcaaaactgtccttcaaaagtgaggaagaaattgggaaatccccaaataaaccaaagttgagaagtttgctaccattagacctgccctgcaagaaatcttaaagagaatcatgcaggttgaaaagaaagaacactagatagtaactcaaagccatatgaagaaataaagatgccagtaaaagtaaatatatgggaaaatattaaatctagtattatcgtaactttggtttaaaactccatgttttgctttctacataatttaatagacaaatgcattaaaaacaattattagtttatgtttatggacacacaatgtacaaaaatgtaattttgtgacattgataactgaaagaggagtggcaaaactgtgaggagagtttttgcatattattgaaatatagctggtatgaattcaagttagagtgctataactttagaatgttaagtgtaatccctatggtaaccacaaataaaacattatataacataaaaaagtaaatgagaagggaattaaaacacttcgctacaaaaaatcaactaaatacaaatgagatcatgcaggaaatggacaaaaatgctgtaaggcatatagaaaatgtatagcaaaatgccagaagtaagtccccccttatcagtaattactttattactttttaaaccattttgttgaggaatgatttacataaaaactgtacatatttaacgtacacatcttgataaatttacaccataaaaccattatcatcaagcctataaacatatccatcaccttttaaaatttccttctgcctctttattattattattgtataaaaaaaagtttttaatggccaggtgcggtggctcacgcctgtaatcccagcactttgggaggctgaggcaggcggatcacctgagatcaggagttggagagcagcctggctaagatggcaaaaccccatctctactataaatacaaaaattagctgggcgtggtggcgggtacctataatctgagcaaagtactgggaggctgaggtgggagaatctcttgaacctgggaggcggaggttgcagtgagccgagacagcaccattgcactccagcctgagcaacaagagtgaaaatctgtctaaaaaaaaataataataataaaagtttttaattaaacaatttaagaatatagtaacattttctgtgggtactatgctgtatagctctccagaacttacttatcttgcataactgaaatttgtacactttaaccatcaacttcccatttccttctcttccccagctcccagcaaccaccattctgttctcttcttctgagtttgacgtctttaggttccacacataagtgagattgtacaatatttcactttctgtgtctggcttattttacttaacataatgccctccagtccatctatgcatagaaatgcaactgatttttggatgttgactctgtatcttgctactttattgaatttattacttctaacagtcttttagtgaagtctttacagttttctatacataaaaatatgtcatctatggagaccattttacttccattcttatttctttacttgcttaattgttctggctaggacttccagtcctattttgaggagaaatggtgagagtaggaattcttgtcttgttcttcatcttcgaggaaaaacgttcagtctttcactgttgagtatgttacatgtggtcttcattatgttgaggtacattccttctgcacctaatttgctcagtttgttgttttttttaatcatgaaaggatgttgaattttatcaagtgctttttaataataaaaataaaggatttttatcgtttattgtgttgatgtggtgtatcacatttagtgactcttgtatgttaaagcatccttgcatgccagagataaatcccacttgatcctggtgaataattctttttttgttttttatttatttattatgtatttatttttttgagatggagtctcgctctgtcatccaggcctgagtgcagtggcgcgatctcggctcactacaagctccgcctcccaagttcacgccattctcctgcctcagcctccctagtagctgggaccacaggcacccgccagcatgctcagctaattttttttttttttggatttttggtagagactggattcatggtgaataattcttttaatgcactgttgaatttggtttactagtatttcattgaggatttttgcatctatgttaaccagggatattgacctatagttttcttattttgtagtgttcttatctggcattgatatcaggataatgctggcctcttagaatgagtttcaatgtgttcccttttcttcaatttttttggaagagtttgagaaggattgttattaattctttaaatgtttgttgaaattgaccagtaaaaccatttggtcctgggattttctttgttgggagatttttcattactggtttaatctctacttattttttctgtttttttttttttttttaattatactttaagttctggggtagccgtgcagaaagtgcaggtttatcacttaggtatacatgtgccatggtggtttgctgcacccatcaacccatcatttacattaggtacttctcctaatactatctctccccttgcccccatcccccaacaggcctcagtgtgtgatattccctgccctgtgtccaagtgttctgattgttcaactcccacttatgagtgagaacatgcggagtttggttttccgttcctgtagttttcagatgtgctctggcctccaaggaccatgaagccaggcggtggtgggggggtgtcctctgtataaaaagtgctgtcccaggaacttcctgacggacactttggggcatgtgagcgattcctggggagggcacctcggccttcctaaggctacccctgcagccagtgctggccattctcaccagcaaccaaccaaaaaacatcagagtccctgtaaacctggttgtgatgataaaaaccaaatgttttctaatctaagacttgtatgcagaacacagaaaactgcagttaaggaacaccctacaaaattgaccaacagtattttccaaaaacatttttcatcacttcaaataatgtacaaaatctacaaaaatcatatttaccaggacacatctgttaaataaaagcattgtttcgtgttggtatacatatacacaagactatgtataacagactgtttcccctccctgcaaccacagaaccatcacacacaggcacagatacacgtcggctatgccgctttccacgaatgcatggaacccaggacgcgaacccacagctcgaggtcttataccttcactactgagctgccgccactgcagcagcaacacctctgcggaggtgtcgctgaagtcactggtgtccctgcccaaggtgtcctggtcctggtcaactctactgattgacccttcgtggatacctcaggtctaaaatcctttcctccgagccagagctcttcctgttgtgcaaactcagccccgtctgtaccttcctgcttggccggtgatcgcagtccttcttcgccagcaagtgtgggcttccaaagacagggctgggcctggcctgggactccctgaaggccgagaaggacaggccctgcagaggcagccccaggtaggggctgaagaggccggtctccctgcccccccaggagacaccctttccaaagtggaagagctgggtggacagcagcggggagaagcccgcaaggggcaggctgggcaggccccgggcggggccctcggaccccttgtctctctctcccaatgccgccccctccacgccgcatctctacctttggagcgcagtgcccatgggctgggcagccgactgtggtgggcaaagtcactccagggcggggcgcggttggcctgggctccagcatccctctcagctcccgggctgggggtcaggaagctccggttcctgcagtccacgtgaaaggtccccctggctcctcctgcctcggtgcccgctgtggcacagctgggccgctgaccaaaagcacttttggcagcaggctcagcccctcgtgggctctggtctttgtaaacgtaaacatttctcttgctcactgagagaccttggcggagacactgccgctggtcctcctgggtggcgcatgatcccctccgccggatcagtggggagccccttcccaccctggctgagcaggcacgctgcgccctgtgctcctgcgctccctgcgcctcgatgccctttagccaaatgtgggaccccccggccctctggctccgtgtgcacatgccaggcagtggggccggctccttcctgcaaggtacctctggcctggctgggccccctgtcccgagagcggtggggccctctgcctgaacttctgaactgctcaccgactccttggccttttccaccaaaaacttcctaatctccagttcgatgctatcgtcgctgtccactgaactgctgttgtcagacaaggagccagggctgggagctgggccctgggactctctggggaatagattctcttcggaggcggaggcagaagcgggtctcctcaccaggaaggccggggcttcgtcctctcggccctgctgccaaagacactggggggtttcttcctggagccctcgcagctgtctctcttggacttaggcagctcttcagcacctgcaggtgcctgtttttccactctctcaggagcctgcccagctgctcctggaagtgcgtctgggaggtgctgaacctgaccttcttcctgcacacagccctgggctccctggacctcttcttgagctttcacttggaccttaacaagtccttgatggctgtgtccaggtccttgtcactgtccagggaactgcttttgtcttcggagctcttcttcttgtctaggtgccttgcctcgtctgtcttaccctggccctgtgacgtgcgagtgtcaccgggcaccctagcggcgccctctcctcccggggcctcgctggctgtgccctggatggaaaggtcccgcccctcatggcccggcccggctctcccctggctgcggtcggcatcctggccaccctctttccccaccacccgcatgttcttgggagtggatggcctcacttggcagccgcctctatgcttccttttgcagccaggagtgggtccagtgttttagagagaggggccttggggctgccggtctggctgctgaggccaggtggtgaaagtgggccctgggcagcctgagggcagctctcacctctggccagcaaacttctagactgcaccttgagggccaaaaacgtccagatttcctgctcaatgctgtcgtcgctgtccacggagctactgtcaccatcagagcgggaaggcacgttgggggagtagaagagtgggcttgcggacagggacccatcgctgccctccatagggccggcaggatcgtcttgaaaatgtccaggactgcttctacacacatcagctcagcggaggtgtctgcctggcaagaggaccattccacaaacttgctcctggaagccgggctcgttggaggtggagctttggtttcctttgggatcttgggggaatggtcagcgtccagatcccctggaccagggtccgtggtcttggtgggcactggcttcttcttgctgggtgttttcctgtgggtctctggcaaggcactttttgtggcgctgcttgtgctgtgtgcgggaggggcaggtgctctttcctcttggagctggaccctctggggcgggtccccgtcggcctccttgcgtgttttctgcacctggtacagctggatggcctcctcaatgccgtcgtcgctgctggagtcggacgcctcgggcgcctgtacggcgctcgtgactcgctttcccctccttgcggtgctggcgttccttttaatcccacttttattctgtactgcttctgaagggcggtgggggttgctggctttgtgctgccctccttctcctgcgtggtcgtgaccttggacctgaggcttctgggctgcacgtttgtctttgctaaccgggggaggtctgcagaaggcgaactccttctggacgcccatcaggccctgccggtgcaccacctttgtagccggctcttggtgggatttcgagagtgacttcgccgaattttcatgtgtgtctggtttcttctccactgacccatcacatttttggttctcatgctgtcttttctcattcagaaactgttcgatttctgccctgatgctctgctcaaaggagtctgctctgctcatgctgactggggaggcagagccctggtccttgctggatcccacctggctgccagggccacaccacctgagccaggtacaagttttggggaacacagggcagttgggcactgctgtgagccagttccggcttacatctactgcctccgcctgcagccctggaaggctgtgcatggctgggccccgctggccccgggctgtgcggctccactctttaccttcaggtactcctggatggcctcctcaatgtcccggtccacggaatcgtcactgtctgaatctagcaccaatgggccaaagtctgcagtttcctcctcccccacggggtcaaagtcagcaacaagaccacaggcagccaacgcaggcagctccttgtgcatggtgggcttggcagcaggcctggcgtcgtggcatccctctgccccctctgcgcagtgcgctcatcgctggtgcccctagcagccctgtcgctctgcagcgtgctgatgagcatctgcacccgggtgctcaccgacatgctctccacgcccttgtcagcctccgagaagcacccggggaacctaaagctccctggtgggacagaggccacccatttgcgctggagagcaaccactggaggagcattcatgagaaacattctggcagatggggagcgacgcgcagaggggcgacactttatttctctgcaggcttcacatcctccaaagattggcaagcagtacccgtgaaataactttaaacctgcaaatgcttctttgcaggtttaaaaggatgactataaactatgacgtcatgcctagattcattcttgacccaaccaacaagctcttgacattctctgagtccaggttgactgtgatgaaaggcagctagtgttcccaaatggcccagggatcaggtcttcatcgctccactcagagggaagcatcctctctctgctttttaaatagacttttgactggggctccagcagcgcggggcgcgcagacctggagttgcatggaggccagagccacgacacccgcctggggaacggagcagccccaggcgctgatccccgtccacctgccccacggagccctcgccgcccgcttgccactgcctgcatggccctcctgtccccggccccccagccctcctttccccagctcccccaccctcctgtccccggcaccccagcttcccagcccccgaaaccgcccccccacctcgacccggcccatgccgcaagtcgcccgctgcgcggacccggcctccgcccgcctcctgcgtcctgggggaggcggctgccgggggtggtgggggagggagagggggaagaggccgccctccgcccgggtgcggggagggggcgcaggggtgtccggccaggccccccgcctccccgcctccccgcagcagctgccccgctcccgggccgcctaatacttttacattttaacttttatactacagtgaaaagtgatttacacaccaccactgcaatattacagtgttatgaatgtgactatatacttacctttccctgtgaacttttttttttgagacagagtctcgctctgtcgcccaggctggagggcagtgtccatgatctcggctcgctgcaagctctgcctcccgggttcaagtcattctcctgcctcggcctcccgagtagctgggactacaggcacccgccaccacgcctggctaattttttgtatttttagtagagacggggtttcaccgtgttagccagcatgatccccctcttctgaccttgtgatccacccgccttggcctcccaaagtgctgggattacaggcgtgagccactgcgcccggcctacctgtgaacttaatatcttaatgttttaatgttgctaatcagaatccttttatttcaacttgaaaaactgccttataaggcaggtgcagtggtgatgaactcccttagaatttttttggtgggagtctgggaaagaccttatcatctctttttcatttctgaaggacagctttacaagttgtggtcttcctgattggcagtttttttcttccaatacattgaatatagcatcctattctctcctggcttataaggttgctgctgagaaatccactgatagccttattgaagtttccttgtatgtgatgaattcctttcttcttgctgcttttgaaagtctctgtctttgacttttgatattttaattataatacatcttggtattatggtctttgggctggccttttttggggcctctgaacttcatgtgtctggaagcccacttgcctctaagaatttggaaagtttttacccattatgtcttcaaatatactttcaggccttttctatcttttttacttctagaaagtccataatatgtttgacccacttcatggtggtgtcctataaatcccaaaggtttttactttataaacttttttttctttctggtcttctgacgggatatttcaaatgtcctgtctttaatttcacagattctttcttctgtttgatcaagtctgcaattgaaattctctattgcattttcatttcattcatttatttatttttatatatttttgagacagagtctgtgtcacccaggcttgaatgcagtggtgccatcttggctcactccaacttccacctcccggttcaagcgattctcctgcctcagcctccctagtagctaggattacaggcatatgccaccatgcctggctaatttttgtatttttaatacagatggggttttggcatgttggccaggctggtcttgaactcttgccatcaagtgatctgcctgcctcggcctcccaaagtgctgggattacaggcgtccgccacggcacccagcttgcattttcattttattcattgtattcttcagttctagaatttctgtttggttcttattatttctgtatctttattgaacttttagttttgttcatctactattttcttgatattattgagttgatatatacattctagtaaatttcactgagctatcttaattattttgaattgtcaggcaatttgtagatctctatttttggggggttgattactggagatttatgagtttattttggtagtgtcatatttgctgattcttcatgatctacaaactttcattaatgtctatgaagaagcaaatacctcttcttttcttttttttttttttttgagacagagtcttgctctgtcacccagctggagtgcagtggcgtgatctcagctcactgtaacctccacctcccaggttcaaatgattctcctgcctcagcctcccaagcagctgggatcacaggcatgtgccaccacgcctggccaatttttttgtattttttgtagagacagagtttcaccgtgttgtccaggctggtctcaaactcctggcctcaagtggtctgcccgccttggcctcccaaagtgctgggattacagttgtgagccaccatgcccaatctctttctgtctttatagattggtttcagcaggtacaaaccttttcctgctggatcccttgactggatcacagtcaagtgggcctggagccatatcacatggctgctgcctggtctgcagctgaatctctgattggcaggccgctatcaaggcataggttggtgatgcagtttctgctggatcctcaggagaactggactgcctctgataccctgattgaacaggactggagccaggtcatggggccacttctagttctacagtcaagtcttcagatatcaggcctattaccaagggcatggactggtatagctccctgtgggtcccagattgagctcctgctggcttactaggtaggtccatgggaagacaggactgcctccagaccacagtagagcagggctagagccaagtcacaggacagctttggtgaccacatttgggttcaagattggtggtcctcttattaggagaatggatggtatgtctttcaccaggtcccaggatgggctggactgtgcccagactgtggcaaagcaagactggaatggagtcacagggctactttagtgtccatagctgagactgagatcagcaggcctgttaccaagggcatgtaaaggcatcactgaattcctgggcaggcacgactgactgtggtagagtggggctgaagccaggtcagggctgctttagtttctgcagtcaggaccatggttagaaggcctgttactgggggcataaatggtcatggttcctcctaggtgcttagtggatggggctagttgcaagaccatgatctagtggagctggacccaagtccataggaggacaaagctgctttcagtctgcaactgggaacctgtcactggtgtgtggacctgccttctcaaagcagctctccttggttttgggctttgctagagttttgccacctcctgcctggatattaaaactcttgcaaaggcagttttgtccatgaatggctgccagatcattgtttgtgtggggagaggtgagtggagggcctcctgttctgccatcttgctgatgtcaccctaagatgattatttgaattctttgtcaggcaatttgtagatcttcatgtctttggagtcagccactggagtttcattttgtttctttggtggtgtcatattttctcatgcttcctgttctttgaagacttagattgctttcttcatgtttgaagaaggagtcatcttttccactctttactaacttcaggagagaaagaccatcaattagctaagctatagattctgggggtctctcagtccttttctgtgggtggtccttccctttcaagggggatgtcttaggattttgtcccttgtcttcatttcacaaatgaataaaacaaccagaccagacataagtaaggaaatacagcacttgaacaacacctgaaaaaacaactagacctaacagacatacacaggatattctacccaacaacataatacacatacttctcaagtatacatgggacattttcaggatagaccacataacacatcacaaattaattctcaataggggctgggtgcagtggctcacatctgtaatcacagagtaatttgggaggctgaggcgggtggattgcttgaagccaggagcttgacatcagcctggccaacatggtgaaaccccatctctactaaaaatacaaaaattagctgggcgtggtggtgtgtgcctgtgatcccagcttcttgggaggctgaagcgtgagaattgcttaggagcccaggaggttgaagctgtagtgagcagagattgtaccactgtactccagcctgtacttcatgacaaagaaaatgtaccattgtaccactgacagaatgagaccctgtcccaaaaaaggaaaaaagctcagtagatttaaaatgatagacatcatacaaagtgtcttctctgaccacaacaggataaagttagaaatcaataacagaagattttaaaaagttcacaaattagtagaatttaaacaacacactctcaaacaaccaatggatcaaagaaatcacaaagaaattataaaattcttaaagacaaatgaaaatgaaagcacactatatccaaacttatgggttgtggccagttgtggtggctcacacctgtaatcccagcactttgggagactgagggaggtggatagctagaagtcaggagttcaagatcagccaggccaacatggcgaaaccctgtctctactaaaaacacaaaaattagctgggagtggtggtacgtgcctgtagtcccagctacccagcaggctgaggcatgagaatttcttgaacccaggaggcagaggttgcaccactgagctaacaccactgcactccagcctgggtgacagaatgagactctgtctcaaaaaacaaagaaacaacaaaaaaacacaacttatgagttgtggtgaaaggagtgctaaggaggaaatttatagctataaacacattaaaaaaagaaacacctcaattcaacaacataagtttacacattaagaaactagaaaaagaagaataaaactaaacccaaagttagcagaaggaaggaaacaatagagatcagggcagagataaatggaaaagagaatagaaaaacaataaaaaacaaaaccaaaagttggttcttcaaaaagattaataaaactgacaagactaaggaaaagggaaacaatctaaattacttaaaacagaaatgtatttgagaatatctttatatatttctgtctgtctgtctgtctgtctgtctgcctgtctatgttttagagacaaggtctagctccattgccctggcaacaatcagatgcaaccacaatcagtggcacaatcggctcactgcagccttgaattcctgggctcgccactatgccagctctttttttttttttttttaagagacaggatcttgccatgttatccaggctgatcttgaactcctggcctcaaggaattttcccacctcggcctcccaaattgttggattacaggcatgacccaccattcccagcctagaaaggattataaaagattactataaataattgtgtgctcataaattggataacccagatgaaatagatgaattccgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgtctcatgcctgtaatcccaacactttgggagcctgaggtagaagttgaggtcaggaggtccaagacaagcctgggcaacatagtgagtctacaaaaaaaatattgagaatctacataaatatagtgggggtgggggtggggaacaagaaaacaaaaaattcaaagcatagtgaaaagaaatatagcaaaacccagccgggcatggtgcctcacgcctgtaatctcagcactttgagaggccgaggcatgtggatcacggggtcaggagatcgagaccatcctggctaacacagtgaaacctgtctctactaaaaatacagaaaaattagccacatgtggtggcgggtgcctgcagtcccagctacttgggaggctgaggcaggagaatggcgtgaacctgggaggcggagcttgcagtgagccgatatcgcgccactgcactccagcctgggcgatagagcgagactccgtctcacaaaaaaaaaaaaaaaagaaagaaagaaatatagcaaaacacaacaaaaaaattaaaatttgctgggtgtagttgtgcctttagtctcagctactggggagggtctgctggaggatcacttgagcccaggggttcaaggctgtgattaagccactgcactccagcctgggtaacagagcaagatcgtatctctaaaaaaaaaaaagaaaaaagaaaacactctctggccacagatgagagaaggcagacaggaagccagtaagccaagcaggcagagggcaggtggccccagcccagctgtcgggtggtgagcagtgtcagggagacaggagtgccggagctggtgaggttcccaaggaggtgaggttgcctgtggccccctcccagggcacagtcccacccctccagtagtgcactctgtcctccctggtaggtacaggcttttccccaccaccatggtgcagccatgcctgcccccaacaccactggtgcagctccatcctccacgcagtggtgcagccccatcccagcgcccattcgagctgctgtcccattgcagggggcattgtgacagctgaggacctgaacaactaccgtgctgagctgatcgagcacccgctgaacatcagcctgggagacgcggtgctgtacatgcccagtgcgcggctcagcgggcccgtgctggccctcatcctcaacatcctcaaaggtgagtggtcgcaccacagccgtgtggtaggacccatgacactgcctctctctccccacgccccacccctcctgcatctctgctcgccccccatgccacgtctttccatcactgagctcctgaggtgtgtccctgcgtcacagctcaccatgtcctgaaggaggcagtgcagagcaacagggctgaagcgggcaatgctcaagggttggaggaggaacaggagtcatcaggagggagagaggtgcaggagctcagggctgcagggccggtccagagggtaccccggtccagtgggtgaccctgccacttggtcattgaatggccagagctgatgcgtgacgtgaggtccaggctcaggagccctcaccttacttcactctcaccacagccttctgaagcagctgctgctattggttattaaacgctccttgaggtgggcaaagtggctcaggcaggtgttaaccctctgagcccctcagagcctctggggctcagcaacatgcacctggctctgatcaaccagggtacaacttctcccgggagagcgtggagacccccgagcagaagggcctgacgtaccaccgcatcgtagaggctttccggtttgcctacgccaagaggaccctgcttggggaccccaagtttgtggatgtgactgaggtaaggggcaggggctggctcactgtgggtgtggggcctgccgtagaggcatcaggtgggctccccagggtggctacagcctcacatatgctttatgaatccattcctgccacagaatttgattgcgggcctactgtgtgctcggatggactcgtgggtgacccccagtcttggcttctgccccacagaactgacagtgtggggaattagtggccaccctcctacctcaggtcctttgcacatgctgtggttcttgagtgctcagtgctgagatgaggaatgcatgggggcattgcagccctcgggcatggtgagatggatgggtgaaagggagagggccaggtgaacagagacctcggccacccactccctgtcactccaaactaacgcttcccagatgccaccctcagccctgcaccacctgacccactcacccagtagttgccccagctccatgctgggtccctataagaccctgtcatatcccttcccgctgaggatcctcacatccctccttacctacttgggtccttggcattcctgggcggatctgcagacccccccacactgaccagtgacctcccaggaggggcgtcagctgcccgggtggtgtcttctctttccctgtgagcattctgcacctctgactcccgctgcagccagtgacctggtgtcttgtctctctaaggggacagagccactgcagcgtgtccctctgccctcctttttggctaaggccaggtccttcatctactcgctggctcggggtgctgttcctacaatgctcctgtctgcctctgatgatttatttctttatcacggattattcccaaaaaaaaggcagctgttattgctctagagacttctatctgctgcctccttctgtcctttgctcctcttagagcaaacatggctgggctatgtcctctctcccttcagggtatcccctcccctgctctatccccatgccaccagatcgccatgtccagcctcagtttccccatcaggccccactcagcagcatctcacacagctcaccacactctcctcgagttttcattttgcaaattttcgcacctacaaaaatgtaaaaaaaacccaaaactgcccaagcatcaatgttcccttttcctggattctgcagtgtggacatttctgccggatttcctaactctctccgtctccacccacatctattgggattcgtgtttttctgagggattccacagtaggttactgatgtcgcacctcagggtgtgtctcaaaagtgagacttgaacatagcacagcaggatgtcggggtgacacaacctgctgtcccttctctttacctacagtaggctcccttggctgttttgtttttgttgtgtttttgtttgtacacagagtctctgtcatccaggttggagtgcagtggtgtgatcttggctcactgcagcctcaacctccagggctcaagcaatcctcccacttcagccccctgagcagctgggaccagaggcacgtgccaccaaacctggataatttttgtattttttttagagacagggtcttgcccagactggtctcaaactcctgggatcaaactgtcttcccacctcagcctcccaaagcgctgggattacaggtgtgttttttctttgagacggagtctcgctctgttgcccaggctggagtgcagtggcgctatctcggctcactgcaagctccgcctcctgggttcacgccattctcctgcctcagcctcccgagtagctgggactacaggcgcccgacactgcgcccagctaattttttgtatttttagtagagacggggtttcaccgtgatcgcgatctcctgacctcgtgatccgcctgcctcggcctcccaaagtgctgggattacaggcatgagccaccgtgcctggcctgttttgttgatttttaaagcccagggcagtagtcttggaaaatgtcccacatcgtggatttgcctttctgtttccttgagggcagattcagacagaacacctttccctgggattggtcagctaatccgtggggtgttgctgaaactttattttattttattttattttattttattttatttttgagacggagtctcgctctgtcccccaggctgtcccccaggctggagtgcagtggcgggatctcggctcactgcaagctccgcctcccaggttcacgccattctcctgcctcagccccccaagtagctgggactacaggtgcccaccaccgcgcccagctaattttttgtatttttagtagagacggggtttcactgtgttagccaggatggtctcgatctcctgacgtcatgatccgccctcccaaagtgctgggattacaggcctcggcctcccaaagtgctgggattacaagcgtgagccaccgcgcccggtgttgaaactctcttgaggcattttcttcggccttcgggtccatcctctctgtctcctctttgacctcctcatctcctcctcgccactgccttggggaccttggccaggctcatggcatccagcagccactcaatgtcaatacctccatgttcatctctcagcccgcccttgcccgtgaacccatgcttatttatttattttttttatacgtgcacccatgctctttgggtctgatgaagtatccaaaatcaagctcctgaccatccccaaaccggccccttctgccggcctcgctagtcggcaccatgcttgattcttctctttctcccacccaggccatcatctcttgcctggttgatacccacagcctcccctttgggctttatccttatccccgtcatagctgccagagggaccctgtgaaaacactccccagcctcctcattcttctgccctaagcctgcatggcacagagcaaaagccagttgttatgggacctaggaggtcctgtgggatgggccccagcctgcatcttcatcctcttctccccaccccactccattcactctctgcctatcgctcaccagcctataccacctgcctcagggcctttgcactgaccatttaggcaacattccaggctcttttcacacgttgcctcctctgagaagccctccctgaccactctgcccatacctcatgcctcttgattccccttacctggcctgtggtttcagcactttccctgtgtgtgtttgtttttcttggcatgagggcaggacttaagtgtctgttccctgttgattccccagtgccaggcatgcagtgcaaattctagaaatattttttgcatgaaagaatgagtgattgaatgcggcaagggtctggaggctgaggaccaggcagacagacattcagagttgctggaacgcgacagagacagggagtcagactggtcatgcaaggtcctgggcctgcccttgggtcctggggagccacggaaggttgtgggtgccagagggttgcggtcagagtcacagtcaagggccttctgagacctgtgccccctccccacctcctcaggccagctctggggtctcagcaggtggtccgcaacatgacctctgagttcttcgctgcccagctccggtcccagatctctgaccacaccactcacccgatctcctacgacaagcccgagttctacacgccggatgacgggggcactgctcacctgtctgtcgtcgcagaggacggcagtgctgtgtccgccaccagcaccatcaacctctagtaggggctgctgggccgcctgggtgggaaagggccaggggcgggtggcccagggactgcccacttatccagtaaggtggctccatcacctcttttcctggtgggaaactgaggcccaaccttggtagcttatcctgggcctctcagtgagtatgtttgagcctcagtgggtggatagggaccaggctgggccaggcaaggtcgggtgctgtctgacctggctgggcggtagctttggctccaaggtctgctccccggtcagtgggatcctgttcaataatgaatggacgacttcagctctcccagcatcaccaatgagtttggggcacccccctcacctgccaatttcatccagccaggtatggggtggaggtccggggggtgggggactggggtggagaggggcgggtgtcctgggcaggcagctgacgggcatccctgtcttctcccatcggccgcagggaagcagccgctcttgtccatgtgcccgacgatcatggtgggccaggacggccaggtccggatggtggtgggagctgctgggggcacgcagatcaccacagacactgcactggtatgtgtcaccccttttctccctggccctgcccactctgcacagcccccaagccacgctgatcacactcccatgccccaggccatcatctacaacctctggttcggctatgacgtgaagagggccgtggaggagccccggctgcacaacaagcttctgcccaacgtcacgacagtggagagaaacattgaccaggtgggccgggggttggagaaactgagtcacggtgtggggtcccagggcatcctgggctggaggcctggatcatcacagagtggacaatggttggtgtcctctctctagtgcctgggccatctggagcccctgtgacatgagggccaagccccctgctccagtgagacccagcaggccccaacctgctcttcctgatgacctggcctgaaatggcaccacctgggctgaggcctgtgaccacacaggtgtggttcaggtggcatctggagccctgctcaggcttcccctctcctcccacccccaggcagtgactgcagccctggagacccggcaccatcacacccagatcgcgtccaccttcatcgctgtggtgcaagccatcgtccgcacggctggtggctgggcagctgcctcggactccaggaaaggcggggaacctgctggctactgagtgctccaggcagacaaggctgacaagcaatccagggacaagatactcaccaggatgaggaagaggactttgggggacgggcttcccctgtgagcagcagagcagcataataaatgaggccactgtgccaggctccaggtggcctccctggcctgtctccccactctctgggcctcagtgttttgtgtgtgaaatggagccatctggctggggaggaacagagaggtgggattcggagatcttcacaatgcggacactggaactagcctcagcatcttcagcatggggagagccaggcacatggctgggggccaggggaaggttcacaccaaaccctgccccttcccaccctgatccctcagactttggggccaggccctcccttactggggctgggcagtgacactacctaggatcagccaccagggggtgtcacgaccctggcgctttcttaggcagagggtggccagccgatgctgggaacccgggcgccttctcagacccgtaggcgtccagctcaccctgccgatgacactggaggtgaagctgagggtccgaggaatggggactgggcaacaggctggaggaaaacatctcggtcagagccatgcccctggggggttcccaagagcaagcccagagtgaaacccaagcttgtgatcctctccagagggaggcctggttctcagggaacagcaaacgggaagatgtccccagatcccagggatcagggcttggaccagccggggacgcagcccagagggagtgggtccggaaggaaacagctcgacacagcagccttcaccatcggcagcccctccaggcctccctcggggcctgctccctcctctgtgcacagttccaacacctggagcagggttctgggaagggctggtggaggtgggctggtgggaggcggtgatcacagcccagcacctggatatcaccaggggcactggggccaggggccaggtgaggccaggtcggggctatccttcaggagccccgaaaacctggtgattccaaagggcccatagacaaacagggttttatgcctgtggagtcaagtcccactgggtctgagctctggagggctgtgtctctggggctctgcaagggtgagatggaggtgggctcaactggtgtacaagtcactcttcaatccttattttatttatttaatttttttaaaaaaaatttaaaccaatagagatggggtctcactatgttgaccaggctggtcttaactcctgacttcaagcagtccccccatctcagtctcccaaagtgctaggattacaggggtagccactgcacccggcctcaatccttatattggcctgagaggaaaggccgtggccccatttgcaggggagaagactgaagctggaggggcaggccttgctctgggttgcacagcaggaagagaagtgggagctggccacgaggcttcctggacccgaaatgctggtggggtacaccctggttctctaggtcccatggggctcagcccaggactacctcggggggtgagggacttaaatcgtctccttcattctcatcgccccttcccccatcatttcctgaggaaggacattcagggacctgaaggggtggcctgcccctccccacctgtgggtgtttctcatcagctgggacaagagactgagaaaagaaagagacacagagacaaagtatagagaaagaaaagtgggcccaggggacctgcactcagcatacggaggccccacgctggcaccagtctctgagttccctagtatttattgatcattatctctaccatctcagagagggggatgtggcaggacaatagggtaatagtggggagagggtcagcaggaaaacacgtgaacaaatgtctctgtgtcataaacaaggttaagaaaaaggtgctgtgctttgatgtgcatatacataaacatctcaatgcattaaagagcagtattgccaccagcatgtcccacctccagccctaaggcagttttctcctatctcagcagatggaatatacaatcaacactgagacattcctttgcccagggacgatcaggagagagatgccttcctcttatctcaactgcaaagaggccttcctcttttactaatcctcctcagcacagaccctttacaggtgtcgggctgggggacggtcaggtctttcccttcccacgaggccatatttcagactgtcacctggggagaaaccttggacaatacctggctttcctaggcagaggtccctgcggccttctgcagtgttttgtgtccctgcttacttgagattagggagtggtgatgactcttaacaagcatgctgccttcaagcatttgtttaacaaagcacatcctgcacagccctgaatccattaaaccttgagtcgacacagtacatgtttctgtgagcacagggttggggctagggttacagattaacggcatctcaaggcaaaagaatttttcttactacacaacaaaatggagcctcttacgtctacttctttctacatagacacagtaacagtctgatatctctttcttttccccacagggaccttcctggctgtgcctcgggtcaggaccagaatgacacccattcatttccctgggcctttgctcgggcggtccctgcaccctggcctctgcctgacgaggatggtggggagaggagggggacgtcccccacactgctgtctccactgttcctgctgcccaggcctctgggcttccaggactgcagcgggtcggtgggtgggctggcctgagcccaggaatgcacttcagctcctggttgagcaatgtcactgaggcttgggagtcgggtgggggcgggaggaggcgtccgcaggcccccctaccgtgagaggcagccgtgggaacagcctacctctaaacaatcactgcagcccaggctggccaggggctctggccggacataggggcctggcaggctgtgtgccctgtaaggacacagtctgtctctgtgcctcagtttctctgctgcccagatggaggggcccagactccaggtgtagacatctggagcaggcagtgttcagttggggaggaagcggggaggactgtgggggccatgtgggaaggattccaccccacatcacctgcacccctgctgagcctggtcaacggagcccctcagtgggtcctcactcccctggttgcctcccatttaggcaccctgaggcctggggagaacagagccaggccagtgtccccagagaggctgcgctgccagcacagtagtagcggatttggattcagggaagcagacctgcagccagggtgggaaagagctgcaggtggggtggggcccccacatggcacagcccccctccctggaggaccatgctgcatttccaggacagcaagtcccagggatggatggtgcctggtgccaagggctagaggcatggtctgtctgcatttcccacgtaagtgtctcgtagtcactagcatttgatgctgtcaagaccccctgtcctctgtgcagactgggaagcccttggtcaccctgggggagttgggggacccaggccaggctgcagaagcataaggacttgaacccgggtcctgagtgacaccaccttgggtcctcctccttctgcctctgttcagctccaccttgatgctgactaggctgggccatgcggagagggttaggggatagagatgggagctggggagcagggctccactctgggaggggggcagccttgccggatccagggcagagttaagcggccccagctctgctttcccagagctgctgagaacctggggaatggtgtggaggttccagggagccctgcccctacctggcaaccgcagtgcagcacgcaccaagttctcctgcacattgcgacagtgtgaccatgggctctggtgggcggtaggtcgggcctttggacctaccagcagtgagggagttaacacagcagctgacttctctaggcaaagaaaactcccctcagacgctttgctgcctggcctcctgccaggaacaagcaggagctgaaaactagaagttgaggcatgagtttggccactccgtagtgtgcacttggtgagggcagcagctcgccacagctgccagccatctgtccattcacccatctgtccatctggcagcccgctgttcagacctgtctgtctgtccgcccatctgtaagcccatctctgtcccattgtctatctgaccatctttctcttactgtcctctttgtctagctatctggcctgtctgtcgatccatcttcgtgtctgtcttcagcccccacctgtttgtccatctgtccaattacctgtgagtctatctatgcatcttcttgtccattcatctgcccacccatctgtccctccatctgcccaccggcctcccctctccttctgggccgcagagccatggcccaggactacggagccatgggtgacctggtcctgctggggctggggctggggctggcgctggctgtcattgtgctggctgtggtcctctctcgacaccaggccccatttgacccccggcctttgcccacaccgctgttgctgctgactccaaggtcttctcaaatattgtacggtgagtgagacgtgggaggaagctgggtggcctttggcagccagcccctcctggagaaggcgtgtgtgtgtgagcatgtgtgtgtgtgagagattatgtgtgagtgtgtgtgggtatatgtgtgagtgtgtttgtggggtgtgggtgtgtgtgaatgtgtgtgatcgtgtttgggtgtgtgtatgtgtgagtgtgggtgtgtgtgaatgtgtgtgattgtgtttgtgtatgtgtgtgtgggtgtgtgtgagtatatgtgagtgtgagtgtgtgggggtgtgggtgggtgtgaatgtgtgtgattgtgtttcgctgtgtgagggtgtgtgtgactgtgagtgtgtgagtgtgggtgtgtgggtgtgtgtaaatgtgtgagtgtgagtatggggggtgggtatgtgtgaatgtgtgtgattgtgtgtgggtatatttgtgggtgtgtgtgtgtgtgcacgtgtgtgtgtgtgcacgtgcactggcccaggaagcaggagccgtgtgtgtgggcttcagcacctgcagggcttgagcgcaaggagacagcctcagggcccttgcacagaacaggcggcagggtgtgcccgtggggcagatggggacttggggacaatggtggtgtgtgagtccatacctggctccaggattcaggaggcccatttgcatatcccaggtgggaacctgtctggccccgcctgaccctgctggccggtgcaggccccttcagtgaggccaattctccaaggctgcggtcttctcccagggtcatgggtgaaggggtttggaggctccctgcgtgggtactggcctgctggggtacacacaatgctgccatagccagtctgcccctacacccagcccggggccacatctcaggtctctcagtcctgaggagcccggtgccccacccctcacatcctctctccctgagtcagggcctgggtctcgtgagctgagtgactgatacttggtgtcctggatgagggcgtggtggagaggggccacagcgggtgtttcctgaccctcttccaggaaggtgctgctgccgctgcagggaggacacacacaggatgccccttcttgccccctgcctcccattgggcccacaaaagccagggcaagcctcccctccctgccagccacctggtctgcttcccagaaattctgtcttgcaggctgttgggaggatcccagtactttgtaaactaaagcaagggaggagtggccgttctctctctttgttcattcattcaccttttcattcattccttcttccctccattcccccatctgtccatccttccctgccctgattgctcatgccacccccccagcccctcctgacctggtcctttggtttctcttcagggctttctgtctcctcccacagggctgagaatggcagctcagggacaagtgggggctggggactgcttagtctccccagtggctctcaggggatttgagggtttgacgtcagctgccaccccaggctgtgcccctcctctgctcgggaggacatacagagatgcgacacccacttaaactcgaagttgcaaagatgcaaatgagactggggtctcaggcaccagagaccacccgtgggcacgtggcttttgggagtggggacctgctgccacagatctctgaagagtctggacctgctgggtctccccgagtgactgtctgggggtctccatagcatgccctgctgtgtgcgtgacggtcactggttgggtaggggtctctactctaaagctccctctgccggcatcccctcgaactctcccttggtgaagagaggatgtggtttgccccagtgttttatcaaacaactctctccacttccagttttaagaagctgggagtggaagagagcctggggctggccccagctgctgctgtgaaacaggggtcactggacgctgggaccctggccgggctggctggaggcctcaggaagaggcctgctacagcgtcatcctggccaagattcctccctgcagaggaccctggccacgctgccacagggtctgctggggccaccagaagcccatgctcctgcctccatctctcccctctgtgctcacctctcaccaggaggccctcccagagttcagtgtcctgcttttttttttttttttttttttttttgtgacggtgtctcactctgtcaccaggctggagtgcagtggcgcgatctcagcttactgcaacctctgcttcctcggttcaaatgattctcctgcctcagcctcctgagtagctgggactacaggtgccagccaccacgccccgctaatttctgtatttttagtagagacagggtttcaccatgttggcccaggatggtctctatctcttgattcacccgccttggccacccaaagtgctggcattacaggagtgagtcatggcacccggcctcatctcctactctttcagcaccaggttttattcttgggattctgctacagccggagcccctgggtgcgagttcctaaggtttctgtgagtgtggacccagcaccgtgcctagtagacatacaaaaggagcatggtgacagtgaggtctgtcatctccagcataatgactgttttgatccttgtaaaaaaggtgatttttggctgggtgtggtggctcacacctgtaatcccagcactttgggaggccgaggggggtggctcacttgaggtcaggagttggagaccagcctgggcaacatggtgaaaccatgtctctactaaaaatacaaaaattagctgggcatggtagcaggtgcctgtaatcccagatacttgggaggctgagacaggagaatcacttgaacgcaggaggcaaaggttgcagtaagccaagattgcaccactgcactccagcctgggtgacagagcaagacttggtctcaaaaaaaaaaaaaaaaaagaaagaaaagtttatatttttgttctaatgcttatcttaatatcgtcattctataattatatgttttatataattataatagctatataagatataatacccctagtatgttgttttttggatattctacttgctcctgatggttaatttatgtgtcaacttggctaagctatggtgtcctgttgtttggtcaaatacttgtcaatatcttgctgggaggttatttcatagatgtgattaacactgacagtcaattgactttaagtaaaacagattacccaccataatatgggtgggccacctccaatcagttgaaggccttaagaacaaaaactgaggtttcccagagaagcaggaattctgcttcaagactgtaacacacaaaccctacctgagtttctggcctgctgactgctctacagattttaggttccagacttcgagatcaactcttacctgaatttatagcctgctggcttgccctacagattttaaaacttgctagtccccacaatcatgtgagccaattcctaaataagtctctctctatgtataatctattggtttagtttctctgaaaaactttcacattccagtttcctggatgttaagaattaccgaaactagctagtaacttctttttttttttttttttgagacagagttttgctcttgttgcccaggctggaatgcaatggcacaatctcagctcaccgcaacctccacttcctgggtccaagcaattctcctccctcagcctcctgagtagctgggattacaggcatgtgccaccatgcttggctaatttttgtatttttagtagagacagggcttctccatgttggtcaggctggtcttgaactcccaacctcaggtgatccgccgccttggcctcacaaagtgctggaattacaggcacgagccattgcgcctggctcctagtaaattcttcttttctgtgatgtgtcccttacctctaataatacttttcttcttaaagtctacttcattaaaaatagttatgctgggcatggtggctcatggctgtaatcttggcactttgctggaggtcgaggtgggtggatcactgaagcccaggagttcaagaccaacctgggcaacatggcgagaccctgcctctacaaaaaatacaaaaattagctgggtgtggctagtataattctaagttggcacacttgtagtcccagctacttgggatgctgaggtgggagaatcgcttgagcctagaagggagagattgctgtaagccaagatcacatcactgcactccagcctgggagacagagtgaggctctatctccaaaaaaaaaaaaaaaaaaaaaaaaaaaaagttatacagctttcttggttagtacatgcatgacatatttttcatgatcttccacctctctgtacccttatataaaaggcattagttgggttttactttattttcaattattttaatttttattgtccttttaaatgtaactaatgatttatttgggttgaaacccaccaccaatttgttttccatgcctattctatttcttcttatctcctctcacatcttgttttggatttattatttttattatttaatttcctccttctctattagtttcataactgtgcagtcttagagttcttttaaaagatgactggattattttagagcttacaacatgcatccttcccttatcaaagtctaacatgagctagtactttttgttgtggttgagatagagagagtcttcctctgctgcccaggctggagtgcagtggagcaatcttggttcactgcaacctccacttcttgggttcaagcaattctcctgcctcagtcacctgagtagctgggaccacaggtgtgcaccactatgcccggccaatttttgtattctttttcagtagagacagggtttcaccatgttggccaggctggtcttgaactccggaccttaagagatctgcctacctcggcatcctaaagtgttgggattacaggcgtgagccaccgcacccagcctatgagttagtacttctatcctcttcctagtcagtacaagaaccttggaacaggaactaaatttacccccagtgacttatatgctaatatttttgtgtattttaaatatgtgtgtgtgcatagatgtatctgtgtgttttttgtgtttttattcttatttatgttgagagtgtagagctatgtaagagtaaagagaattgtgtaatgaagccccgagtatccattcaatttcaacaacaatcttatggccaagctcatttcatgtatactctttcctgcttccctctaccccacattatttccgtgcaaatcccagatatataactgtacccatacatatttcagtatgttttatttcttttaaaccccacaagatatcattttctatactactgtaattttataccaataacattcatttagatttacccacacgtttaccctaccctccgggtcctgtttgaaaatcaagcccatgctcacaggccaatttttttttcttttagagacagggtctcactttgtcacccaagctggagtgcagtggtgcgattatagctcaatgcagcctccaattcctggactcaagggaccctcctgcctcagcctgccaagtagcttggactatagctgtatgttttattattattttgtagacatggggtctggctatgttgtccaggctattctcaaaattcccggcctcgagcaatcctcctgcctcggcctctcaaaggttgggattacaggtgtgaggcaaggcacccagctcagccacagagccctgttgcatctctcttactaggagcaagagctgactgccccctcatccccattccagagtgttggggctgtgttgagccgaggccaggccactggcatggcccaaggaacgggatcattcactgctgccccaaatctgacatcattccaccttgacaagacttcctcatccaatccctttacttgacagctggggaaaccaacgcgcacagagcacccccagctcactcggggtctcagagctgatccatgagcagaggctgagatcctgggatcttgtcccccagccgccctgcaagcttactccctttctgctggaagagatggggccggacctcaaccagcagccctggcctggacatgactgtgctcacccaggtattgaggccgagatgccccggcatcatatgtttttctcttattttttctttttttttgagacagtatctcactctgtcacccaagctggagtgcagtggcatgatattggctcactgcaacctctgcctcccgcttaaagtgattctcctgcctcagtcttccaagtagctgggcctacaggcttgtaccaccacgcctgactaatttttgtatttttactagagacagggtttccccatgttggccaggctcgtgtcgaactcctgacctcaggtgatccacctgccttggcctcccaaagtgctaggattacaggcatgagccatggcatcacttaaacgtagtgagaggccgggcaaggggctcatgcctgtaatcccagtgctttgagaggacgaggctgtcagatcacctaaggtcaggagttcgagaccagcctggccaacatggtgaaactgtgtctctacaaaaaaatagaaaaaaaaaatccctgcgtggtggcaagtatctgtagtcccagttactcaggagtctgaggcatgagaattgcttaaacctcggaggcggaggctgcagtgagctgagatggcgccactgcactccagcctgggtgacagagcaagactttgtctctaaataattaaataaataaatatggccgagcatggtgccttaggcctgtaatcccaacattttgggaggctgaggcaggtggttcatgaggtcaggagcccgagaccagcctggccaagatggtgaaacactgtctctactaaaaatacaaaaattagccagctgtggtggcaggcacctgtaatcccagctacttgggacactgaggcaggagaatcgcttgaacctggaaggcagaggttgcaatgagccgagattgcaccgctgcactctagcctgggcgatggagcaagactccatctcaactaaataaattaataaatacagagcaagattccatctcaaataaataaataaatgtacacctgtaatcctagcactttgggaggctaagacaggtcgatcacctgacgtcaggagttcgagaccagcctgaccaatatggcaaaactccatctctactaaaaatacaaaaattagctgggcgttttgacgtgtgcctgtagtcccagctacttgggaggctgagacaagagaattgcttgaacccaagaggtggaggttgcagtgagccgagatctcggctgcacttcagcctgggtgacagagtgagactctgtctcaaaaggaataaataaaatacaaagtaaaaaaaaatgtagtaagattgcagagtcgtgccgcagaagcgtgctggtcctatccatgtagtgaaggctgatttcatacacaaatgtcacaagaacttttcttttctttttctttttttttttttttgagacggagtctcactctgtcacccaggctggagtgcagtggtgcgatctaggctcactgcaagctctgcctcccgggtttatgccattctcctgcctcagcctcctgagtagctgggactacaggcgcctgccacctagcccagctaatttttttgtacttttagaggagatggggtttcaccgcgttagccaggatagtctcaatctcctgacctcgtgatccgcccgtctcggcctcccaaagtgctgggattacaggcatgagccaccacacccggccttcttatatgcttttattgcatttgagcgtacctcttttacagcgaagatctttttttttaattttattttatttttagagatggagtcttgctttgttgcccaggctggagcactgtggtgtgatcatagctcactgcagccttgaactcccgggcacaggtgatcctcccacctcagcctcctgaatagctgggactacaggcatgcaccaccatgcctggcatattttaaagatgtttgtagacatgaggtctcgctatgttgccaggcttgtctcaaactactgggctcaagccatccatccatttcagcctcccaaagtgcttggattataggcatgagcactgcgcctggccatcacactgtttttttggttgtttgtttgtttgtttgttttgagatggagtcttgctctgtcgctcaggctggagtgcagtagtgggatctcacctcattgcaagctccgccttgtgggttcacgccattctcctgcctcagcctcctgagtagctgggattacaggcgcccgccaccacgcctggctaattttttgtatttttagtagagacgggatttcaccgtgttagccaggatggtctcgatctcctgacctcgtgatctgcccgcctcggcctctcaaagtgctgggattacaggcatgagccaataaatatttttataatcattaactaccgaggagaagctggagagaaaaaaggtggatgaagttaaggcagagagactttgtaagtttcttggctgagcttttggagactgtatatcagagatcctatttgaggtgattttcagctacagagataggcctggtcatttgaaaaataacggattaggtgaagcttgcgtttgaaatcctccttctacttttcatctttctctcttgtttattctgagcatccatcttagacacccaatctttgtcactttgtggttgtcattgatttccctgttattgagattagaggttggcagactttctctgtaaagggctggagagaaagtacttcagactttgtggtctgtgcggtgtctgttgcaaccacttaactctgccctgtagagcaaaagcagccgcagacagtacatgggcagatgagcatggctggggtccagttacatttacttgcaaaaagagggttggagactgggtgcgatctcccacctttaatcccggcactttgggaggccgaggcaggaggatcacttcaagccaggagttcaagaccagcctgggcaacaaagcaagactccatctctacaaaaaaataaaaattattatagctaggcatggtggtacacacccgtagtcctagctactcaggaagctaaaactgaggcaggagggtcagttgagcccaggagcacgaggctgtggtgagctattattgtgccagtgcactccagcctggtgacagagcaagaacggtctcgtcaaaaaataaacaaaaggctgggcacggtggctcccgcctgtaatccctgcactttgggagactgaggtgggcagatcatgaggtcaggagattgagaccatcctggctaacacggtgaaaccctgtctctactaaaaatacaaaaagttagccgggcgtggtggcgggcgcctgtagtcccagccactcgggaggctgaggagggagaatcgtttgaacctgggaggcggaggttgcagtgagccaagattgtgccactgcactctagcctgggctacagggcaagactccattaaaaaaaaaaaaaaaaaaccagcaaaaaccaaacaaaacataatgcatgttctctcttataaatgggagctaaacatggggactcattgacttaaagatggcaacaactgggaactgctggatggggagggaggggaggggtgaaaggccaactgttggggagtatgctcatatccacgtgacaaacctgcacatgtgcccgctgaatctaaaataaaagttgaaagtagatttaaaaaaccccaagagggctgggtttggcttgtgtgtccatagcttgttaacctccgctttagatattaacgaatagaaacatagtgcttaacttcccaggccacctattttgttcctctccaaggtgatggatagatgaaggccttatccagccgcctggaagtttgctgacgcttgtcctgtcacggattaatgaagcattgttttctgatgaaggtttcatgccgctgtgctgatgtgtcttctcttctctctaggcaggaaactgcatatcttctggtttacatgaagatggagtgctaatggaaatgcccaaaaccttcagagattgacacgctgtcattttccatttccgttcctggatctacggagtcttctaagagattttgcaatgaggagaagcattgttttcaaactatataactgagccttatttataattagggatattatcaaaatatgtaaccatgaggcccctcaggtcctgatcagtcagaatggatgctttcaccagcagacccggccatgtggctgctcggtcctgggtgctcgctgctgtgcgagacattagccctttagttatgagcctgtgggaacttcaggggttcccagtggggagagcagtggcagtgggaggcatctgggggccaaaggtcagtggcggggggtatttcagtattatacaactgctgtgaccagacttgtatactggctgaatatcagtgctgtttgtaatttttcactttgagaaccaacattaattccatatgaatcaagtgttttgtaactgctattcatttattcagcaaatatttattgatcatctcttctccataagatagtgtgataaacacagtcatgaataaagttattttccacaaaaggactttgcagttttaacggggggcagtagggcttgtgctatagaaattcaaaggcaagggaagtcacttctgttgtggggccctgggaggagcctccaggctggaaaggcttaaggtggaggtctccgataggggcagcgtacacagtggactggctgcaaaaggccgtgctcagcattcagacagcatcacacactccgcttttctctaccagggaggcaggtggggaaggatagcgatgggaaggcaggcggagctcagaatgtggaaggggatccagtaaggcttggaagtttgcacctgatctggtgggtggtgaggagcccttgaaggggcaaggaggcgaggagcactcagctgtgttcttacactgatctgccactggggttagagacaaacgtggtgggaatggaaagccacgcacagtcactagcgcctctggggggagaatggatgtggctggtgagagaacaggggggcccagggagagtccggcaccaacctgggcgggggagcccagtgggtgtgagcacccccactttagagatgaagtgatggagacattcagatgtttaaccccttgttcaagattccatacttgataaatggcagatcaaactcccaacataaaatgtgggtcatttctttattattttatttgtattggttaacaatgatcagccatgcaagaataaatgattattgtaaaatctgcaaacaatgtagatatgtagagagtcccttccttggagcttgaccttgtcagacaggtatagatgagtgttccggggcagccgtaaaaactgccagagactgggctgcttataacagaaacgcatggtctcccagaagcccacattcaaggtgtccaaaggcctggctcctggaggctctggaggagagcctgttccctgtctctcagcttctgccggttgccagcaagtgttgccgttcattcactccagccactgcctccatctgcacacagcaaaacagcgtatcctgaagtgctcaaccttatagccattattttaaaatatccggaacacacaggaccgtgggagtggctgttggagaaattttcatgaaggaagaaagattacaactaagttttaaaatgctagttttgtttgttttgtcttggagaggaggtaaaagtgggagtaaaaatagggagtttggtgtaaggtgggaaaagcaaaggaaccccgcatggatgggctgaagggtgtgatgggagaacagtgagaagtacgtttggggaagcaattggaaatagtagctaagcttaatcacaatctatcaaaagggacttgttgaagaattaatgtgtgactaggaacagggaggttatgggcttgtcagctcgacagcgggcactcagttccactaacgaatgatgcccgtgtggacagacagaatgatggacaggcagatgaatgcgtgggctttatgtgaaacaggtcctcttggttgttgacaagatactgttttaaagttccattttgccatacttcgaacagcttgtcattagctcaatttagccacatgtaaaatcactaaggcggacttccagagttcccacatgaaaatcaaatgtaaaccagcagtgacctgcttcaacaccatcatcggaagtcagaagttgaactcttttttgatgtttaaagcctgcataatattcgctgtattattattcagcatattactatttccttcgtgatggaaatttggtttatcccaattttctattccatcaaaacaccgctacatagaaaatccccatgcacatatttctcctaattgtggaaatattttacataaaagactctagacatgggatgaaattcccaggttattggaattttaaaatagataggtacttccaaattgacctcttacaaattatatgaattcgtaagcttccaactgttatggagttacccattttgagaaatctgtgctaaaaggacccaaacaatgctgatgacaatgatcaggataataagtacgctgggaagacaacaaaatgatttagatcttagacaagtcattctaggtgtctccactgtttcagttcttgcgttcgttcattcttgtgctttttcgttttaccaaataaaatagctccttgatgtcataggaatccacgctatgcttaatgagtattggttagtaaaatgcctataactagtaatcttcatctatgcaattaaatattaattcataaaacacttcaaatgtaaacaataattagtaaatgaaaagtacataatacctcaattagaaaaaaatcactccattaaaaagacattatttgtgtgataaaagagattgctatttttgtatttttctacaaggttaaagaaaactaagtcaacttatacaagtgaattttaaaagactttagggcaggcgtggtggctcacacctgtaatcccagcactttaagaggccgaggagggcagatcacctgaggtcaggagttcgaaaccagcctgaccaacatggtgaaatctcatttctactaaaaatacaaaaaaattagcccagtgtggtggcatgtgcctataatctcagctacttgggaggctgagacaggagaatagtttgaacctgggaggcggaggttgcaatgaaccaggatcgcaccattgcactccagcttgggcaacaagagtgaaactccatctcaaaaataaataaataaataaataaataaaataaataaaagcctttaacccagaatgctgagtaaattggccaaaaatgctaacctatgcatttcaatactataggagtcgcatgggtagaaataaccagatgaaatacttctggtatttcaccttcccaacccacacgagccagtgtttttctgtgaataacaaaaacagcagaatttacttgcctcaccataagaggttaccacttctgtgtgttcccccgaaacaggtggtggctgggtgagaaggtggacagcactagggcaggagatgggggctccagtatcgtgggtgagcttcctaaacctctgcaactttcagcccctaaatgggatgagccatcagaatttttagcacaatgcccagaacaaagtaaggatttgacaaatgacgcctctctccacattgttctgtcatcagccaccgcatcctgtacctccaagtccactgggctccggctgtttccatcacatggagaatgactcagagcctggcctccagccaccctcctggcctttctgcttctcactctgccactggctcctcatggaccaccagcctgggtgtcctcagacataccacacacttcactgtgggagtcacgcagccctcactgctccttcgccagggagccacggggctttcctcctcaggaggactctgcaagcagctggatgaagggccctcccgtctctcatccttccttaatttttgtcacagttctccttccttccactcagtgcagcgcacactgattgatcctccatcttccccaaaagacaggaacagcatgagcagtggagagtagattccaatgatagaaaaaatagtcagtgatttctcatttccattgatcatcaatgaagaaaatgtatcctgaaggtcatgtacctcctatgggactgctgcatcctcagcctcctgaatttcagcccagcaccttcctccccagcacagcaacaggtcagcccttaccagcatccctctcttattgcctttgtgcagagccagcaccagggccaggggaggccttgggattgtccctccccaacaatctgtgaaacaatcctttatgtcaccaacaaagcacagccttctgcactggtggtcagtccctctcaacacctctgtcactgtaaagctggcaggcaaccctccaaggttggccttcccaagcactgcacctctaggtgacagagcacgtccttaccttgaagcctgggcgcccagtctatcctgtccaatgagcgagctgtggagaaggggggattccgggttaaggggagactagcagggctcctgcttttatgttgccctgttgggaaggctattaaagaaacacaaagtgctaagcagtgaggatagaacatgttttcattatttcaaccaatacattccacagatggaataataagaaatgctacaaccaagctaactgaatccaacagcatatcaaaaagataatccaccatgattcaagtgggtttcatactagggatgcagggatggtttaacatacgcaagtcaataaatgtgatacatcacatcaataaaactaaaaacaaaaatcacatgataatctgaatagatgcagaaaaagcctttgacaaaatccagcatttctttatgattaaaaccgttcgtcacaatcagcatagaacggacataccttaaggtaataaaagctatctatgacaaacccacagccaacattttcctgaatgggggagagttgaaagcattccccctgaggaagggaacaagacaaagatgcccacgttcaccgcttctcaacacagtgctgttcactacagcattggttataagagcaagactggaaacagaacaaatggatacccatagcggggtgcttaagtaattttgggaatagtcatggggtgcagtactttatagctctgaaacaatacaatggatttacatttgaaatgtggaatgataactaaggtgcattgcccagtgatatatgcagaggtgcagaggactttgtgtaaacacgatcacacatcagcctgcattccaggtgcatgcttctatttgcacatagattgcagggatgatatgcaaacaaaaatgttgacttggtgtttggaagttcagagtggaagggaaacttccttgctaaccttttatgatatttagagtttctaaatgtgaatacgtaatacatttagaaatcttagttaataagaaaagcctctgttcctggcctcttgctggcacatgtcaggtggaaatggggctgtcatgctaatgtgtgcaaactgagaaaaatccaagaatgggagtctgcttttttcatcatacaaataattgttaatagaaacagtatgataattgctcattgatataccatgcatattctattagataataataaatttctgaaatttgaactatacttacacatggaaattgaaatatatggatgaaacattgtggcttatataggcaattgttttattggcattttacaaactgatcatcattcctcatggcacgggtccatgtgatattaagtagcttgttatgcttgggaaaggcagtgatgaccacaagaatgacttcaactactaaagtacaatggagatttcaacaatgttttgtttaatatttaaatatttcattgtgctcccaggctttttctcaccctaatagctctcatccatatcatgtgggtcccattaatacagatacctccgaatgcaccactcttccattatatccagtcaattgctggttaccttgggcctacaactgggggagggcaggggctgctggccacctcctcatctacagtaagagtcaatgagcagttaagtggatactgaaaaccatttatcctgctggagtgagaaataaatggtttctttcaatagcgtagtaaaatgcatcttttccaaactatttatatgactcaaggcccatctcaatttcagatgtggttagcctcaattcctgattctcaccaaggtgtgtaatgtcatccacggcccagtgcagaggaacacaggtgctgccgtcagactgccagggtccaatcccgcctcctcactcaccccgggagatccctttaagccaggagtcaacagtgaggatggaaacatgagtgctttttaaagtcctgaaagttcagaggcagactgtcaatttctcctccacccctgggcacacaccaggagaactctgtctccaggttgaaggaagtgcctgtgagagagttgtgtccctcagattctgttcaccacaggtgacactcgatgcaaccccaaacctcttctgcacaatcccaaggggtgctgactaatccaacccaaaggctgtgatgtttggcagaggcagaaaagaaaaggccaggtgttctgggaaagaccacctttaaatatcacagcaccctcatagcccagagagacagttctaactattatgccaataaacccggaaaagaccaaatccaatatgacacatatttcctgtttccttttgatttcatgccccctcccttaacctcccaagcagcatggataccccgaaggcccctgggaactctctccaattggatcttacgtggaaagtagttacctacctacaaatccccatcatcagatatgctctccacaatcaaatctttagaaacacaaacaccaggataagtcattagagagaggcccacccactcctcccaccctagctgaagccatggtgcttcgcacaggatcccctggtgtttcctctgggctcacagatatccctacagcctctctggacattgttttatacttgcaaaatcatttgctctcaccagactccaaatcctccttcccaaaaggagcccagaatcaggtttctgtaccctagagatggcgttttttcctcaggaagtgagttatttcagggtaggtatcattctccagtgtcaatggctcctgcaattatagaaaagaaaacattaggagggtgaaatgatgccatacacgtcacacagatctgatagtctctcgacaacttgagagagaaaataagaaggggtatagtgattgagtcaaaggtcaaagtcccccaaaactggcacggaagacacctgtggaaaagacaagaccttttcccacagaatttatctttaaagtgtatctagattggcagtttcacaactcttaatccatgggggaaaactgctgtggagggaaacacctctgcattgcagtggatcgtggatgctgccatctaccacaccccagtgtgcctggcatgggttggtgagaggctgccaatcaatagcaccacaccaagggaattgcagatgtcataaatagtccacattggcagatgttcatgtctacatttgattaaactgcagatgacatccataatgcacactggcagatgttcatgtctacatctgattggaaagaagccaggaaagtaacatttctgttcaagacaaagaaaagtgtcttacattggcagcatcttcttttttacagatgtcttgtacagtgtcctcattagcaatgtcatatacagcgtccttattagcgaattcgtatacagcatcctcattagcgatgccatatacagcgtcctcattagcgatgttgtatacagcgtcctcattagtgatgtcgtatagagcgtcctcattagcgatgtcatatacaatgtcctcattagcgatgtcatatacagcaacctcattcgctatgtcttgtaaagcatcctcattagcgatgtcatatacaacgtcctcattagcgatgtcgtatacagcgtcctcgttagtgatgtcttgtacggtgtccttataagcaatgtcgtctacagcgtcctcgttagcatgccttgtgggtgtcattagcgatgtcatatacagcatcctcattggtgatgtcttatatggtgtcattagcgatgttgtgtacagcgtcctcgttagcaatgccttgtacagtgtcctcgttagcaatgtcatatacagtgtcctcattagcgatggcttatacactgtcctcattagcgatgttgtgtacagcatccttgttagtgtgcctcgtacggtgtcattagcgatgtcgtatacagcgtcataattagcgatgtcttatacggtgtcatcattagtgatgttgtgtacagcgtcatcgttagcgatgccttgtatggtgtcctcattagcgatgtcgtatacagcgtgctcactagcgatgtctttttttttttatatatactttaagttttagggtacatgtgcacattgtgcaggttagttacatatgtatacatgtgccacgctggtgcgctgcacccactaactcatcatctagcattaggtatatctcccgatgctatccctcccccccccaccccacaagagtccccagagtgtgatattccccttcctgtgtccatgtgatctcattgttcaattcccacctatgagtgagaatatgcggtgtttggttttttgttcttgcgatagttactagcgatgtcttatacggtgtcctcattagcaatgtcgtgtacagcgtccacgttagcgtgccttgtcggtatcattagcaatgtcgtataaagcgccctcattggtgatgtcttgtacggtgccgtcattagcgatgttgtgtacagtgtccttgttagtgacggcttgtatggtgtcctcgttagcgatgtcgtatacagcgtcctcattaccgatgccttgtatggtgtcctcattagcgatgtcgtgtacagcgtcctcgttagcgtgccttgtacggtgtcattagcgatgtcatatacggcaccctcattagcgatgtcgtatacggagtcctcattagcgatgtcgtgtacagcgtccacgatagcgtgccttgtcggtatcattagcaatgtcgtataaagcgccctcattggtgatgtcttgtacggtgccatcattagcgatgttgtgtacagtgtccttgttagcgacggcttgtatggtgtcctcgttagcgatgtcgtatacagcgtcctcattaccgatgccttgtatggtgtcctcattagcgatgtcgtgtacagcgtcctcgttagcgtgccttgtacggtgtcattagcgatgtcatatacggcaccctcattagcgatgtcgtatacggagtcctcattagcaatgtcgtgtacagtgtccacgttagcgtgccttgtcggtgccattagcaatgtcgtataaagcgccctcattggtgatgtcttgtatggtgccgtcattagcgatgttgtgtacagtgtccttgttagcgacggcttgtagagtgtccttgttagcgatgtcatatacaacgtcctcattaccaatgccttgtatggtgtcctcattagcgatgtcgtgtacagcgtcctcgttagtgtgccttgtacggtgtcattagcgatgtcatatatggcatcctcattagcgatgtcgtatacggagtcctcattagcgatgccgtgcacggcatcctcgttagcaatgccgtgggcagcatcctcgttggcgatgccgtgggcggcgtcctccttggcgatgccctgggcggcgtcctcgttggcgatgccctgggcggcgacctcgttggcgatgccctgggcggcgtcctcgctggcgattccgtgggcggcgtcctcgttggcgatgccctgggcggcgtcctcgttggcgatgcccttgtcggcggcctcgttagcgatgccgtggacagcgtcctcgttagtgatatcgtgtgaggcatcctcgttagtgatgttgtgtacggtgtcctcatggggagctagaagaacacagagttaaggtcagtgccctggtagtggagactgtgaatcacccaggggcttgcttggtgtggtgcatggaggtggctgatcacagcatgggccaagctgatgctgggacatcctcccaggtggacctgcactagtgaagctaagggatgtggctcagaacactttctgcagtgggcatcagtttccaggttcaggtatgcattatccagtgaagtggggaaatataaaaaataaaaattgacaaattcatgaaaagccttccatgagtgcaagtgtgagttttttatccactttacattcagtatgcattcacacatacaaaatatttttacaagaaatcagaaattttaatttttgtcagttatgcgaaatctaacttagctgccaacataaagattctatctcatttacttggtctcgagaaaatctagcacatagtaagtagaccaaaatgttcattaaatgaaaacacagagcagagataggggggctgctaggcagactgggttgcacctgattacctggatgataattaactgcacaaaacctcggtcaaattaatattgaaactgccttttgcttgggctcgtttcccttgcggaagaaggatgaccaaggagatgaacaggaaagaaatgagaaacagaggcctttgcctagtagctaaaggccaccttctataacacgaaatagccttgaactctgccgtgatttagtgacagagttccctcgtgtcttctacccaggttgaagtccagcaaaattgcgactgtcctctttacaacttgcgagaccacactgcttctgcatttgcctgttgtatgtatgagatttacacttgttttaaagcaacattttgtttcagttgggctggtggccatacccggcactagccagtcaatagtgagatggctcctcatggaggaggcttggcttgaggctgagggtctttaacccacatatacaagagagttgccactaagggatggaagccaggctaataaccaagtgccacacagagttcctatctgtccctcctcaccatttttggctggcaggatttgagcattttagggcttgggaagatagtattactaaatctactaaaatacatcacccatccttatagactttggccagttgctgagcaaattaacttcacaactgaagtgggccacactggcctttgtggtcccccactcctcttagaatttgtgagcgtggggcctactggagggtgggaggtgggaggagggggtggatcaggaaaaataactgatattaggctcaatatatgggtgatgcaataatctgtacaacaaactctcatgacacacatttatatatgtagcaaacctgcacatcctgcacatgtacccctgaactgaaaagttaaataaaaaaaaaaaaaggatcggtgagctgagccaaacacctggggatctttgtgcttttgacacactgatgactatgcctgtccgtggggagatgaacccataactgccctgggttgtgtgaccacggaggccactttatgatgatgggcagtgtctggggccttttgggctcggtgccttagggtttatacatgaatgctggactccctgtgtggtggtgaacaccccatgactaagtgcatgtcagcgtcagcactggcccacactcctgggttcgtgttttcactttttcattcaggaactcgggagctggggccactcccttggcccttcaggttctccacctgagcagtggggataataaggcagacccggggatggctctggtgagggtggaggagtcactgtacagagagagtagagcgggggtggattttattgttagaagtggacactggtgattgggttgtataaatgggaaatctctcctgagaaaacacacagcctcacctgtacagaaacacacacattcacaccacacgatgcagcctcacacaagacaccaccaatcctcaagcacccaactcagcaccacccaaaagggagcacagctgcttcctcaaaatttggccataatttttccctggggaattcaggttttaaaaaaacacttcccctatacttattcctatcacaatcccaggatcagggtggctcttcacattgaaaccaggcaaggatgccacacctttcttggcatccagattgttttcttggtaagtgattccagaatacttactagattcacgcctcagaggggccacctgcaccacctgcaatacagaaacaaagctttttgaggggtatgtcatgttgtggattgtttgcacaaggctgtgtttctctcaatgaatattgaaaacttgatcagaaagtgtagtcaacttcaaggcctccaaaacaagggtaggatacacactggaaaagacatcagcttctggatggcggatctctcaggtccacgtaggttggcaagtgcaaaatactgaatccaaggagaagacattgcttccaaggacaaggaccccaaggatacagtctacaacctgaagccatcatagctaaatgccattttggattacatatcagttgctaagagtcacttcttcctccccctcagaaaactgcatttaatacctgtcatggacattgtcatcttttcacatgtaaagtcagttgaaaaagaaagacaacaagaaaggaacatttctatttcagagaaagcaaggcaaccttaccttcacgttgactggcctctctccatctcctctgtccttgtgaactagagactcctcagaggctaggaggacacagagcaacagttagtcatagatgcttttgttcatgagctattcagggagctctgcttaatgtggacaacaggacagtgtgtgtggatgtgtttcattaaaagcacagcttgagctcctgctagaaaatcctccctcgtggaaagacaggcaagaacgaggagctaaggagcaagaaatagagtccctggcattttgctgatggcaacttaaggcaatgggaatgagtcagtctacaaatggtactgaagcacatgctatagtttgatgagagtcccactgctcacactgtgaggtttgaaacccagctaaatggttttctaaacctgtaaaaacaatattacttgcaggatttatgtcccaagactacttttacctctgaggatccacagtggctgtcactgcagttattatgtgttttagcattttgcacttgaataaaagcaaagtttaatagacagattggattcaattctaggcaaaacagtctatggtatttattcactaatcctttgttataactgctgatgggagaattagaagtactgaaattatatcctttaaaattaattaaagcataattattaatcacacaatattttttcatccaggcctccttttctttgtcatgcatgcatattaattgaggatggagaatatctacgcttgttcaggccagccaacatacgacagtttacttcaagacaggagacatgggttgaatgctggtatgttttaactctgcagcgcaaacagttgcaacaagtgtggtgaactaatcaccagatggccctttgctgccttatttgtcattgtgccttacatgtagcttgcaggatttgattacgcttatgttttgtggtgatcatactttcaactattcctaaaatactgcttcagtcttatctgtttggggtcaactgctgaggatttcatacaaattaatgaagtttgtgaatctaaagttctacacaaagggggaaatatttgcaaatcatttatcttgtaagagactaaaatttagaatatttttaaatatatttaagatatattcaaaaatctacagcaacaaactaactaaataaaaatcagacaactctttaaaaatgggcaaaagacttcaacatatatttccctaaagaagatatagccacaaatagtagcacaggaaaagctgctcaggatcattagtcattagggaaatgcaaatgaaaaacacaagcagccaccaatatacacctactaggatgatttaaaggaaaataagtgtgaacaaggatgtaaagaaattgtaaccctgatacattgatggtagaaatggataaagttgcagccactgtgaaaaacagtctgcagtggctcagaaggttaaatatagaacccctgttggacccaggaactctactcttaggcaccccaaagaatagagaacagaaatcaaacagatgtttgtatactaatgtttgtagcatcacttttcacaggagccaaaaggtggaaataatccaaccatcagtgaacaaatgaatgtaataaaagcaaggtggtctgcatgcaatgctacatcatccatctgtaaaaaacgaacatcattttgatagatgatacaacatgggtggacattgagaacattatgcttagtgaaataagccagacacaaaaggaatatattgtataattgtaattacatgaagtgcctagaatagtcaaattcatacaagagaaagtcggataggaatcaccatgggctggaaatagggggaaggcgctatattgcttattgtggacaaggttttgtaagaaatcatcaaaattgtgggtgtagatagtggtgttggttatgcaaccctgtgaatatattgaatgccacggagtgcacactttggttaaaaggttcaaatgataaataatgtgttatatatatttccccacgatagaaaacatgcacagccaagcccagatgccagtcttgttagctgccttcctttaccttcaagagtgggctgaagcttgtccaatctttcaaggttgctgaagactgtatgatggaagtcatctgcattgggaaagaaattaatggagagaggagaaaacttgagaatccacactactcaccctgcagggccaagaactctgtctcccatgcattgctgacccatctcagtatttcctgtgaccacctcctttttcaactgaagactttgcacctgaaggggttcccaggtttttcacctcggcccttgtcaggactgatcctctcaactactgaccatttcacctccattcatgtccatgccacatcaggctgtgttgtctagatggcatgaatctaccccaaatgtccctttctggaggaagccaccattatgctgtacctccaagcataatgatacgtccacacacaccaaggcacctcactcatgcaaggtgtgtgtcctctaacaaagtttcacgctctaaacccagataacttttgaaacccaagttctgttgattcccctactttgggtgctccatagatgctcatttgtctactaaacactgccccaggcaattaaatattccaaagtgaccagcagaatttttatgttaattctgacattgcattgttagtacaagtgtttttcccccttcaaatttatgtctttgttactgataaatgtaactgataatgcttttttcagctatgttgccaagcatatttatataaaaatatactcagattgttttcagaatttgacaaagatgatagcaacaacgataatctcatttgtcttatactaatctttatgtgttactttcatcatttcttacatattggggcctaccatacattgtacggtgaaattagtgctatgcatcatggtaggaatataaattggcaaaagtaatttagaaaatagttcccttctttcttaaaaaaattaggctgggtgtggtggctcatgcctataatcccagcactttgggaggcagaggtgggtggatcacctgaggctaggagtttgagactagcctgaccaacacagcaaaatcctgtctctactgaaaatacaaaaattatccaggtgtggtggtgtgtgccagttgtcccagctactcgggaggttgaggcacgagaattgcttaaacctgggagatggaggttccagtgagccgagattgtgccactgcactccagcctgggtctcagaaaaaaaaaaattttttttgaccaaaatgtcattatgcattacatgactgtatatgaatgctcaaagctacattactcatcaaagaaaataacaaaacaattaaatgtccattaactgataaatgaataaacactatctgtatgaataaacacagcagactatgaaggaaaacacatgaccagcacgtgctaacacgtcaattaacttcaaacatagtatgctaaatgagggaagtcagattccaaatatatatatatgtccatttctataaagcaagtgggaaatttatggagatggaatgtcacagcagtattgcttagggctggagatgggagtggggattaactgccagtgcgcaagagagaacttgggtgagggaaacatatttaaattagatcgtggtgttgggtgcacacagtatcaatttaataaagcatcaaattctagaccttttcagtgggcaaactttatggtgggttcacacccaatataggtgttaaaaataatgttacggaaattcttgtcgggtttttaacaagccaagagatatgctgtgaaagcagcattaattcaagtggttgtcacaggtcacttaaagttaatcagatagttgtcctacaaatatagggtgaatgttattcatgaatttcctgaatctattgcaataatcacatttttttccattaaactcttgaggtagctaattttatttattgcattttcaatgttaatctactatttcatatgttgagattaactcacattagtcagaatttaaagtattttaaaatatcacagaatttaatttaccttatctggttttggtttcaagactatagtagccatttcatttaattgtacatgtagggtattctaatttatggaaaactattacattttccttgatttttttttttttagaaattacttctagggatctatatggtagagtccatggagaattgttttaattcttcattcatgtcttcagtgggtataggattggtcatattggtcatagttttctgctcggatttcaataagaaacttgtggaagaacctgaagggtgggatctttgagggagcctaagacagagcaagacaagctaagaaggagggcagtgccacagcagaactgccattgatgccccctcgcctagattgcggaagagacatccagctgtagacactgaggtgcaggaaaacaatggagcaccatcagagaaagcagtgcccaggaacaaggaggcactgatggtggcaaggggcaaagacagctgccacgaggctgttcacatgagggtctcaggctgcatagacacccacaccagctgaggggtcctggttttcataaagtgtgtggctcagccaggccaccaacaagcagttcacaaacagtagtaatacgacactttccaaagaccttacttgagtaacacggtgatcctcacaaatttccaatcaggatggtcgcacagttcctcctgctttaggactcagagcctgcccgtggtcacagtgggtaggtgcagactctgaagatgcactttggtcagagaccctgctgaactctgtctaatgaggacctctgtcctgtctgctgaccaccggtcagaggtgcaggctgcagtggggagtaagaatgccaccttctcaatgttgggaaaactccctgccagaactgagaatggccctttctaagcagaaggcaagctcagactaaagaaggaggccgaacacatcaggttggcagattgccaaagattcactcagggagagcccacatcctgggccatcttgggtggtggcaagatgaggtagacgactgcttttgcaacacacacctgacaacaaaaaatcaacaactgtaaaagagccacaaaatccccaaatatttgcaaattagcaatgcacttttaaataactgttgggttaaagaagaagtctcaatagaaaattaaaagtacttttaactacattaaaagaaaatgtgacttggcaagatttctggatgtagcaaaagcagtccttagagggaaatctatagcattggatgcaatatactaaaaatcacaagacctaaaatcagtaatatcatgtttcaattagggaactatagaaaatagaggaatgcaatggaaagcaagtaaaagtaataaacaacatcacagaaatcaataaaattaaaacactgaaatcatcagaaaatcaataaaaccaaaagctggttctttgatatgctcattacaatgaatgaattgatatgcaggctaaccaagaaaaagaagataacacaaatgaccaatttcagaaataaaagaggagccatctctactgaactgttaggcattaaaaggaatatcatgaacagttctatgagcgcagtttgataacctcagtgaaatgtatcaattccttgaaaggcaatcttcccaaggtcatgctaggatcctaatttgaataaacttatgtctattaaataagttgaattcacattaagagcattccgaaaaagaaagcaccaggcccagatggtttctctcatgaaatctaccgaattcttcaacaggtgaataaaaagacaaaaattcatttaatgcaatattatttggtgatttaatgtgccattttttgccattaaggcataaaaaagacatgaaagcagctaaagcgtacatcaatttagtgcaataaattcatctgaaaaaactacataatatatgattccaactatatgacattctggaaaaggcaaagctgaagcgatagtaaaaatattaatagttgccaaggtttctggagaaagaggacagagattaatgagaagagaggatttttagggaagtgaacattttctttatgagaccataagggtgaacataatgttttaaatatttcaaaattcatatatatgtataacagaaagaatgaacattatgcaaatgcagacttcagataataatgtgtcaatattttctcattattctagcaaatgtaccacagtaatgtaagatgttactaataggtgaaattaggaagtgagggtgaggagacagaataatatgggaacttcgtgtattatatactcaatttttatttatttatttatttatttatttatttatttattttgagatggagtttcactcttgtcacccaggctggagtgcaatggcatgatcttggctcactgcaacctctgcctcccgggttcaagcgattctcctgcctcagccttctgagtagctgggattacaggcgcctgccaccacacccggctaatttttttggatttttagtagagatggggtttcaccatgttggccaggctggtctccaactcctgacctcagatgatccgcctgccttggcctcctaaagtgctgggattataagtgtgagccaccacacacggccatatgctcagtttttatgtcaatttaaaactctctaaagaaatatattaattgaaaaataataatatagcaccactctttcagggagatctatgcttatgtttaacaaccaggtaagttctagacattagcttgaagcattgtctatcattaaacatgaaccaaaattgacttttaagtagatatttacttttgtggtggtagcaatatttactgaccaggcaaattagaatcctgacacattaaaaaatatggcttagtctcttcatagtttcctcttacatatgggacactgaatactccccgcaactgcaattcttgaatcaacttaattaatgaacttccacagtaccttcttgtgggtacctcttcttctttacccgggagccatgaggtctcctacactggttggtgtgcacagcatatcttcttgtattctctatcagagaagatgctggttaatgcattgacaatagatagggctgttgacatcttgctgacagaagaccagagggaaaatagtgataatctgttctaagtttaaacttatgatcctttttttacaggcttccaagcagagcccactgaatcaaagttgggtttcaggaagatcacggagttcagtgagcactcaacacctctatcagacagactgcgtgggcagtgccttcctggagaggggaacacagccggatgactgtgagtgcagggctggtgcagagtgggggcccggattcaaattccactaagccatgtggacctggcaagctcatgtcctccctctgccctcagttctctgcactgtcataatgtaattttagcaatactttttaggccctatttaagccctacttcttagtatcacagtacagggctaaaaaatcactaaatacaggaaaaccttagagaggactggtacttcagtaatgttctctaagtgtttactacatgccaggaggaataagctggacacttagcagtggcggaatatggagggggaacttggatggctccggggcagtggagcatgctttcctgttcggcttttccgtgggcatgacgccttatggtttatggagaacatcagccctgcagggggtgcagaggaggggctgtggctgagattttacacttgagggtgctgacattcagagatgataagtgacgagcagaacctcaaccccgctgagtgaaggacctgagatgggaaatgtatttggttccctagagagagagattcctgaaaaactgccacctcttcatcacgccctgtgccacagacccaagagacccctcactgtctttctccagtcctcctagcccaaggtgtgtgggtggacaaaggtggtgctctggaggaaatgcctgagataaggacaggtccttaatgataaagaattctccttcctctttcagatccttgacctcccagtatgacagcttaaaggctgtcatctctgtggcctgcctccccttgcccttcaccctgccagctgcctctcagtgactgtctcctccagtgactacactgagggaccagggactgcttgcctcccgaggctgctcacaccttctgacaccgcaaaatgattgtcaaaaatgggtctgcaaagagtaacttcccttccactgatcaaacctgaatatgcaagctactgtcaattaactggaaaagtggccgtgtgggctggtgctttggtgatttaatgaattaagtctgcaagccccactgcctccttgactattgatcagagctgcctgcaataaggtctggctaagaatgggcagtggctgcaccagctctgggtaaaatttgacctaaaatgaccaatctcattcactaacctcaccatagtcttatgggttcaatggacctgtccaatcctttgctctgttctctccatcaccttcctgtgtaattttcctccaccacgcacataatagaaacatggcacaggggagctaatcgcctcttttatcccccacttcaggctcacacataagtttatagtaaaagccttttcaaatgactgctttaactgctgctacagcatgtgtcatcagttgaatggaatctgtcacgtgactttaagcaaccctttgctgagagacaagattcaatactagggacagtattctagtgtactacatcattgattttatgttatgaagatcatcatttattgaaaatgtataaataatgaagcccagccttactcttcaacgctgtgtgtgtaaatccactgagtgtgctgacccccacgcttgtacccacctgctaacacagaaagggtccactcagaagggaggcacagctccagcactgaggctgtccacaccagcttcacaagagggttgccacaaggacgacggatacccggataacaaccaaatggtaatttgagtacttaatggtcatgatccctaaagtgtgtagctcagagggcttgtggtgataactccatcaagactctaaagcatctccccaattcttactggacttgatccatgtcttgaggagacccagctatgacacgcaggcaccacgttgtcctacttagtgcctcccttagtgtttcagaacctgtgatttgatcagaaacatgggctttctatgttggtttcacactaaggactatgtgacacctgcaggaagatgtctacatagctacctggattatgagatcatgaggctgtcttatgtgagggatggcgtttgggatctctgcaggcgtgggtaattccaggcatagagggtgctggaactcccttgcatggtgaatagtgatctcttcactggctgataaatagaggttgtagttcaggccttcaacattagcaccgtatgaggaaacattttgactcttcactatgcagcaagtgaaccagagcacatttatttatgtggcttagtttctccatctggcatgtgggctcaataaacaagctcacaacatatgggcatgatgatgatgaggtgtgaactaatgtaagtaaagtatgtggtctgatttgttaaattaagaaaaatggcactgagagttgtgctgggtaaacacaacatttttttcctgggggaaacacagatagacacacattcacaagcaaatcatgcagacttgcacacagaccacctcaccccacccccgccctaatacacacatacccacacacaacctaatgtgaacatgttcccagaaactatacatagataaaaagagtatgtcaccaggaaaaccagtttcttttactataccctacatcctcattcccaccagatgtcttggatcatggaggctctccggacaaaagccagcagttaagctccagatttcctgtagaatccttttctaacaaccagtgagtgattccagaatacgtaccattgaatgtgctccctgaagtcacctgtaattagagaaggaaaacactctgagaatcaggctatgctatggatggctcacacaggtcttttgttcacttggaaactctgggtaaccaagattggaaataaggttcaagtcaaaagccccaactctagagtagagttcccttaggaaagcacaggagcttttcttgaagaatgtttctgtctaggtaatttttgagtagcaattgcagaattcttatctaaagtggaaagcttgttcctgaagaaaacatcccttaacacccagtgtactatctgacactgccaattttgcacgtcctctggaatcaggtgtcagttggtaaaatacacctcctccatccccaaggaaatattatctaacacctataatgtagtggagaattttcccatagctgatatcaactgaaaaataaaggatccaagaaaacaacatttacatcttaggcaaagacaggctactttaccttggtagtagagtagggcttccttttcacacgctttttggaaggcttcttcgagtcacctaggggatgtggagggacacagcatggctgtcagttcattggcagtgctactcatgaatgactcagggactggaacttaggggcgtgcctggttaacaagcatggaatgagcttctcctggaccatcttcttcacggaccaaggaaggcaaagaaagagcagcaaggaaatgagagtagagcccttggctttccaggtaatggcaaatgaaagcaacgtgaaataatcaactccaaatgaacaaatgctaaaacacatgctacgattcaaccacagcatcctgtcacttcttcagaccctttaaaagcccagcaggactgccactaccttcttgacatcgaccaagtccctttcaacctccacagacccacatacactgctactgcatttatcatggagggtatagggttctgccctgtttatgtgtgaattttttaaaaactagatttaataccatgcaccagcattaattgtatttatttcttttcttggttatgaaaataatcagtcaggcatagtggctcacacctgtaatcccagcagtttggaaggtggaggtgggtggatcatttgaggtcaggagttcgagaccagcctgaccaacatggtaaaaccccatcattgaagataaatgttttatatccatggttaacagatgagatgaccatgaaatgaacaccagtgtactgggtggagcagcttatctattcagtcttcggcactaaaacctgtgaaacaatatcatcttgccttatttactaacaaatacaagtgcctctaaacttagacagtttccaagtcatggaactgatgagcacttagctcctgcagagagctctggatgatgggtcgggagaacaaagacacaatacatcaaaacagcattcacaagtaaacaggttttcaaagccctctacatgcaaatttacacaattatccttttaatttttatcttcatatatatgtacataatctacttgcttctgagtataaatcaaactgtatgttcttagttaatagtctctataaattcactctatttatctttctgagttgaaatactgcatctcattggataacaaaaaaaaaaatttgactaagattacactggaaaggtgagtaggttgggtgattgactgtgattgacaattccatgattctggataacttccaaagcataaaaataaatgtgtgttttctttcacacgtagacaatacacatgcttattactttaaaaaattaatatgtgcatggaagtgacttactacaaatatattaaagtaaatacacatttcacaaaaaaagaagagaggaagggaaaaacatgttaaaaacaaagagagttacattttattgtgtgaaaagcctccaacggatccttactactgtggctttgttccaaagttttggaaagtaatgatttcataggttcttaattgggttaaaaacagcattaaaatagactctgccatattctcccctggggaataacttaatctgtggggtggggaatggaacgttgaaggatgcaggatgtaaaaggaaattatatatatattatatatattatatattatatgatatatataatatatatattatttattatatatattatatgttatatataatatatataaataatatataatgtacataatatataattatataatatatattatatattatatattatatacataatatataattatataatgtataatatatattatatataatataatatatattatctataatatatataatatattatatatattatatattatatttaatatattatatatattatatatataatatattatatataatatatataatatattatatataatatattaaatacattatatatatattttatatatatatatattttttatatatatatatataatatatatatataatttgggaatttgggaataaactgaatcccaattcacactgggactacaccagctgccaccatgcctggctaattttttgtatttgtagtagagacagggtttcactgtattggccaggatggtcttgatctcctcaccttgtgatcctcttgccttggcctcccaaagtgctgggattataggcctgagtcaagatacatattttttaaatgaagaaaaatttgaaagatactctgcttggtacaataatcaaatatataaattgaggaataaaacataatcatgaaacatatttataactgcatatggaaaatacagaggctaattttttaaataacatattttgaaagcattaactagtaatttgaaaagatcgcatttgacaggccagtatgaacataccttgaatgcagccacacaggttccccataagaaaaatcaaaatcagggaaaatgaaaccacaatggttcaatctgctctgacctttgaaaaactcagcacaggtagtggcacttacgaccaagggcaggagatccctaatcccatcaccatggcgatagggcataaacattccagggtgaaggcacaatccacactgtgaggtccaactgctgccatgcagacaggtgggcttttacaagtacaggaaggtcatcaaaggctcagtgttttgtttcaaaaactgaatcccaagcccacacattattatgctggcttcttaaaataagttgtgagatgggaagtagggcacccacaaatatatatatatataattatatataatataatatatagtatatatataatatatttaatatattatatatatatataatttgggaatttgggaataaactgaatcccaattcacactgggactacaccagctgccaccatgcctggctaattgtttgtatttgtagtagagacagggtttcactgtattggccaggatggtcttgatctcctctccttgtgatcctcttgccttggcctcccaaagtgctgggattacaggcctgagtcaagatacatattttttaaatgaagaaaaatttcaaagttactctgcttggtacaataatcaaatatataaattgaggaataaaacataatcatgaaacatatttataactgcatatggaaaatacagaggctaattttttaaataacatattttgaaagcattaactagtaatttgaaaagatcgcatttgacaggccagtatgaacataccttgaatgcagccacacaggttccccataagaaaaatcagaatcagggaaaatgaaaccacaatggttcaatctgctctgacctttgaaaaactcagcacagatactggcacttaggagcaagggcaggagatccctaatcccatcaccatggcgatagggcataaacattccagggtgaaggcacaatccacactgtgaggtccaactgctgccgtgcagacaggagggcttttacaagtacaggaaggtcatcaaaggctcagtgttttctttcaaaaactgaatcccaagcccacacattattatgctggcttcttaaaataagttatgagatgggaaatagggcacccacaaatatatatatatataattatatacaatataatatatataatatatataacatatatataatttccttttacatcctgcatccttatattatatataatattatgtataatataatatgtattattatatataatataatatatatgaatatatataattatataatataatatgtaattctatataattctatataatataatatatattatatataaatatatataatatactatattatatataagtatacataatatattatatatacgtatacataatatagtatattatataaacatatatataatatattatatatacgtatatataatatattatatatacgtatatataatatattatattatatatacgtatatataatattatatatacgtatatataatatattatattatatatacgtatatataatattatatatatattatatataagtatatataataatgtaatatattatatataagtgtatataatgtaatatataatataatataataatatattataatatattatatattataacataatataatataatatacattataatataatatataatattatatataatataatatataatataaaataatataatatataatataatatataaaataataattaatattttaaattaattattattaattaatattaattaatattaaaaataatataaaatataattactataatataatctataattattatatataatataatatacaattatatataatattatatataataaaatatatataattatgtgtatttattacatataatataatacataaattatatataattattacatataatataatatataattatatataattattacatataatataatatataattagatataattattacatatgatataatatataattatatataattattacatatgatataatatatataattatatataattatataattatatatacaagataataatatataatatataatatatattacataatattttatataatatattatactatatatattatataatattttatataaaatattatatattatatataatataatattttatataaaatattatatattatatataatataatattttatacaatataatatataatatatattatattatcatatgttatacaataatatgttatagtataatatatattataatctaatatattatatattattatatattatattatatataacattatatagtattatatattttataataataatataatatataatattatatattatatataatatataatatattatgacatattatatataatatataatatattatgaatatattatatataatatataatatattgtgatatatattatatattatataatatattatgatatatattatatataatataatataattatatgtaatataatattatatatcttatatatcacatattatatattttatatcatatactatatattatatcatacattacatataatgtatgtcacatattatatgtaatatatgtcacatatatgtaatatatgtcatatattatatataatatatatcatatattatatatgtcatttattctgtaatatgtatcatacatattacataatatgtattatggtgtctggtggtcccaggacacagactgatgtcactcagcctcacatgacactctgtcctcaccacacttggggtcctgggagtcgtagcaccaggcacctatagagacagtgggcaggaggctgagctgagagaccagtcatctgggtcctctccaagccccatcccatcaactggggtccaagaatgaagtaggccaggggcttaggccaggggaggccagtgaagaaccttctctcatgtcacccctaccccagtattttctctccccagtccctccccactcccagtggcaagacctaaggggtggtggagcatggcaagagggtagattggagaccagacgggaagagtcctggtgctcactctcagagtctgcaccacaccagctgcaccgcaaggcgagcatgatgccaggggcgtgcgtggctcagtggcagccgcagctaggaaggactagaaagtggctagaccgcggagccaagatgctggcctggctactacatatttattcattagctagctgggctaggggcgtggctattgaggagaggatgggaggggtcggtgcccaggcagggccaccaggaagagcgggagcgctccaaactcacccaggtgtgctctggtcccagggctgcactgatgccagcaacaatcgctgaggttaatcctgcaggggaggggtgacctattattatccccacttacagtccaggaaacagaggctggggaccagaatgacacaccaaagccaccagcaagaaaggtcaaatagtgagggcaccttgaaccccagcgcccatgactttcggggcaaggatgggaggaaggtgtaggatgtctcttgccccgctgtgggcctggaactgccaccccatcccaagaccatagcctccctcctgcccaggcccccctgcggatccaggccaagacggagccctgcaggaggtcagaggaggggacttctttgcaccctgcgcctctttccaatcgccagagggcagggccctacccacattggggatgggaagtcaaatgcagaagttaggtgaagtcagttcttggatactcctgtactgtcaccctggtcttatctcatgccttagcccaagctgtgcacacaatggggtcctaggtccccctcacctcccagattccaccttcccagggatgggaccccctggaaccctcgggggcctgggcagtggccttgctggctcttgccttcctaggagctgagcaggagctccactctcagcagggcagttcactgcagcctctgcttcctcagctcaagccatcctcccacctcagcctcctgagtagctgggaatgcagacacacaccaccacgcctggcaaatttttgtatttttagtagaaacagggtttcaccatgttgcccaggctggtctcgaatgcctgagctcaagcgatctacccacctcgggctcccaaagtgtgggagccaagatgggaacccaagcatacggccccaatgctgaggctctgaactactgacctgccctcagcactcagccttgggatcatgagtcactgtgcaagggagttccaacatctgcatgtatgtctggaatgatctgagcctgcagagttcctacacactggccacattatagggtggtgtccgtggtcacacagctcagggcaggtatttattagtacatgaatagcttagctgtgtcatagtctttatgtgaaaggcacaaaaaaaggcactttggcaggctgaaagtgtggggattataggtgtcagccaccgtgcctagcccactggatgacttatgatatcatatgtgacattgtgacatcatgtgagtcagggatgtaccccgttctcagctgctatatgctatgttacactgacagaatgggaatgaagaatgtgtcccactctctcagctgttgtattatatcatacaaggtgcagtgactaagtgtgtcagctgtgtcctcatcctacatagcatatgagagtgtgtgacgggagataggatgcagacctgagaagcattaaacacctaggcaataaaggtgccagcatcagctgagagcgcaggtagacctcagtcacatttgttactgtgtaactaaaaatacaaaattagctgggtgaggtggtgcacgcctgtggtccccactgctcaggcacctgaggcaggagaattgcttgaacccaggaggcagaggttgcagtgagctgagattgcaccactgcactccagccttggggacagagtgagactgtatctcaaaaaaataaaataaaataatctaggacaaccaagagaaggactcaggctcaccttactccatgtcacatgtgatatataacacttgagggggacacacacttgtcactttgtatcactatgtcctatatgatagccaatgataacccaagagggggaggcagccttgttcacaccatgtcacttatgatattatatgacatcaaggagcccagacctcagttgcattatgtcactatggcacatacagtatcatgcaacaactgacagaagggttgcaggcctgattcacagtgtatgtgagtcacaaatgtcacttatgacaccatacagcaggtgagaggggatagtcattactcacctcgggtcacattgtcacacatgataccatatgatagcagagggggatgcagaactgagttgtattatgtcgctatgtaacctgtgatagatgatagctgatgcgggtgaagaccaaagttacattttgtacctacattatatgaaatatacaacatgcacgagggagatgcagacacaaatcacactgtgtgctgtatcccatatatgtgtttaatttctgtgtttaagagagctgggttcatgaatgaacttagtcactgcaccttgtatgatataatacaacagctgagagagtgggacacattcctcattcccattctgtcagtgattgaccacaccttgtgttaactgtatgagccactgtgtttggccgtgtatagcgcacgtggcacattgctcactgatacatatttgctccgtactgaagtgaggcagatgcatgagtgattgagaataatgctgccttggtgaagcattccatttagaagcatgaggttcaggtactaccatcttctgtgatacatatttaaatgttaagtttaacagttaggtctaccatgagtgaatgagccttgcattatctttgagaatcgatgtgtttagcagggtgtggctcatctaagatagccttctttaatgcatgttcactatctgtgtttattagaaataggtttgtgaatgacttagcatagtgttttccctatgaaaccctgtttatttatttatttatttattttgagatggagttttgctcttgcaacccaggctggagtgcaatggtgtggtctcggatcactgcaacctctgcctcccaggttcaagcgattctcctgcctcagcctcctgagtagctgggattacgggcgtctgccaccacacccagctaatttttgtatttttagtagagacggggtttcaccatgttggccaggctggtctcgagctcctgacctcaggtgatcctcctgcctcagcctcccaaagtgctggaattacaggcgtgagccaccacacccggccaaaaccctgttttaagaagtgtgtggtgcaggtactacattctttgttgttccaagttcaaaccctgtgtttaacagagataggtgcaagattgcctaggtgtagcgtagactcttggaaatactgtggttagcattctgtgttttctgtagtatagtttcagtgatgcctgtttagatagtttatcagatctaggtactagtgttatgtcagcgaaacactgtttagctgcacgcggtgcatgtaatactttgttcattgatatttgtttaaatcaatcagtgtttaccagaactagatatgtgagttactgagaatagcctaatctctgaaaatgttttccagcctatggtgcatgtaatatactcttctatggtacctctttccgatgtttttattgtggcaaaatatacataacagattataccatttttaagtgtagaatttagtggtagtaagtatagagagaaccttaaaagcagcaagagaaaagtgacttctcatgtgcaagggagcctctagaagattatcagtggatatttcagcagaaaccctgcaggccagaaggtggtgggatgatacattgaaagtactgaaagagtaaagcctgccaactgagaatactatatttgacaaaactgtccttcaaaagtgaaggagaaattaagacattcccagataaataaaagctgaaggagtttattaccactagacctgaccaataagaaataataaaggggccgggcacagtggctcatgtctgtaatcccagcactttcgggagccgaggcaggtggatcacctgaggtcaggtgttcaagaccagcttgaccaacatggcgaaaccccatctctaataaaaatacaaaaattagctgggtgtggtggcacgcacctgtaatcctagctactcaggaggctgaggcaggagaatcacttgtacccgggaggtagaggttgcagtgagctgagatcacaccactgcactccagtctgggcaacggagcgagacttcatctcaaaaaaaaaaaaaagaaacaataaagggagtccttcaagttgatatgaagggatactagacagttgctcagcctgatgaaaatataaaggtaaatacataaagattaaaacctgtattattgtaatttttgctaataactcaatttttaatactttaatggaatttaaaggacaaaagcataataattataaatctatgttaatggatacaaagtatataaagtttaatttgtgacatcagtaacttaatagtggggcaaagatgtaaagagtagaggttttgtatgtgattgaagttatctgtttaaaataataagataactttaagatgttccatgtaattcccatagtaaccacaaagaaaatacctacagaatatatgcaaaaggaaatgagaaggaaatcagagcatagcactacaaaaaatcaactataacacaaaggaagacaataagggaggaaagaaggacaaaaaggctctaaacatacagaaaacaatgaccaaaatggtggtagtaagtccttcctaatcaataatttcattaaatgtgcataggttaaactcccaataaaaagacataaattggctgattggatttaaaaaaacgggattcaactatatatgctgtctacaagagactcatttgaaatccaatacaaatgggttgaaaaatgagagaatggagaatattccgtgcaaaaagtaaccaaaacagatcaggaatggctgtacaagttatggctgtacaagttgttggggtttatgttactgaagaatgaacagagatgagtaagtggaggtgttatgtaaaggcatactgtactcaaaatctgaagacctgcagcagatttaaattccagctcttattataactttttaaaagattgtgaaaatatcaaaatatagatgaatcaagttttaatatactgtatgatgggtggatgaggctgtccattgtaccatttgtttgaattctcaggcatggtttggcagtgcaagaactctgtaacgttaacaaattcaataaaaagtaaatatatggaaaaaaaagtatagacaaaatagattttaagtaaaaaactattacaagagagggttctgggaagaaagtggagtaggaagcactgggaattcatctccccacctagaaaataatcacactggcagaatctgcctgatataactattttggaactctagactctatcaaaggaggcttgtaacctccaaatgaaggcttaaactataatttttacttaattttggtcaatttcagctcttagctcagcagtggctacccaatccccatgccccagcttcacggcaagaagctttgcatgtgttcctgaagcagcttgtaccaagcttgtgggaacaatcatgggcaataagcactctgtcctccaagtgttagcatctgcgttctggttgttgattgctacttttgattatggaagggcaaacacagaggccggcagccattattgctcacaactccccactccactgctgcaagcccttaccagactgaagcaacttctaggagatagaaaaggccagaaccccatttcccttccccttcattgttctcttttccttttttgggagccaaacattaaagactaggacactcaaaagcaatggcatacccagaggaaattaaagttaccacacatccttggagagaggagtgtgtgcccagggaaaggagcagcttcagacctgagaagacctcaagcttacaactcaggttgatcctcagcatggagacaacctacaacaatgtaaaacataacaaaaccctaaaacagcaaaccctgaggaagaggagagtctcatctccagagttactgcattattatattcaagtgtccagttttcaatacaaaacacaaggcatacaaaaaacaagaaaatatggtatttcaaaggaaaaacaacaacagaaactgttccagagaaagaccagatggtaacctactacacaaatactttaaaacaactttcttaaagatggtcaaagaactgaaggaagatgtggagaaagtcagtaaaattatgtgtaaacaaaatgggaatatcaataaagagatagaaaacctaaaaagaaaaaaaataaataaattctggaactaaaagtgtagtgattgaaataaaagttcaccagagggattcaaaagcagatttgagcaacagaagaaagattcagtgaatttgaagatgggacacttgaaatgatcaagtcagaggaacagaaataaagacgattgttgaatagcaagcagacattgtggaagtcccaaaagaagagagggaaaggggcagagagatcatttgaagaaataatggctgaggctgaacacggtgactcacacctgtaatcccagcactttgggaggccaaggtgggtggatcacaaggttaggagttcgagaccagcctggccaatatggtgaaaccccgtctctactaaaaacacaaaattagccaggtgtggtggtgcatgcctgtaatcccagctacttgggaggatgaggcaagagaatcgcttgaacccaggaggcagatgttgcagtgagccgagattgtgccattgccctccagcctgggcaacaagagtgaaactccgtttaaaaaaaaaaaaattagctgggcgtggtggcacgtacctgtagtcccagctactcaggaggctgaggcagaagaatcgcttgaatccaggaggcagaggttgcagtgagccaagatcacaccactgtactctagcctgggcaacagagcgagactctgtctcaaaaaagaaaaaaaaaaagctgaacacttcccaaatttgatgaaagacatgaaaataaatatccagaaaactcaatggactccaagtaggatgaaaaaaaaaagactcatactgagacattataattagccagtagggcctcttgaaagcaccaagagagaagcaactagtcacatgctaggaatatataataggattataagtagatttctcatcagacactttggagaacagaagacaatgggatgacatatgtaaagggctaaaagaaaaacaaccactacctctcaaccaagaatcctatatccagcaaaactgtccttcaaaagtgaggaagaaattgggaaatccccaaataaaccaaagttgagaagtttgctaccattagacctgccctgcaagaaatcttaaagagaatcatgcaggttgaaaagaaagaacactagatagtaactcaaagccatatgaagaaataaagatgccagtaaaagtaaatatatgggaaaatattaaatctagtattatcgtaactttggtttaaaactccatgttttgctttctacataatttaatagacaaatgcattaaaaacaattattagtttatgtttatggacacacaatgtacaaaaatgtaattttgtgacattgataactgaaagaggagtggcaaaactgtgaggagaatttttgcatattattgaaatatagctggtatgaattcaagttagagtgctataactttagaatgttaagtgtaatccctatggtaaccacaaataaaacattatataacataaaaaagtaaatgagaagggaattaaaacacttcgctacaaaaaatcaactaaatacaaatgagatcatgcaggaaatggacaaaaatgctgtaaggcatatagaaaatgtatagcaaaatgccagaagtaagtccccccttatcagtaattactttattactttttaaaccattttgttgaggaatgatttacataaaaactgtacatatttaacgtacacatcttgataaatttacaccataaaaccattatcatcaagcctataaacatatccatcaccttttaaaatttccttctgcctctttattattattattgtataaaaaaaatgtttttaatggccaggtgcggtggctcacgcctgtaatcccagcactttgggaggctgaggcaggcggatcacctgagatcaggagttggagagcagcctggctaagatggcaaaaccccatctctactataaatacaaaaattagctgggcgtggtggcgggtacctataatctgagcaaagtactgggaggctgaggtgggagaatctcttgaacctgggaggtggaggttgcagtgagccgagacagcaccattgcactccagccttagcaacaagagtgaaaatctgtctaaaaaaaaataataataataaaagtttttaattaaacaatttaagaatatagtaacattttctgtgggtactatgctgtatagctctccagaacttacttatcttgcataactgaaatttgtacactttaaccatcaacttcccatttccttctcttccccagctcccagcaaccaccattctgttctcttcttctgagtttgacgtctttaggttccacacataagtgagattgtacaacatttcactttctgtgtctggcttattttacttaacataatgccctccagtccatctatgcatagaaatgcaactgatttttggatgttgactctgtatcttgctactttattgaatttattacttctaacagtcttttagtgaagtctttacagttttctatacataaaaatatgtcatctatggagaccattttacttccattcttatttctttacttgcttaattgttctggctaggacttccagtcctattttgaggagaaatggtgagagtaggaattcttgtcttgttcttcatcttcgaggaaaaacgttcagtctttcactgttgagtatgttacatgtggtcttcattatgttgaggtacattccttctgcacctaatttgctcagtttgttgttttttttaatcatgaaaggatgttgaattttatcaagtgctttttaataataaaaataaaggatttttatcgtttattgtgttgatgtggtgtatcacatttagtgactcttgtatgttaaagcatccttgcatgccagagataaatcccacttgatcctggtgaataattctttttttgttttttatttatttattatttatttatttttttgagatggagtctcgctctgtcatccaggcctgagtgcagtggcgcgatctcggctcactacaagctccgcctcccaagttcacgccattctcctgcctcagcctccctagtagctgggaccacaggcacccgccagcatgctcagctaattttttttttttttggatttttggtagagactggattcatggtgaataattcttttaatgcactgttgaatttggtttactagtatttcattgaggatttttgcatctatgttaaccagggatattgacctatagttttcttattttgtagtgttcttatctggcattgatatcaggataatgctggcctcttagaatgagtttcaacgtgttcccttttcttcaatttttttggaagagtttgagaaggattgttattaattctttaaatgtttgttgaaattgaccagtaaaaccatttggtcctgggattttctttgttgggagatttttcattactggtttaatctctacttattttttcctgttttttttttttttttaattatactttaagttctggggtagccgtgcagaaagtgcaggtttattacttaggtatacatgtgccatggtggtttgctgcacccatcaacccatcatttacattaggtacttctcctaatactatctctccccttgcccccatcccccaacaggcctcagtgtgtgatattccctgccctgtgtccaagtgttctcattgttcaactcccacttatgagtgagaacatgcggagtttggttttccgttcctgtagttttcagatgtgctctggcctccaaggaccatgaagccaggcggtggtgggggggtgtcctctgtataaaaagtgctgtcccaggaacttcctgacggacactttggggcatgtgagcgattcctggggagggcacctcggccttcctaaggctacccctgcagccagcgctggccattctcaccagcaaccaaccaaaaaacatcagagtccctgtaaacctggttgtgatgataaaaaccaaatgttttctaatctaagacttgtatgcagaacacagaaaactgcagttaaggaacaccctacaaaattgaccaacagtattttccaaaaacatttttcatcactttaaataatgtacaaaatctacaaaaatcatatttaccaggacacatctgttaaataaaagcattgtttcgtgttggtatacatatatacaagactatgtataacagactgtttcccctccctgcaaccacagaaccatcacacacaggcacagatacacgtcagctatgccgctttccacgaatgcatggaacccaggacgcgaacccacagctcgaggtcttataccttcactactgagctgccgccactgcagcagcaacacctctgcggaggtgttgctgaaatcactggtgtccctgcccaaggtgtcctggtcctggtcaactctactgattgacccttcgtggatacctcaggtctaaaatcctttcctccgagccagagctcttcctgttgtgcaaactcagccccgtctgtaccttcctgcttggccggtgatcgcagtccttcttcgccagcaagtgtgggcttccaaagacaaggctgggcctggcctgggactccctgaaggccgagaaggacaggccctgcagaggcagccccaggtaggggctgaagaggccggtctccctgcccccccaggagacaccctttccaaagtggaagagctgggtggacagcagcggggagaagcccgcaaggggcaggctgggcaggccccgggcggggccctcggaccccttgtctctctctcccaatgccgccccctccacgccgcatctctacctttggagcgcagtgcccatgggctgggcagccgactgtggtgggcaaagtcactccagggcggggcgcggttggcctgggctccagcatccctctcagctcccgggctgggggtcaggaagctccggttcctgcagtccacgtgaaaggtccccctggctcctcctgcctcggtgcccgctgtggcacagctgggccgctgaccaaaagcacttttggcagcaggctcagcccctcgtgggctctggtctttgtaaacgtaaacacttctcttgctcactgagagaccttggcggagacactgccgctggtcctcctgggtggcgcatgatcccctccgccggatcagtggggagccccttcccaccctggctgagcaggcacgctgcgccctgtgctcctgcgctccctgcgcctcgatgccctttagccaaatgtgggaccccccggccctctggctccgtgtgcacatgccaggcagtggggccggctccttcctgcaaggtacctctggcctggctgggccccctgtcccgagagcggtggggccctctgcctgaacttctgaactgctcaccgactccttggccttttccaccaaaaacttcctaatctccagttcgatgctatcgtcgctgtccactgaactgctgttgtcagacaaggagccagggctgggagctgggccctgggactctctggggaatagattctcttcggaggcggaggcagaagcgggtctcctcaccaggaaggccggggcttcgtcctctcggccctgctgccaaagacactggggggtttcttcctggagccctcgcagctgtctctcttggacttaggcagctcttcagcacctgcaggtgcctgtttttccactctctcaggagcctgcccagccgctcctggaagtgcgtctgggaggtgctgaacctgaccttcttcctgcacacagccctgggctccctggacctcttcttgagctttcacttggaccttaacaagtccttgatggctgtgtccaggtccttgtcactgtccagggaactgcttttgtcttcggagctcttcttcttgtctaggtgccttgcctcgtctgtcttaccctggccctgtgacgtgcgagtgtcaccgggcaccctagcggcgccctctcctcccggggcctcgctggctgtgccctggatggaaaggtcccaccctagcggcgccctcccatcccggggcctcgctggctgtgccctggatggaaaggtcccgcccctcatggccgggcccggctctcccctggctgcggtcggcatcctggccaccctctttccccaccacccgcatgttcttgggagtggatggcctcacttggcagccgcctctatgcttccttttgcagccaggagtgggtccagtgttttagagagaggggccttggggctgccggtctggctgctgaggccaggtggtgaaagtgggccctgggcagcctgagggcagctctcacctctggccagcaaacttctagactgcaccttgagggccaaaaacgtccagatttcctgctcaatgctgtcgtcgctgtccacggagctactgtcaccatcagagcgggaaggcacgttgggggagtagaagagtgggcttgcggacagggacccatcgctgccctccatagggccggcaggatcgtcttgaaaatgtccaggactgcttctacacacatcagctcagcggaggtgtctgcctggcaagaggaccattccacaaacttgctcctggaagccgggctcgttggaggtggagctttggtttcctttgggatcttgggggaatggtcagcgtccagatcccctggaccagggtccgtggtcttggtgggcactggcttcttcttgctgggtgttttcctgtgggtctctggcaaggcactttttgtggcgctgcttgtgctgtgtgcgggaggggcaggtgctctttcctcttggagctggaccctctggggcgggtccccgtcggcctccttgtgtgttttctgcacctggtacagctggatggcctcctcaatgccgtcgtcgctgctggagtcggacgcctcgggagcctgtacggcgctcgtgactcgctttcccctccttgcggtgctggcgctccttttaatcccacttttattctgtactgcttctgaagggcggtgggggttgctggctttgtgctgccctccttctcctgcgtggtcgtggtcgtgaccttggacctgaggcttctgggctgcacgtttgtctttgctaaccgggggaggtctgcagaaggcgaactccttctggacgcccatcaggccctgccggtgcaccacctttgtagccggctcttggtgggatttcgagagtgacttcgccgaattttcatgtgtgtctggtttcttctccactgacccatcacatttttgggtctcatgctgtcttttctcattcagaaactgttctatttctgccctgatgctctgctcaaaggagtctgctctgctcatgctgactggggaggcagagccctggtccttgctggatcccacctggctgccagggccacaccacctgagccaggtacaagttttggggaacacagggcagttgggcactgctgtgagccagttcccgcttacatctactgcctccgcccgcagccctggaaggctgtgcatggctgggccccgctggccccgggctgtgccgctccactctttaccttcaggtactcctggatggcctcctcaatgtcccggtccacggaatcgtcactgtctgaatctagcaccaatgggccaaagtctgcagtttcctcctcccccacggggtcaaagtcagcaacaagaccacaggcagccaacgcaggcagctccttgtgcatggtgggcttggcagcaggcctggcgtcgtggcatccctctgccccctctgcgcagtgcgctcatcgctggtgcccctagcagccctgtcgctctgcagcgtgctgatgagcatctgcacccgggtgctcaccgacatgctctccacgcccttgtcagcctccgagaagcacccggggaacctaaagctccctggcgggacagaggcctcccatttgggctggagagcaaccactggaggagcattcatgagaaacattctggcagatggggagcgacgcgcagaggggcgacactttatttctctgcaggcttcacatcctccaaagattggcaagcagtacccgtgaaataactttaaacctgcaaatgcttctttgcaggtttaaaaggatgactataaactatgacgtcatgcctagattcattcttgacccaaccaacaagctcttgacattctctgagtccaggttgactgtgatgaaaggcagctagtgttcccaaatggcccagggatcaggtcttcatcgctccactcagagggaagcatcctctctctgctttttaaatagacttttgactggggctccagcagcgcggggcgcgcagacctggagttgcatggaggccagagccacgacacccgcctggggaacggagcagccccaggcgctgatccccgtccacctgccccacggagccctcgccgcccgcttgccactgcctgcatggccctcctgtccccggccccccagccctcctttccccagctcccccaccctcctgtccccggcaccccagcttcccagcccccgaaaccgcccccccacctcgacccggcccatgccgcaagtcgcccgctgcgcggacccggcctccgcccgcctcctgcgtcctgggggaggcggctgccgggggtggtgggggagggggagggggaagaggccgccctccgcccgggtgcggggagggggcgcaggggtgtccggccaggccccccgcctccccgcctccccgcagcagctgccccgctcccgggccgcctaatacttttacattttaacttttatactacagtgaaaagtgatttacacaccaccactgcaatattacagtgttatgaatgtgactatatacttacctttccctgtgaacttttttttttgagacagagtctcgctctgtcgcccaggctggagggcagtgtccatgatctcggctcactgcaagctctgcctcccgggttcaagtcattctcctgcctccgcctcccgagtagctgggactacaggcacccgccaccacgcctggctaattttttgtatttttagtagagacggggtttcaccgtgttagccagcatgatccccctcttctgaccttgtgatccacccgccttggcctcccaaagtgctgggattacaggcgtgagccactgcgcccggcctacctgtgaacttaatatcttaatgttttaatgttgctaatcagaatccttttatttcaacttgaaaaactgccttataaggcaggtgcagtggtgatgaactcccttagaatttttttggtgggagtctgggaaagaccttatcatctctttttcatttctgaaggacagctttacaagttgtggtcttcctgattggcagtttttttcttccaatacattgaatatagcatcctattctctcctggcttataaggtttctgctgagaaatccactgatagccttattgaagtttccttgtatgtgatgaattcctttcttcttgctgcttttgaaagtctctgtctttgacttttgatattttaattataatacatcttggtattatggtctttgggctggccttttttggggcctctgaacttcatgtgtctggaagcccacttgcctctaagaatttggaaagtttttacccattatgtcttcaaatatactttcaggccttttctatcttttttacttctaggaagtccataatatgtttgacccacttcatggtggtgtcctataaatcccaaaggtttttacttataaacttttttttctttctggtcttctgacgggatatttcaaatgtcctgtctttaatttcacagattctttcttctgtttgatcaagtctgcaattgaaattctctattgcattttcatttcattcatttatttatttttatatatttttgagacagagtctgtgtcacccaggcttgaatgcagtggtgccatcttggcttactccaacttccacctcccggttcaagcgattctcctgcctcagcctccctagtagctaggattacaggcatatgccaccatgcctggctaatttttgtatttttaatacagatggggttttggcatgttggccaggctggtcttgaactcttgacctcaagtgatccgcctgcctcggcctcccaaagtgctgggattacaggcgtccgccacggcacccagcttgcattttcattttattcattgtattcttcagttctagaatttctgtttggttcttattatttctgtatctttattgaacttttagctttgctcatctactattttcttgatattattgagttgatatatacattctagtaaatttcactgagctatcttaattattttgaattgtcaggcaatttgtagatctctatttttggggggttgattactggagatttatgagtttattttggtagtgtcatatttgctgattcttcatgatctacagactttcattaatgtctatgaagaagcaaatacctcttctttttttttttttttttttttttttttgagacagagtcttgctctgtcacccagctggagtgcagtggtgtgatctcagctcactgtaacctccacctcccaggttcaaatgattctcctgcctcagcctcccaagcagctgggatcacaggcatgtgccaccacgcctggctaatttttttgtattttttgtagagacagagtttcaccgtgttgtccaggctggtctcaaactcctggcctcaagtggtctgcccgccttggcctcccaaagtgctgggattacaggtgtgagccaccatgcccaatctctttctgtctttatagattggtttcagcaggtacaaaccttttcctgctggatcccttgactggatcacagtcaagtgggcctggagccatattacatggctgctgcctggtctgcagctgaatctctgattggcaggccgctatcaaggcataggttggtgatgcagtttctgctggatcctcaggagaactggactgcctctgataccctgattgaacaggactggagccaggtcatggggccacttctagttctacagtcaagtcttcagatatcaggcctattaccaagggcatggactggtatagctccctgtgggtcccagattgagctcctgctggtttactaggtaggtccatgggaagacaggactgcctccagaccacagtagagcagggctagagccaagtcacaggacagctttggtgaccacatttgagttcaagattggtggtcctcttattaggagaatggatggtatgtctttcaccaggtcccaggatgggctggactgtgcccagactgtggcaaagcaagactggaatggagtcacagggctactttagtgtccatagctgagactgagatcagcaggcctgttaccaagggtatgtaaaggcatcactgaattcctgggcaggcatgactgactgtggtagagtggggctgaagccaggtcagggctgctttagtttctgcagtcaggaccatggttagaaggcctgttactgggggcataaatggtcatggttcctcctaggtgcttagtggatggggctagttgcaagaccatgatctagtggagctggacccaagtccataggaggacaaagctgctttcagtctgcaactggtaacctgtcactggtgtgtggacctgccttctcaaagcagctctccttggttttgggctttgctagagttttgccacctcctgcctggatattaaaactcttgcaaaggcagttttgtccatgaatggctgccagatcattgtttgtgtggggagaggtgagtggagggcctcctgttctgccatcttgctgatgtcaccctaagatgattatttgaattctttgtcaggcaatttgtagatcttcatgtctttggagtcagccactggagtttcattttgtttctttggtggtgtcatattttctcatgcttcctgttctttgaagacttagattgctttcttcatgtttgaagaaggagtcatcttttccactctttactaacttcaggagagaaagaccatcaattagctaagctatagattctgggggtctctcagtccttttctgtgggtggtccttcccttttaagggggatgtcttaggattttgtcccttgtcttcatttcacaaatgaataaaacaaccagaccagacataagtaaggaaatacagcacttgaacaacacctgaaaaaacaactagacctaacagacatacacaggatattctacccaacaacataatacacatacttctcaagtatacatgggacattttcaggatagaccatataacacatcacaaattaattctcaataggggctgggtgcagtggctcacatctgtaatcccagagtaatttgggaggctgaggcgggtggattgcttgaagccaggagcttgacatcagcctggccaacatggtgaaaccccatctctactaaaaatacaaaaattagctgggcgtggtggtgcgtgcctgtgatcccagcttcttgggaggctgaagcgtgagaattgcttaggagcccaggaggttgaagctgcagtgagcagagattgtaccactgtactccagcctgtacttcatgacaaagaaaatgtaccattgtaccactgacagaacgagaccctgtcccaaaaaaggaaaaaagctcagtagatttaaaacgatagacatcatacaaagtgtcttctctgaccacaacaggataaagttagaaatcaataacagaagatttaaaaaagttcacaaattagtagaatttaaacaacacactctcaaacaaccaatggatcaaagaaatcacaaagaaattataaaattcttaaagacaaatgaaaatgaaagcacactatatccaaacttatgggctgtggccagttgtggtggctcacacctgtaatcccagcactttgggagactgagggaggtggatagctagaggtcaggagttcaatttcagccaggccaacatggtgaaaccctgtctctactaaaaacacaaaaattagctgggagtggtggtacgtgcctgtagtcccagctacccaggaggctgaggcatgaaaatttcttgaacccaggaggcagaggttgcaccactgagctaacaccactgcactccagcctgggtgacagaatgagactctgtctcaaaaaacaaagaaacaacaaaaaaacacaacttatgagttgtggtgaaaggagtgctaaggaggaaatttatagctataaacacattaaaaaaagaaacacctcaattcaacaacataagtttacacattaagaaactagaaaaagaagaataaaactaaacccaaagttagcagaaggaaggaaacaatagagatcagggcagagataaatggaaaagagaatagaaaaacaataaaaaacaaaaccaaaagttggttcttcaaaaagattaataaaactgacaagactaaggaaaagggaaacaatctaaattacttaaaacagaaatgtatttgagaatatctttatatatttctgtctgtctgtctgtctgtctgcctgtctatgttttagagacaaggtctagctctattgccctggcaacaatcagatgcaaccagaatcagtggcacaatcggctcactgcagccttgaattcctgggctcgccactatgccagctcttttttttttttttttttttaagagacaggatcttgccatgttatccaggctgatcttgaactcctggcctcaaggaattttcccacctcggcctcccaaattgttggattacaggcatgacccaccattcccagcctagaaaggattataaaagattactataaataattgtgtgctcataaattggataacccagatgaaatagatgaattcctagacacacaaaacctaccaagactcaattataaagaaacagaaagtcagaatagacctaacctagtaagggaattgagtcagtaataagacaatctcatgacaaagaaaagtcctggacctgatagctttactggtgagttctgccaaacgtttaaagaagaactaacactgattcttttcaagcatttccaaagagtggaagaggagtgaatacctcttaactctttctatgaggccagcattaccctgataccaaagccaaaaacactgtaagaaaataaaacaacagatcaatatgcctctgatcattgatgcaaaaactctaaaaatgctagtatactgggtggggcacggtggctcatgcctgtaatcccagcactttgggaggctgaggtgggtggatcacctgaggtcaggagttcaagaccagcctgaccaacatagagaaactcttgtctctactaaaaatacaaaattagccatgtgtggtggtgcatgcctgtaacctcagctactcgggaggctgagacaagagaatcgcttcaacccgggaggtggaggttgtggtgagccgagatcatgccattgtacttcagcctaggcaacaagagcaaaactttgtctaaaaaaaaactatcatactgaattcagcatcatattaaaaggattatacaccatgaccaagtgggatttattcctggaatgcaacgatgtttcaatatataaaaattgatccatataaattcagacaattaattttaactgatgtatagttttacattatatgcacataccacgattcacttttccattttcctagtaatgagctttaagattatttccaatttttagctattaccaataatgtttcaacaaacacctttggacatctcttctgcaaatgtgtgtgtattctcttggagaaggtttaccctgtggaatttctagtgtgtatgtgtatgtgtgtgggtatatatatatacacatatgtatatattttcaactttactatatatttccaaaaaactcttcaaagtggcagatttaaactccccttcgccgtgtataaattcacggttcctaaagcccttggcatagttttgtgtttttatagaaaagggcataaagtcttattgctgttgaattgtaccttgctcttttcaattgtcttttcacaataattcactatttatcatctgttgtgaatattgtgtagtagttcttaatcattttttctactatattatttattttatatcatgaatttgtagaaatcctctttatataatggatattatacttttcaattatatattttgtaaatattttacccaattttctggcttgcatttaacctttatttaggatgcctaggatttttcattttaatacagtctaatttatttttcttttcttttcttcttcatgcattctggcatttgattaataagccatttgttgcccaacgtcattagttctctgtatatacttttaaatatcttaaacatgtaatattcataagtaatttcacaagtagtttaagatttgagtctttaacctaaatagatacaggattttgtgatatgctgtaatatacagatttttatttatatatggataaaaatttatatgttttttctgacatcatttattgaatagtataatttttctactgacttttagtatcatatcttttattacaagtccaatgtattcagcatatctatggatctatttcttggtgcttccattttttcccattgtttaacggtgtatcactgagccaaagcaaaccattttaattattataattaaaacacatttaaatattgataggctattattgttcagaataactttggttcttcctttccattgattattttaatatgacttttccaatcaagttctaaaaaaatactggtggtatatttattgaaataactttaataaaattaaatgaaagatcatgtgttttctgaattaattcttagatacgttaatgttttatgttaccatgaatgtgatattataatataatatttttaattggttgctactgtttataagaatttcattttctctttactttgccttcatatctgaaaaccttgctgatttgattagtgcatccacaaattttcttggattttctatgggtaattacaaatctccacacaatgaggttgcagtgagccaagatcacaccactgtactccagcctgggcgacagagtgagacaccatctcacaaaaacacataaacaaacaaacagaaactccacacaatgacaacgtatgtgttttctttttttcttcctctttctataatatttctttgtcctatcttaactgaactggccagaaaccccaggacaatgataaatacgagcagtgtcaacagacatctcattccctttcctagcttttataaaaaataacgattatgcttcaacattacatatggtggtgtcgatggttttgttatagataagcttatcaggttaagaaatttgtctgcttttcctagtttggtataaagattttaatataaatgaatgttgtattttaccatcttattttttttcctacatctgctaaggtaatcctgtgttttccctttttcaatctcctaatgtggtgaatgacattaaaataccttctattgttaaaatattcttgcaacgctgtatagaaccaatgcctttattctgtattgctgatggatttttgaaaaatatgtaggtggacttagttttctaaggggaatagaatttctagtatatttaaactattttgcatgtatgttctgaaggacattggtgtgtcatttctataccatctggctacgagaggagccgactgaaagtcacactgccggaggaggggagaggtgctcttccgtttctggtgtctgtagccatctccagtggtagctgcagtgataataatgctgcggtgccgacagttctggaaggagcaacaacagtgatttcagcagcagcagtattgcgggatccccacgatggagcaagggaaataattctggaagcaatgacaatatcagctgtggctatagcagctgagatgtgagttctcacggtggcagcttcaaggacagtagtgatggtccaatggcgcccagacctagaaatgcacatttcctcagcaccggctccagatgctgagcttggacagctgacgccttggatcatctgccactgatctctggtcaacatttttatcacccaacacaaaagaagcagagatttatcaagttacttaaacaacctgaccctttcatcttttgctacacatactcttgtaattgatctctccatgaattgttttctgtttaaaatatctagaatgttttctgcttcctgacttgattctaatattgtataggtactagaaatggttctagaaatagatctttatagatgagaatctggaagtggtttgctgacctgtttcagtctgaatgaattcctgaccttgttgtcgggaggagacagaaacctgatcatctgtagtgtacggtggtatcatgattacttaaatcatcaaatgtggttattgggaatgatgtgttttttaaagtggtacatgagaggtaaaattgctattgtagttgactgttgcagttataattttgtcaacatggtctgtaagagtgcaatggattcggcccggtgtggtggctcacgcctgtaatcccaatactttgggaggccaaggtgggccgatcacgaggtcaggagatcgagaccatcttggctaacacagtgagaccccatctctactaaaaatacaaaaaattagccatgtgtggcggcacacgcctgtagtcccagctactcgggaggctgaggcaggagaatggcgtgaacccgggaggcagagcttgcagtgagccgagatcgcgccactgcactccagcctgggcgacagagcaagactccatctcaaaaaaaaaaaaaaaaaaaaaaagagtgcaatggaaagctggtagaaaatggacattgtttaaagaccaaaacaaccacactactttgctaatccctatcagctaaagcctagagaatatatgaggtatagatttacatggtgtttgactaaggcatgcagaatataatcttgacataggctaagtttatcaacatagatacatagagattctgaagttaaagtcttagcccaagaagttagaaggggtgctcaagtttgtttgtctgacagaaactgtgaatccacactggcctgcttattttgaggttgtgttgccagagctttcctagcataataaagagaggtgcatacaaaggaataggaatagtaggaggtgggggtaaaaatatcaggtgtgatccacatgccaagccgacccgcactgtgtcccacaggaagcccagaagatgtttctctaagaaattaaggattcgtttgttggggagggctgctggcatgcttgaaaagtactgtgatggctgaattttgtgggcttggggagattgcagattctctgatttcaaggggaatgatgtgatcctagagttgcaaagaacaagtgacagtggaggcgcttatgctttgtgactgcactagagacaaggaagacacaactagaataatggggagcaggaatggagcggccaacagaatatgtgactgttagggatctttgatgaaggctgattctcagggagtgaactacatcagtgaccaactatttgtctttatataactgggtaatgtggatggattctaataaagggactacttacagcacagcaggaaagtcacaaagaaaccagacagaagagtgtaagtagtaaggggccaagcagtcacctgactagagacagtgccagcttgccaagaaggcaccagacagaagctgtgatcttcagcaaagggacacagtctgcctgtgctgaccctgcaggggcagaggtgggggataaacacactcttctctcacctatcttctgccaccccctccattagctgaaccccaataaaagcatgagggtaagggagatctctgaagtatccaattcaggtgagcctcctaaggaacaaagcagaatgcagaaaaattaagagtgggtctagggaataaaatagagatatgcaccagagtatgatgatgtgtctgggaaagaatatacaaatacttttaaaattactagacaataaacctgagatgacactaatacaggtaaatctcatttaatggtaatatattccaagaaatgcatcattaggtgattctgtggctgtgcagacaccaaagagtgtactttatacaaacctagacagcgtagcctactacatacctaggctatatcgtacagcctattgctcctgggctacacacctgtgcagcatgtcactgtgctgaatacagtaggccaatggtccccaacacccaagccatggaccagcaccggttcgtgtcctgttaggaactgggcacaaagcaggagatgagtggctggccagccgaacattactgcctgagctccgcctcctgtcagatcagcagcagcattagaccttcacaggagcacaaaccctattgtgaactgcccatagaagggatctaggttatgttctccttatgagaatctaactaggctgggtgctgtggctcacgcctgtaatcccaacactctgggaggtcgaggcaggtggatcacaaggtcaagacaatcctggccaacatggaaaccccgtctctactaaaaatacaaaaattagctgggtgtggtggcgcatgcctgtagtcccagctactcgggggactgagacaggagaatcacttgaacccgggaggcagaggttgcagtgagccgagattgtgccactgcactccagcctggcaacagtgggagactcagtctaaaaaagaaaaaaaaagaaaaaaagaatctaactaatgcctgatgatctgaggtggaagagtttcagcccaaagccatccccactccgtggaaaaattatctttcacaaaaccagtccctggtgtcaaaactttggggcccactgctgtaggcagttatatcacagtagtaatatctaaacatggaaaagatacagtaaaaacacagtacattgggagaccgaggggggcggatcacctgaggttagaagttcgagaccagcctgaccaacatggagaaactccgtctgtactaaaaatacaaaattagctgggcgtgctggcgtggggctgtaatccctgctactcgtgaggctgaggcaggagaatcacttgaaccccggaggcagaggttgcagtgagccaagatcgtatcattgaactccagcctgggcaacaaaataaaactccttctcaaaaaaaacaaagaaaaaaatatatatatattacaaaatttaaagagagtggtacaccagtaaaggacatttagcatgaacagaggttgcaggactggcagatgctctgatgagtcagtgagtacctggtgagtgaatgcgaaggcctaggatattactgtacataactatagactttatatgcactgtacacttaggctacactaaatgtatttaaattttttctttctttaacaagttcatcttagcttatcataactttataaacttttaatttttttaattttttgattctttgataataacacatcttaaaacaaaaacacattgaacagctgtacagaaatactttatatccttatttgataagcttcatttattttgattttttatgttttaaacatttttgttaaaaactaagatacaaacacacacactagcttagtcctgtaagggtcaggataatcaatatcactgtcttccatctcgaaatcttgtccaagtgaaaggtcttcagggtcttcagtggcaataacatacatgcagctgtcattctctatgataacaaggctttcttctggaagaactcgtggaagaccttcctgaagctgtttcatagttaattttttttaatgagtagtagtactacactctaaaatatgaataaaatctgtagtattatacatactgttgatccttgaacagtgcaagggttaggggaccagctcctgtgcagttgaaaatccatatataattctgggctatccccaaacttaacttaatatgatatatatcatatataatatatatgatatatatcgtatatattacatatgatatatatcatatataatatatacgatatatatcatacataatatgtatgatatatattatacacaatatgtatgatatatattacatacaataagtatgatatatattatatacaatatgtatgatatatattatatacaatatatgatatatattatatactatatgatatagattatatacaatatatatgatagagattatatacaatatatatgatacagattaaatacaatatatatgatacagattatatacaatatatatgatacagattatatacaacatatatgatagattatatacaatatatatgatatagattatatacaatatatatgatatagattatatacaatatatatgatatagattatatacaatatatatgatatagattatatactacatatgatatacatgatatatcatatatatgatatacatggtatatcatatatgatatatacgatatatcgcatatatgatatagatgatatatcgtatatatgacatagatgatatatcatacctgatatagatgataaataatatatgatatagatgatatatatcatatatgatatatcatatattatataataaatgatatatattatatataataaaagatatatattacataataaatgatatatattatgtaaaatatatgatatatattatatattatatctgatatatattatatattatatattttatctgatatatattatatattatatctgatatattatatataattatattatattatattatatattatatattttatattatatgatatataattatattatattatattatattatatatattatattatatataattatattatattatatattatatattatattatatataattatattatatgatattatatattatatataatttatgatatatattatgtattatatataatttatgatatatataatatattatttatcatatatcatatatattatggtatattatatataattgtattatatataataatatataatataccataatatatcatatattatataatatataatataatataatataatgtaatcatatataatatataatatattatattataaaatatattatattatgatatactatatattacatgttacattatataatattttgtataatatataatatatattatctattatactttattatattacatatataattatacattattatatttcatatataattatataattatacataattatatatattatattatatataatgttatgtataacaatatatattatacataatattatatattatattaaatatgatattatatataaggatgcaggatgtaaaaggaaattatatatatgttatatattatatatattatattatacataatatatatatatatttgggggtgccctatttcctatctcataacttattttaagaagcacagcataataatgtgtggacttgggattcagtttttgaaatgaaacactgagccttcgatgaccttcctgtacatgtgaaagcacacctgtctgcatggcagcagttggacctcacagtgtggattgtgccttcaccctggaatgtttatgccctatcgccatggtgatgggattagggatctgctgcccttggtcctaagtgccactatctgtgctgagtttttcaaaggtcagagcagattgaacctttgtggtttcattttccctgattttgatttttcttatggggaacctgtgtggctgcattcaaggtatgttcatactggcctgtcaaatgcgatcttttcaaattactagttaatgctttcaaaatatgttatttaaaaaattagcctctgtattttccatatgcagttataaatatgtttcatggttaggttttattcctcaatttatatatttgattattgtaccaagcagagtacctttgaaatttttcttcatttaaaaaatatgtatcttggctcaagcctgtaatcccagcactttgggaggccaaggcaagaggatcacaaggtgaggagatgaagaccatcctggccaatgtggcgaaaccctatctctactaaaaatacaaaaaattagccaggcatggtggcagctggtgtagtcccagtgtggtgtagccccagctacctgggaggctgaagcaggacaatcgcttccacccgtgaggcagaggttgcagtgagccaagatggcaccattgcattccagcctgtgcaacagaacaagaatctgtctaaaaaaaattatatatatataatgtatattatatgtactatatattacataaaacatataatatataatatatataatatatataaaatataatatacattatatataaataatatatattatatgtcacgttatgtaatatctatgatacatattacataataaaagacatatataatatatgatatatattacatataatatatgatatatattacatataatatatgatatatattacatataatatatgatatatattacatataatatatgatatatattacatataatatgtgacatatattacatacaatatgtgacatatattatatgtaatatatgatatataatatataatatatggtatataatatataatatatgatatataatatatgatatataatatataatatatgatatataatgttatattacatataattatattatattatattatatatatcataatatattatataatatataatatatatcataatatattatataatatataatatatatcataatatattatgtaatatatataatatatcattttatatattatatataatatgtcataatatattatataatattatatataatatatcataatatattatatattatattattataaaatatataatactatataatgttatatataatataatattatattagattataatatataatattatattagattataatatataatattagattataatatataatatattagattataatatacattatattataatatattattgtataatatgttataatataatatatattatatattatattatacataatattatattatatataatatatataatattttatacaacatattatatataatatcttatataatatattatacaatatattatattgtataatatattatatatattatgtattattatcttgtatatataattatatataattatataattatatatattatattataggtaataattatatataattatatattatattatatgtaataattatatataagtatatattatattatatgtaataattatatataatttatgtattatattatatgtaataaatacacataattatatatattttattatatatattatgtataattgtatattatattatatataataattataggttatattagatatattaattgtattttatattatttttaatattagttaatattaattaataataattaatttaaatattaattattattttatatattatattatatattatgttatatattatattatatattatattatattatatattatattatattatatattatattatatattatattatatataatatagataattatatattatatatcattatatataattacatatattatattatattgctatatatattcatatatattatattatatataataatacctattatattatacataatattatatataatataaggatgcaggatgtaaaaggaaattatatatatgttatatatattatatatattatgtcatatataattatatatatatatttttttgggtgccctatttcccatctcataacttattttaagaagccagcataataatgtgtgggcttgggattcagtttttgaaacaaaacactgagcctttgatgaccttcctgtagttgtaaaagccctcacctgtctgcatggcagcagttggacctcacagtgtggattgtgccttcaccctggaatgtttatgccctatcgccatggtgatgggattagggatctcctgcccttggtcctaagtgccactatctgtgctgagtttttcaaacgtcagagcagattgaaccattgtggtttcattttccctgattttgatttttcttatggggaacctgtgtggctgcattcaaggtatgttcttactggcctgtcaaatgcgatcttttcaaattactagttaatactttcaaaatatattatttaaaaaattagcctctgtattttccatatgcagttataaatatgtttcatgattatgttttattcctcaatttatatatttgattattgtaccaagcagagtatctttgaaatttttcttcatttaaaaaatatgtgtcttgactcaggcctgtaatcccagcactttgggagcccaaggcaagaggatcacaaggtgaggagatcaagaccatcctggccaatacagtgaaaccctgtctctactacaaatagaaaaaattagccaggcatggtggcagctggtgtagtcccagtgtgaattgggattcagtttattcccaaattcccaaattttatatatatatatatataaaatatattaaatatattatatatatactatatattatattatatataattatatatatatatatttttgggtgccctatttcccatctcataacttattttaagaagccagcataataatgtgtgggcttgggattcagtttttgaaacaaaacactgagcctttgatgaccttcctgtagttgtaaaagcccacctgtctgcatggcagcagttggacctcacagtgtggattgtgccttcaccctggaatgtttatgccctatcaccatggtgatgggattagggatctcctgcccttggtcctacgtgccactatctgtgctgagtttttcaaaggtcagagcagattgaaccattgtggtttcattttccctgattttgatttttcttatggggaacctgtgtggctgcattcaaggtatgttcatactggcctgtcaaatgcgatcttttcaaattactagttaatgctttcaaaatatgttatttaaaaaattagcctctgtattttccatatgcagttataaatatgtttcatgattatgttttattcctcaatttatatatttgattactgtaccaagcagagtatctttgaaatttttcttcatttaaaaaatatgtatcttgactcaggcctgtaatcccagcactttgggaggccaaggcaagaggatcacaaggtgaggagatcaagaccatcctggcgaatacagtgaaaccctgtctctactacaaatacaatcaattagccaggcatggtggcagctggtgtagtcccagtgtgaattgggagtccgtttattcccaaattcccaaattttatatatatatatatataatatatataatatataatatattatatatattttatataatatataatatatataacatatatattatatataatatatacattatatgtaatatattatatatattttatattatatataaaatatatatactatatataatatatatagtatatataatatatattatatataatatatatagtatatataatatatattatatataatatatatagtatatataatatatattatatataatatgtataatattatatattatatatattatatatattatatattatatattatgtatataatatatattatttatatattatatataatatataatatataatatataatatataattatatattatatatattatatattatataatatataataaataatatatattatatatataatatatatgatatataattatatattatatattatataatatataatatataataaataattatatatcatatatataatatatataatatatataaataatatatattatatacataatataattatcatatattatatatatgtcatatataatatatgtcataatataatatatgtcataatatatataatataatatatgtcataatatatatataatttccttttacatcctgcatccttcaacctgcatccttcaacgttccatcccccaccccacagattaagttattcccctggggagaatatggcgaagtctattttaatgctgtttttaacccaattaagaacctatgaaatcattactttccaaaactttggaacaaagccacagtagtaaggatccgttggaggcttttcacacaataaaatgtaactctctttgtttttaacatgtttttcccttcctctcttctttttttgtgaaatgtgtatttactttaatatatttgtagtaagtcacttccatgcacatattaattttttaaagtaataagcatgtgtattgtctacgtgtgaaagaaaacacacatttatttttatgctttggaagttatccagaatcatggaattgtcaatcacagtcaatcacccaacctactcacctttccagtgtaatcttagtcaaatttttttttttgttatccaatgagatgcagtatttcaactcagaaagataaatagagtgaatttatagagactattaactaagaacatacagtttgatttatactcagaagcaagtagattatgtacatatatatgaagataaaaattaaaaggataattgtgtaaatttgcatgtagagggctttgaaaacctgtttacttgtgaatgctgttttgatgtattgtgtctttgttctcccgacccatcatccagagctctctgcaggagctaagtgctcatcagttccatgacttggaaactgtctaagtttagaggcacttgtatttgttagtaaataaggcaagatgatattgtttcacaggttttagtgccgaagactgaatagataagctgctccacccagtacactggtgttcatttcatggtcatctcatctgttaaccatggatataaaacatttatcttcaatgatggggttttaccatgttggtcaggctggtctcgaactcctgacctcaaatgatccacccacctccaccttccaaactgctgggattacaggtgtgagccactatgcctgactgattattttcataaccaagaaaagaaataaatacaattaatgctggtgcatggtattaaatctagtttttaaaaaattcacacataaacagggcagaaccctataccctccatgataaatgcagtagcagtgtatgtgggtctgtggaggttgaaagggacttggtcgatgtcaagaaggtagtggcagtcctgctgggcttttaaagggtctgaagaagtgacaggatgctgtggttgaatcgtagcatgtgttttagcatttgttcatttggagttgattatttcacgttgctttcatttgccattacctggaaagccaagggctctactctcatttccttgctgctctttctttgccttccttggtccgtgaagaagatggtccaggagaagctcattccatgcttgttaaccaggcacgcccctaagttccagtccctgagtcattcatgagtagcactgccaatgaactgacagccatgctgtgtccctccacatcccctaggtgactcgaagaagccttccaaaaagcgtgtgaaaaggaagccctactctaccaccaaggtaaagtagcctgtctttgcctaagatgtaaatgttgttttcttggatcctttatttttcagttgatatcagctatgggaaaattctccactacattataggtgttagataatatttccttggggatggaggaggtgtattttaccaactgacacctgattccagaggacgtgcaaaattggcagtgtcagatagtacactgggtgttaagggatgttttcttcaggaacaagctttccactttagataagaattctgcaattgctactcaaaaattacctagacagaaacattcttcaacaaaagctcctgtgctttcctaaggcaactctactctagagttggggcttttgacttgaaccttatttccagtcttggttacccagagtttccaagtgaacaaaagacctgtgtgagccatccatagcatagcctgattctcagagtgttttccttctctaattacaggtgacttcagggagcacattcaatggtacgtattctggaatcactcactggttgttagaaaaggattctacaggaaatctggagcttaactgctggcttttgtctggagagcctccatgatccaagacatctggtgggaatgaggatgtagggtatagtaaaagaaactggttttcctggtgacatactctttttatctatgtatagtttctgggaacatgttcacattaggttgtgtgtgggtatgtgtgtattagggcgggggtggggtgaggtggtctgtgtgcaagtctgcatgatttgcttgtgaatgtgtgtctatgtgtgtttcccctaggaaaaaaatgttgtgtttacccagcacaactctcagtgccatgtttcttaatttaacaaatcagaccacatactttacttacattagttcacacctcatcatcatcatgcccatatgttgtgagcttgtttattgagcccacatgccagatggagaaactaagccacataaataaatgtgccctggttcacttgctgcatagtgaagagtcaaaatgtttcctcatacggtgctaatgttgaaggcctgaactacaaccactatttatcagccagtgaagagatcactattcaccatgcaagggagttccagcaccctctatgcctggaattacccacgcctgcagagatcccaaacgccatccctcacataagacagcctcatgatctcataatccaggtagctatgtagacatcttcctgcaggtgtcacatagtccttagtgtgaaaccaacatagaaagcccatgtttctgatcaaatcacaggttctgaaacactaagggaggcactaagtaggacaatgtggtgcctgcgtgtcatagctgggtctcctcaagacatggatcaagtccagtaagaattggggagatgctttagagtcttgatggagttatcaccacaagccctctgagctacacactttagggatcatgaccattaagtactcaaattaccatttggttgttatccgggtatccgtcgtccttgtggcaaccctcttgtgaagctggtgtggacagcctcagtgctggagctgtgcctgccttctgagtggaccctttctgtgttagcaggtgggtacaagcgtgggggtcagcacactcagtggatttacacacacagcgttgaagagtaaggctgggcttcattatttatacattttcaataaatgatgatcttcataacataaaatcaatgatgtagtacactagaatactgtccctagtattgaatcttgtctctcagcaaagggttgcttaaagtcacgtgacagattccattcaactgatgacacatgctgtagcagcagttaaagcagtcatttgaaaaggcttttactataaacttacgtgtgagcctgaagtgggggataaaagaggcgattagctcccctgtgccatgtttctcttatgtgcgtggtggaggaaaattacacaggaaggtgatggagagaacagagcaaaggattggacaggtccattgaacccataagactatggtgaggttagtgaatgagactggtcattttaggtcaaattttacccagagctggtgcagccactgcccattcttagccagaccttattgcaggcagctctgatcaatagtcaaggaggcagtgggggttgcagacttaattcattaaatcaccaaagcaccagcccacacggccacttttccagttaattcacagtagcttgcatattcaggtttgatcagtggaagggaagttactctttgcagacccatcttttgacaatcattttgcagtgtcggaaggtctgagcagcctcgggaggcaagcagtccctggtccctcagtgtagtcactggaggagacagtcactgagaggcagctggcagggtgaagggaaaggggaggcaggccacagagatgacagcctttaagctgtcatactgggaggtcaaggatctgaaagaggaaggagaattctttatcattaaggacctgtccttatctcaggcatttcctccagagcatcacctttgtccacccacacaccttgggctaggaggactggagaaaaacagtgaggggtctcttgggtctctggcacagggcgtgatgaagaggtggcagtttttcaggaatctctctctctagggaaccaaatacatttcccatctcaggtccttcactcagcggggttgaggttctgctcgtcacttatcatctctgaatgtcagcaccctcaagtgtaaaatctcagtcacagcccctcctctgcaccccctgcagggctgatgttctccataaaccataaggcatcatgcccacggaaaagccgaacaggaaagcatgctccactgccccggagccatccaagttccccctccatattccgccactgctgagtgtccagcttattcctcctggcctgtagtaaacacttagagaacattactgaagtaccagtcctctctaaggttttcctgtatttagtgattttttagccctgtactgtgatactaagaagtagggcctaaatagggcctaaaaagtattgctaaaattacattatgacagtgcagagaactgagggcagagggaggacatgagcttgccaggtccacatggcttagtggaatttgaatccgggcccctactctgcaccagccctgcactcacagtcatcctgctgtattctcctctccaggaaggcactgcccacgcagtctgtctgatagaggtgttgagtgctcactgaactccgtgatcttcctgaaacccaactttgattcagtgggctctgcttggaagcctgtaaagaaaaggatcataagtttaaacttagaacagattatcactattttccctctggtcctctgtcagcaagatgtcaacagccctatctattgtaaatgcattaaccagcatcttctctgatagagaatataagaagatatgctgtgcacaccaaccagtgtaggagacctcatggctcccgggtaaagaagaagaggtacccacaagaaggtactgtggaagttcattaattaagttgattcaagaattgcagttgcggggagtattcagtgtcccatatgtaagaggaaactatgaagagactaagccatattttttaatgtgtcaggattctaatttgcctggtcagtaaatattgctaccaccacaaaagtaaatatctacttaaaagtcaattttggttcatgtttaatgatagacaatgtttcaagctaatgtctagaacttacctggttgttaaacataagcatagatctccctgaaagagtggtgctatattattatttttcaattaatatatttctttagagagttttaaattgacataaaaactgagcatatggccgtgtgtggtggctcacacttataatcccagcactttaggaggccaaggcaggcggatcatctgaggtcaggagttggagaccagcctggccaacatggtgaaaccccatctctactaaaaatccaaaaaaattagccgggtgtggtggcaggcgcctgtaatcccagctactcaggaggctgaggcaggagaatcgcttgaacccgggaggcagaggttgcagtgagccaagatcatgccattgcactccagcctgggtgacaagagtgaaactccatctcaaaataaataaataaataaataaataaataaataaataaataaaaattgagtatataatacacgaagttcccatattattctgtctcctcaccctcacttcctaatttcacctattagtaacatcttacattactgtggtacatttgctagaataatgagaaaatattgacacattattatctgaagtctgcatttgcataatgttcattctttctgttatacatatatatgaattttgaaatatttaaaacattatgttcacccttatggtctcataaagaaaatgttcacttccctaaaaatcctctcttctcattaatctctgtcctctttctccagaaaccttggcaactattaatatttttactatcgcttcagctttgccttttccagaatgtcatatagttggaatcatatattatgtagttttttcagatgaatttattgcactaaattgatgtacgctttagctgctttcatgtcttttttatgccttaatggcaaaaaatggcacattaaatcaccaaataatattgcattaaatgaatttttgtctttttattcacctgttgaagaattcggtagatttcatgagagaaaccatctgggcctggtgctttctttttcggaatgctcttaatgtgaattcaacttatttaatagacataagtttattcaaattaggatcctagcatgaccttgggaagattgcctttcaaggaattgatacatttcactgaggttatcaaactgcgctcatagaactgttcatgatattccttttaatgcctaacagttcagtagagatggctcctcttttatttctgaaattggtcatttgtgttatcttctttttcttggttagcctgcatatcaattcattcattgtaatgagcatatcaaagaaccagcttttggttttattgattttctgatgatttcagtgttttaattttattgatttctgtgatgttgtttattacttttacttgctttccattgcattcctctattttctatagttccctaattgaaacatgatattactgattttaggtcttgtgatttttagtatattgcatccaatgctatagatttccctctaaggactgcttttgctacatccagaaatcttgccaagtcacattttcttttaatgtagttaaaagtacttttaattttctattgagacttcttctttaacccaacagttatttaaaagtgcattgctaatttgcaaatatttggggattttgtggctcttttacagttgttgattttttgttgtcaggtgtgtgttgcaaaagcagtcgtctacctcatcttgccaccacccaagatggcccaggatgtgggctctccctgagtgaatctttggcaatctgccaacctgatgtgttcggcctccttctttagtctgagcttgccttctgcttagaaagggccattctcagttctggcagggagttttcccaacattgagaaggtggcattcttactccccactgcagcctgcacctctgaccggtggtcagcagacaggacagaggtcctcattagacagagttcagcagggtctctgaccaaagtgcatcttcagagtctgcacctacccactgtgaccacgggcaggctctgagtcctaaagcaggaggaactgtgcgaccatcctgattggaaatttgtgaggatcaccgtgttactcaagtaaggtctttggaaagtgtcgtattactactgtttgtgaactgcttgttggtggcctggctgagccacacactttatgaaaaccaggacccctcagctggtgtgggtgtctatgcagcctgagaccctcatgtgaacagcctcgtggcagctgtctttgccccttgccaccatcagtgcctccttgttcctgggcactgctttctctgatggtgctccattgttttcctgcacctcagtgtctacagctggatgtctcttccgcaatctaggcgagggggcatcaatggcagttctgctgtggcactgccctccttcttagcttgtcttgctctgtcttaggctccctcaaagatcccacccttcaggttcttccacaagtttcttattgaaatccgagcagaaaactatgaccaatatgaccaatcctatacccactgaagacatgaatgaagaattaaaacaattctccatggactctaccatatagatccctagaagtaatttctaaaaaaaaaaaaaaatcaaggaagatgtaatagttttccataaattagaataccctacatgtacaattaaatgaaatggctagtatagtcttgaaaccaaaaccagataaggtaaattaaattctgtgatattttaaaatactgtaaattctgactaatgtgagttaatctcaatatatgaaatagtagattaacattgaaaatgcaataaataaaattagctacctcaagagtttaatggaaaaaaatgtgattattgcaatagattcaggaaattcatgaataacattcaccctatatttgtaggacaactatctaactttaagtgacctgtgacaaccatttgaattaatgctgctttcacagcatatctcttggcttgttaaaaacccgacaagaatttccgtaacattaatttatttttaacacctatattgggtgtgaacccaccataaagtttgcccactgaaaaggtctacaatttgatgctttattaaattgatactgtgtgcacccatcaccacgatctaatttaaatatgtttccctcacccaagttctctcttgcgcactggcagttaatccccactcccatctccagccctaagcaatactgctgtgacattccatctccataaatttcccatttgcttaatagaaatggacatatatatatatttggaatctgacttccttcatttagcatactatgtttgaagttaattgacgtgttagcacgtgctggtcatgtgttttccttcatagtctgctgtgtttactcatacagatagtgtttattcatttatcagttaatggacatttaattgttttgttattttctttgatgagtaatgtagctttgagcattcatatacagtcatgtaatgcataatgacattttggtcaaaaaaatttttttttttctgagacccaggctggagtgcagtggcacaatctcggctcactggaacctccacctcccaggtttaagcaattctcgtgcctcaacctcccgagtagctgggacaactggcacacgccaccatgcctggataatttttgtattttcaggagagacaggattttgctgtgttggtcaggctagtctcaaactcctagcctcaggtgatccacccatctctgcctcccaaagtgctgggattataggcatgagccaccacacccagcctaatttttttaagaaagaagggaactattttctaaattacttttgccaatttatatttctaccatgatgcatagcactaatttcaccgtacaatgtatggtaggccccaatatgtaagaaatgatgaaagtaacacataaagattggtataaaacaaataagattatcattgttgctatcatctttgtcaaattctgaaaacaatctgagtatatttttatataaatatgcttggcaacatagctgaaaaacgcattatcagttacatttatcagtaacaaagacataaatttgaagggggaaaaacacttgtactaacaacgcaatgtcagaattaacataaaaattctgctggtcactttggaatatttaattgcctggggcagtgtttagtagacaaatgagcatctatggagcacccaaagtaggggaatcaacagaacttgggtttcaaaagttatctgggtttagagcgtgaaactttgttagaggacacacaccttgcatgagcgaggtgccttggtgtgtgtggacgtaccattatgcttggaggtacagcataatggtggcttcctccagaaagggacatttggggtggattcattccatctagacaacacagcctgatgtggcatggacatgaatggaggtgaaatggtcagtagttgagaggatcagtcctgacaagggccgaggtgaaaaacctgggaaccccttcaggtgcaaagtcttcagttgaaaaaggaggtggtcacaggaaatactgagacaggacagcaaagcatgggagacagagttcttggccctgcagggtgagtactgtggattctcaaattttctcctctctccattaatttctttcccaatgcagatgacttccatcatacagtcttcagcaatcttgaaagattggacaagcttcagcccactcttgaaggtaaaggaaggcagctaacaagactggcatctgggcttggctgtgcgtgttttctatcgtggggaaatatatataacacaatatttatcatttgaaccttttaaccaaagtgtgcactccatggcattcaatatattcacagggttgcataaccagcaccactatctacacccacaattttgatgatttcttacgaaaccttgtccacaataagcaatatagcaccttccccctatttccagcccatggtgattcctatcccactttctcttgtatgaatttgactattctaggcacttcatgtaattacaattatacaatatattccttttgtgtctggcttatttcactaagcataatgttctcaatgtccacccatgttgtagcatctatcaaaatgatgttcgttttttacagatggatgatgtagcattgcatgcagaccactttgcttttattacattcatttgttcactgatggttggattatttccaccttttggctcctgtgaaaagtgatgctacaaacattagtatacaaacatctgtttgatttccgttctctattctttggggtgcctaagagtagagttcctgggtccaacaggggttctatatttaaccttctgagccactgcagactgtttttcacagtggctgcaactttatccatttctaccatcaatgtatcagggttacaatttctttacgtccttcttcacacttattttcctttaaatcatcctagtaggtgtatattggtggctgcttgtgtttttcatttgcatttccctaatgactaatgatcctgagcagcttttcctgtgctactatctgtggctgtatcttctttagggaaatatatgttgaagtcttttgcccatttttaaagagttgtctgatttttatttagttagtttgttgttgtagatttttgaatatatcttaaatatatttaaaatatattctaaattttagtctcttacaagataaatgatttgcaaatatttccacctttgtgtagaactttagattcacaaacttcattaatttgtatgaaatcctcggcagttgaccccaaacagataagactgaagcagtattttaggaatagttgaaagtatgatcaccacaaaacataagcgtaatcaaatcctgcaagctacatgtaaggcacaatgacaaataaggcagcaaagggccatctggtgtttagttcaccacacttgttgcaactgtttgcgctgcagagttaaaacacaccagcattcaacccatgtctcctctcttgaagtaaactgtcgtatgttggctggcctgaacaagcgtagatattctccatcctcaattaatatgcatgcatgacaaagaaaaggaggcctggatgaaaaaatattgtgtgattaataattatgctttaattaattttaaaagatataatttcagtacttctaattctcccatcagcagttataacaaaggattagtgaataaataccatagactgttttgcctagaatcgaatccaatctgtctattaaactttgcttttattcaagtgcaaaatgctaaaacacataataactgcagtgacagccactgtggatcctcagaggtaaaagtagtcttgggacataaatcctgcaagctaatatcgtttttacagggtttagaaaaccatttagctgggtttcaaacctcacagtgtgagcagtgggactctcatcaaactatagcatgtgcttcagtaccatttgtagactgactcattcccattgccttaagttgccatcagcaaaatgccagggactctatttcttgctccttagctcctcgttcttgcctgtctttccaccagggaagattttctagcaggagctcaagctgtgcttttaatgaaacacatccacacacactgtcctgttgtccacattgagcagagctccctgaataactcatgaacaaaagcatctatgactaactgttgctctgtgtcctcttagcctctgaggagtctctagttcacaaggacagaggagatggagagaggccagtcaacgtgagggtaaggttgccttgctttctctgaaatagaaatgttcctttcttggtgtctttctttttcaactgactttacatgtgaaaaaatgacaatgtccatgacaggtattaaatgcagttttctgagggggaggaagaagtgactcttagcaactgatatgtaatccaaaatggcatttagctatgacggcttcaggttgtggactgtatccttggggtccttgtccttggaagcaatgtcttctccttggattcagtattttgcacttgccaacctacgtggacctgagagatacaccgtccagaagctgatgccttttccagtgtgtatcctacccttgttttggaggccttgaagttgactacactttctgatcaagttttcaatattcattgagagaaacacagccttgtgcaaacaatccacaacgtgacatacccctcaaaaagctttgtttctgtattgcaggtggtgcaggtggcccctctgaggcatgaatctagtaagtattctggaatcacttgccaagaaaacaatctggatgccaagaaaggtgtggcatccttgcctggtttcaatgtgaagagccaccctgatcctgggattgtgataggaataagtataggggaagtgtttttttaaaacctgaattccccagggaaaaattatggccaaattttgaggaagcagctgtgctcccttttgggtggtgctgagttgggtgcttgaggattggtggtgtcttgtgtgaggctgcatcgtgtggtgtgaatgtgtgtgtttctgtacaggtgaggctgtgtgttttctcaggagagatttcccacttatacaacccaatcaccagtgtccacttctaacaataaaatccacccccgctctactctctctgtacagtgactcctccaccctcaccagagccatccccgggtctgccttattatccccactgctcaggtggagaaactgaagggccaagggagtggccccagctcccgagttcctgaatgaaaaagtgaaaacacgaacccaggagtgtgggccagtgctgacgctgacatggcacttagtcatggggtgttcaccaccacacagggagtccaacattcatgtataagccctaaagcaccgagcccaaaaggccccagacactgcccatcatcataaagtgggctccgtggtcacacaacccaaggcagttataggctcatctccccacagacaggcatagtcatcagtgtgtcaaaagcacaaagatccccaggtgtttggctcagctcaccaatccttttttttttttttttttaacttttaagttcaggggtacatgggcaggatgtgcaggtttgctacatatataaatgtgtgtcatgagagtttgttgtacagattattgcatcacccatatattgagcctaatatcagttatttttcctgatcctccccctcctcccacctcccaccctccagtaggccccacgctcacaaattctaagaggagtgggggaccacaaaggccagtgtggcccacttcagttgtgaagttaatttgctcagcaactggccaaagtctataaggatgggtgatgtattttagtagatttagtaatactatcttcccaagccctaaaatgctcaaatcctgccagccaaaaatggtgaggagggacagataggaactctgtgtggcacttggttattagcctggcttccatcccttagtggcaactctcttgtatatgtgggttaaagaccctcagcctcaagccaagcctcctccatgaggagccatctcactattgaccggctagtgccgggtatggccaccagcccaactgaaacaaaatgttgctttaaaacacgtgtaaatctcatacatacaacaggcaaatgcagaagcagtgtggtctcgcaagttgtaaagaggacagtcgcaattttgctggacttcaacctgggtagaagacatgagggaactctgtcactgaatcacggcagagttcaaggccacttgcagactatttcatgttatagaaggtggcctttagctactaagcaaaggcctctgtttctcatttctttcctgttcatcttcttcgtcatccttcttccgcaagggaaacgagcccaagcaaaagacagtttcaatattaatttgaccgaggttttgtgcagttaattatcatccaggtaatcaggtgcaacccagtctgcctagcagcccccctatctctgctctgtgttttcatttaataaacattttggtctacttactatgtgctagattttctcgagaccaagtaaatgagatagaatctttatgttggcagctaagttagatttaacataactgacaaaaattaaaatttctgatttcttgtaaaaatattttgtatgtgtgaatgcatactgaatgtaaagtggataaaaaaaatcacacttgcactcatggaaggcttttcatgaatttgtcaatttctatttttttatatttccccatttcaccggataatacatacctgaacctggaaaatgattcccacagcagaaagtgttctgagccacatcccttagcttcactagtgcaggtccacctgggagtatgtcccaccatcagcttgacccatgctgtaatcagccacctccatgcatcacaccaagcaagcccctgggtgattcacagtctccagcaccagggcactgaccttaactctgtgttcttctagctccctatgaggacactgtacacgacatcgctaatgaggacgctgtatatgacattgctactgaggacgccatatatgacatcgctaacgaggacgccgtccagggcatcgcaaaggaggacgccgcccagggcatcgctaacgaggaagccgtccacgacatcgctaacgaggatgccgcccacgtaatcgctaacgaggacgccgcccagagcatcgctaacgaggacgcggtccacgacatcgctaacgaggatgccacccagggcatcgttaatgaggacgccgcccacaatatcgctaatgaggacgccgcccacggcgtcgctaacgaggtcgccgcccagggcgtcgctaacgaggacgccgtccactgcatcgctaacgaggtcgccgcccagggcgtccttaaagaggacgccgcccaggacatcgcaaacgaggacgccgcccagggcatcgctaacgaggacgccgcccacggcatcgcaaacgaggacgcagcccaggacatcgcaaacgaggacgccgcccaggacatcgcaaacgaggacgccgcccagggcatctctaaggaggacgccgtccagggcatcgcgaacgaggatgccgcccagggcatcgctaaggaggaccccgtccagggcgtcgctaacgaggaccccgtccagggcgtcaataacgaggacgccgtccagggcatcgctaaggaggaccccgtccagggcgtcgctaacgaggaccccgtccagggcgtcgctaacgaggacgccgtccagggcatcgctaacgaggacgccgtccacggcgtcgctaaagaggtcgccgcccacggcgtcgctaacgaggatgccgcccacgcgatcgctaagccggacgccgcccgcggcatcgctaacgaggttgccgcccagggcatcgctaccgaggacgtcgccgacggcatcgctaacgaggacgccgcccacggcgtcgctaacgaggtcgccgcccagggcgtcgctaacgaggacgccgtcgagggcgtcgctaacgaggacgccgcccagggcgtcgctaaagaggtcaccgcccacggcgtcgctaacgaggacgccgtccagggtgtcgttaacgaggacgccctccacggcgtcgtcgctaacgaggatgccgcccaagcgatcgctaagccggacgccgcccatggcatcgctaacgaggtcaccgcgcagggcatcgctaacgaggtcgccatccacagcatcgctatcgaggacaccacaccgtccagggcgtggctaacgaggtcgctgcccagggcatcgctaccgaggatgtcgccgacggcatcgctgaggacgccgcccatggcatcactaacaaggaggccgcccaggccatcgctaagcaggatgccgcccacggcatcactaacgaggacgccgtccagggcgtcgctaacgaggtcgccgcccagggcgtcgctaacgaggacgccgcccacggcgtcgctaacgaggtcgccgcccacggcgtcgctaacgaggacgccgcccagggcgtcgctaacgaggtcgccgcccagggcgtcgctaacgaggacgccgcccagggcgtcgctaacgaggacgccgtccagggcgtcgctaacgaggtcgaagtccagggcatcgcacacaaggacgccatccagggcatcgctaacgaggatgccgcccacggcatcgctaacgaggtcgccgcccacggcatcgcaaacgaggacgctgcccagggcatcgcgaacgaggacgccgcccagggcatcgctaacgaggtcgccgcccacggcatctctaaggaggacaccgtccagggcatcgcgaacgaggacgccgcccagggcatcgctaaagagaaccccgtccagggcgtcgctaacgaggaccctgtccagggcgtcgctaacgaggttgaagtccagggcgtcgcacacgaggacgccgtccagggcatcgctaacgaggacgccgcccacggcatcgcgaacgaggtcgctgcccagggcatcgcgaacgaggacgccgcccaggacatcgcaaaggaggatgccgcccaggacatcgcaaacgaggacgccgcccagggcatctctaaggaggacgccgtccagggcatcgcgaacgaggacgccgcccagggcatcgctaaggaggaccccgtccagggcgtcgctaacgaggacgccgtccagggcgtcgctaacgaggttgaagtccagggcgtcgcacacgaggacgccgtccagggcatcgctaacgaggacgccgcccacggcatcactaacgaggtcgccgcccacggcatcgcgaacgaggacgccgcccagggcatagcacatgaggatgccgtccagggcatcgctaacgaggacgccgtccacggcgtcgctaaagaggtcgccgcccacggcgtcgctaacgaggatgccgcccacgcgatcgctaagccggatgccgcccacggcatcgctaacgaggtcgccacccagggcatcgctaccgaggatgtcgccgacggcatcgctaatgaggacgccgcccacggcgtcgctaaagaggtcaccgcccacggcgtcgctaacgaggacgccgtccagggcgtcgttaacgaggacgccctccacggcgtcgtcgctaacgaggatgccgcccaagcgatcgctaagccggacgccgcccatggcatcgctaacgaggtcgccgcccacggcatcgcgaacgaggacgccgcccagggcatcgctaacgaggtcgccgcccacggcatctctaaggaggacgctgtccagggcatcgcgaacgaggacgccgcccagggcatcgcgaacgaggacgccgcccagggcatcgcacacgaggacgccgtccagggcatcgctaacgaggacgccgtccacggcgtcgctaaagaggtcgccgcccacggcgtcgctaacaaggatgccgcccacgcgatcgctaagccggacgccgcccgcggcatcgctaacgaggttgccgcccagggcatcgctaccgaggatgtcgccgacggcatcgctaacaaggacgccgtccacggcgtcgctaacgaggtcgccgcccacggcgtcgctaacgaggatgccgcccacgcgatcgctaagccggatgccgcccacggcatcgctaacgaggtcgccacccagggcatcgctaccgaggatgtcgccgacggcatcgctaacgaggacgccgcccacggcgtcgctaacgaggtcgccgcccacggcgtcgctatcgaggacgccgtccagggcgtcgctaacgaggacgccgtccacggcgtcgctaacgaggacgccgcccagggcgtcgctaaagaggtcaccgcccacggcgtcgctaacgaggacgccgtccagggcgtcgttaatgaggacgccctccacagcgtcttcgctaacgaggatgccgcccaagcgatcgctaagccggacgccgcccatggcatcgctaacgaggtcgccgcccacggcatcgggaacgaggacgctgcccagggcatcgcgaacgaggacgccgcccagggcatcgctaacgaggtcgccgcccacggcatctctaaggaggacgccgtccagggcatcgcgaacgaggacgccgcccagggcatcgcgaacgaggacgccgcccagggcatcgcacacgaggacgccgtccagggcattgctaacgaggacgccgtccacggcgtcgctaaagaggtcgccgcccacggcgtcgctaacgaggaccctgtccagggcgtcgctaacgaggacgtcgtccagggcgtcgctaacgaggttgaagtccagggcatcgcacacgaggacgccgtccagggcatcgctaacgaggacgccgcccacggcatcgctaacgaggtcgccgcccacggcgtcgcgaacgaggacgccgcccagggcgtcgctaacgaggacgccgcccagggcgtcgctaacgaggacgccgtccacggcgtcgctaacgaggacgccgcccagggcgtcgctaaagaggtcaccgcccacggcgtcactaacgaggacgccgtccagggcgtcgttaaccaggaggccctccatggcgtcgtcgctaacgaggatgccgcccaagcgatcgctaagccggacagcgcccatggcatcgctaacgaggtcgccgcccagggcatcgctaacgaggtcgccgtccacagcatcgctatcgaggacaccacaccgtccagggcgtggctaacgaggtcgctgcccagggcatcgctaccgaggatgtcgccgacggcatcgctgaggacgccgcccatggcatcactaacgaggaggccgcccaggccatcgctaagcaggatgccgcccacagcatcactaacgaggatgccgtccagggcgtcgctaacgaggacgccgcccacggcgtcgctaacgaggacgccgcccagggcatcgctaacgaggtcgccacccatggcatctctaaggaggacgccgtccagggcatcgcgaacgaggacgccgcccagggcatcgcgaacgaggacgccgcccagggcatcgcacacgaggacgccgtccagggcattgctaacgaggacgccgtccacggcgtcgctaaagaggttgccgcccacggcgtcgctaacgaggaccccgtccagggcgtcgctaacgaggacgccgtccagggcgtcgctaacgaggttgaagtccagggtgtcgcacacgaggacgccgtccagggcatcgctaacgaggacgccgcccacggcatcgctaacgaggtcgctgcccatggcatcgcgaacgaggatgccgcccagggcatcgcgaacgaggacgccgcccagggcatcgcacacgaggacgccgtccagggcatcgctaacgaggacgccgtccacggcatcgctaaagaggtcgccgcccacggcgtcgctaacgaggatgccgcccacgcgatcgctaagccggacgccgcccgcggcatcgctaacgaggtcgccacccagggcatcgctacccaggatgtcgccgacggcatcgctaacgaggacgccgcccacggcgtcgctaacgaggtcgccgcccacggcatcgctaacgaggtcgccgtccactgcgtcgctatcgaggacgccgcccagggcgtcgctaaagaggtcaccgcccacggcgtcgctaacgaggacgccgtccagggcgtcgttaacgagtacgccctccacagcgtcgtcgctaacgaggatgccgcccaagcaatcgctaagccggacgccgcccatggcatcgctaacgaggtcgccgcccacagcatcgcgaacgaggacgctgcccagggcatcgcgaacgaggacgccgcccagggcatcgctaacgaggtcgccgcccacggcatctctaaggaggacgccgtccagggcatcgcgaacgaggacgccgcccagggcatcgcgaacgaggacgccgcccagggcatcgcacacgaggacgccgtccagggcattgctaacgaggacgccgtccacggcgtcgctaaagaggtcgccgcccacggcgtcgctaacgaggaccccgtccagggcgtcgctaacgaggacgccgtccagggcgtcgctaacgaggttgaagtccagggcgtcgcacacgaggacgccgtccagggcatcgctaacgaggacgccgcccacggcatcactaacgaggtcgccgcccacggcatcgcgaacgaggacgccgcccagggcatcgcgaacgaggacgccgcccagggcatcgcacacgaggacgccgtccagggcatcgctaacgaggacgccgtccacagcgtcgctaaagaggtcgccgcccatggcgtcgctaacgaggatgccgcccacgcgatcgctaagccggacgccgcccgcggcatcgctaacgaggttgccgcccagggcatcgctaccgaggatgtcgccgacggcatcgctaacgaggacgccgcccacggcgtcgctaacgaggtcgccgcccacggcatctctaaggaggacgccgtccagggcatcgcgaacgaggacgccgcccagggcatcgctaaggaggaccccatccagggcgtcgctaacgaggttgaagtccagggcgtcgcacacgaggacgccgtccagggcatcgctaacgaggacgccgcccacggcatcgccaacgaggacgctgcccagggcatcgcgaacgaggacgccgcccaggacatcgcaaacgaggacgccgcccagggcatcgctaaggaggaccccgtccagggcgtcgctaacgaggaccccgtccagggcgtcgctaacgaggacgccgtccagggcgtcgctaacgaggttgaagtccagggcgtcgcacacgaggacgccgtccagggcatcgctaacgaggacgccgcccacggcatcgctaacgaggtcgccgcccacggcatcgcgaacgaggacgccgcccagggcatcgcgaacgaggacgccgcccagggcattgcacacgaggacgccgtccagggcatcgctaacgaggacgccgtccacggcgtcgctaaagaggtcgccgcccacggcgtcgctaacgaggatgccgcccacgcgatcgctaagccggacgccgcccgcggcatcgctaacgaggtcgccgcccagggcatcgctaccgaggatgtcgccgacggcatcgctaacgaggacgccgcccacggcgtcgctaacgaggatgccgcccaagcgatcgctaagccggacgccgcccatggcatcgctaatgaggtcgccgcccagggcatcgctaacgaggtcgccgtccacagcatcgctatcgaggacaccacaccgtccagggcgtggctaacgaagtcgctgcccagggcattgctaccgaggatgtcgccgacggcatcgctgaggacgccgtccagggcatcactaacgaggaggccgcccaggccatcgctaagcaggacgccgcccacggcatcactaacgaggacgccgcccagggcgtcactaacgaggtcgccgcccagggcgtcgctaacgaggacgccgcccacggcgtcgctaacgaggtcgccgcccacggcgtcgctaacgaggacgccgcccagggcgtcgctaacgaggtcgccgcccagggcgtcgctaacgaggacgccgtccacggcgtcgctaacgaggacgccgtccagggcgtcgctaacgaggtcgaagtccagggcatcgcacacaaggacgccatccagggcatcgctaacgaggacgccgcccagggcgtcgctaacgaggacgccgcccagggcgtcgctaacgaggtcgccgcccacggcgtcgctaacgaggatgccgcccacggcgtcgctaacgaggtcgccgcccagggcgtcgctaacgaggacgccgcccagggcgtcgctaacgaggtcgccgtccacggcgtcgctaacgaggacgccgcccggcacatggctaaggaggacgccgcccaggacatcgctaacgaggacgccgcccacggcatcgctaacgaggacgccgtacacggcatcgctaacgaggactccgtatacggcatcgctaatgaggatgccgtatatgacatcgctaatgacaccgtacaaggcacgctaacgaggacactgtacaggacatcgctaatgaggacaccatacaaggcatcggtaatgaggacgctgtatacgacatcgctaacgaggacaccctacaagccgtcgctaacaaggacactgtacacaacatcgctaatgagggcaccatacaagacatcaccaatgagggcgctttatacgacattgctaatgataccgacaaggcacgctaacgcggacactgtacacgacatcgctaatgaggacaccgtataagacatcgctagtaactatcgcaagaacaaaaaaccaaacactgcatattctcactcataggtgggaattgaacaatgagatcacatggacacaggaaggggaatatcacactctggggactgttgtggggtgggggggggagggatagcatcgggagatatacctaatgctagatgacgagttagtgcgtgcagcacaccagcatggcacatgtatacatatgtaactagcctgcacaatgtgcacatgtaccctaaaacttaaagtataataaaaaaaaaaagacattgctagtgagcacactgtatacgacatcgctaatgaggatgctatatatgacatcgctgatgaggacgttgtacacgacatcactaatgaggacaccatacagatggcttgagcccagtagtttgagacaagcctggcaacacagcgagacctcatctctacaaacattttttaaaaatatgccaagcattgtggcgcatgcctgtagtcctggctattcaggaggctgaggtgggaggatcacctgtgcccaggagttcaaggctgcagtgagctatgatcacaccacaatgctccagcctgggcaacaaagcaagactccatctctaaaaataaaattaaattaaaaaaaaagatcttcgatgtaaaagaggtatgctcaaatgcaataaaatcatataagaaggccgggtgtggtggctcatgcctgtaatcccagcactttgggaggctgaggcaggtggatcatgaggtcaagagactgagaccatcctggccaacatcgtgaaacaccgtctctactaaaaatacaaaaaacaatcagctgggcgtggtggcacacacctgtagtcccagctattcaggaggctgaggcaggagaatcgcttgaacctgggaggcggaggttgcagtgagccaagattgtgccactgcactccagcccggcaacagagcgagactccgtcaaaaaaaagaaaaaaagaaaaccatacaagaagcccctacgaatctgggtgaatcagcaaaggcttcacaggataggaaaaggccatgagtatgaaaacatgagtggggggttggcctagatggtaaacgaggagaggacaatacggccaggaagtgcatgtgcacagcagacgggagatggagggcacggctgattggcagctacctgtactttaatattcctggagtgtgacgtgtgaggcaaacatggggtggtggggtgagtgctggagatgaggcagacagtgagccatcagcatgttagtaacaggggaatccatgggcgtttcatgcagctccaaggaccctatgtgagctcatcagactccaattacccaaatctgtttcttaccagtggtagttaggatttccgtaggtacactggatgtcttcccaggacacctggaagccagaaacaaatggggtcaagcagccagctgacacaagcacccacagaggacaggacactataatgtgcccctcatcctccagacaagcccacccctagcaactcccaagagcctggagcaacagcagcaggatgtcttgtgcagtgaagtatgtttagcgcccttgtccctgtgtttaaacttggtcatgcttttcccagaggcctaacttacatatttctaactctccttgctctctagacatttcccacaaagcaggaagctgcagagcatgagcctagagcaccaaaaacttagaagtgaagtgaattgaacccttgcagaggtgcaaaccacatggggacttcagaccgaaaaaggcttgaaccctcatcaaaggccccacacccagacagcaggatcacagtgtgtcttgatctcagagacccaggcagccctgagcccagcatttgctagaggtggccaatccagggcaggaggcaattgtggatgatgtttcttaccaagcaaatattggagtcattgaagcagaaccattttccatccacagcattccggatgtagacacagtaatgaccggagtctgccattcccacgtgcgcaatcacagcaaaaagctcatactgccctccagactggaaagagacaggcacgagacagttcacccaccaccacaaacacgactgcctcacacatttatacctgtccacccgaggcccgactctgggactttagaatattagaaaacagtcctgacccacggccagtgggcaccctccaggaggggctttcctgagtgtggatcctgaactgtgaaggctcagcagcttggcagggcagagcacacaagagatggaaggcatgaggtcatgagagaggcccccaaagccaaggcaagattagaactttcccctgggaggggtggggatcatcagaacacagttctgcttctccacaagcccaggaatgaccctaacctgagccaccgtacccagccaaaaaagtcttttgtagggggaggggagacagagggcaagggcggcacacgcaaagctgagtcacccacagtggaggctgaaattatccctatttccatttgcagactttgtgcagaactttacaaaatgcagggcaatatctgtatctaaatattagtttacaagaaataaaagggttatagatgatgttaaaagatatcaaccagccagtgctggcatatgaaaaaaatattcaaccaaatcaactgcaaggaaaagaaaaggagcggaaatctaaaaggaacttaagaaaagaaagaaacttaaccaaatgcaagtgtaggcgttgtttggatctagagtcaaacaaaccacatagattacacaacagtcaggaagtctgaacgttaaccagatatttgatgctattaaggaattgcaagatggagatgattatcttttaagtgcttattctttagtgatacataatgaagtgtttataaatgaaatagtatgatgtctgggatttgcttcaaaaaaatccagtacagggttgggtgaaacaagagggtgggttataggaaaagcaagacctgccatgcgttttggtaactgttacagccaaggattcactgtctaactcttccttcactacacactttggtatctatttgtaatgttccataacaaagtcttttttgttgttgttgcaaagatggagtcttgctttgttgtccagctgggctcgactcctggactccagcaatcctcttggccccgcaaagagctgggattacaggtgtgacccactgcatccagccaaaaaagtcttttttaagtgaaaaacaattttaaatgtacttcatcgggtagaatctgcaggtagaaataaaaagaactagaaggaaagaaaaagagaatcctatgaaatgtatacggcctaagtagggaaagaaatcatgttataataggagctattgtaacgtattatcaggtcttaattttctaaatgtcatggttctagagcataaatagccaaacagaccaataaaacagaagagacactccaaaaatagacccgtacatatagaaatacaaaatttgttatgtagcatttcaaatctatggaaaaaaagatatttgggtcctttttttttttttttttttttttttttaagtttttcttgttttgtttttagagacggggtcttgcgctgtcacccaggctggagtacaatgatagatcatagctcactgcagcctcaaactcctgggctcaagtgatcctccaactcagcctcccaagtagctgggactaaaggtttgtgctaccacacccagctaattttttttttttttttgagagacgggggtctcattatgttgctgaagctggtctcgaactcctgggctcaagcaatcctcctgcctcagccttttgaggtgtgggatcacaggcatgagccacatcacctggccttgtgtctctttttttctcagaatctcttgataagttattatctcaggacaagtgaattaaactttactctgattaaatgtggtccagtcaactggctactttatgattatcctcaaagtgggcacaggccatctgaggaagaaagtttggttggtactatgaacccacaatgacatgtttgcctatgcatttctatgtattccacattatttccaaagaagcctactgaattctggattctgtccctcagtgctgtgaggcatatgaacacaaatccaatatttagaaagaagaaaggcttttgaggctggggacagtctctgaggaacaggtggctcctagcagactgggggtgaaggaagggaaaacagaaaggacatggcatctggggagaggcaggatggcaaggaggtcgggatcatcccacctgctcctcagcatcacaagactctcgcttcattggaaggatctggctgaaatccaagctctgggggaagtacagggagtggcagatctttctcgtctgtgaattcctgatggagaatcgcatgaggtggattgtcagggtctggggcaaatgggtcagcttcaagacctgaaaaatcaaaatcactctggagatgaagtccacttggaatgagagagtcagagaaatgtcagggctagcaacgcgttcttcccaaaaagaggggagcagggcgacatcatggagttcaaggctcctgttcactgaatctgctgagctcctctgagaataatgcaaaacttggctattctaccaccatgtggccccccacaagaggcacaagggcacagggctctgcacaggtaccaggacccagggagccaccacgtctgctccagggagctggtctcgccccgagggaaatgccctgcccgctgctctcaggccccctcctgcagtccctctcagtgatgcgacatgagaagccacatccacggctccagatatcagaaccacagcgtcccagatactagccagacccagattccctttctcacccatcatgggatgtcctcggggcctctgatgattctatcaggaaatccacggggggcaaccccagactagtgaaggacagatgacccctgaacagcacaggtttggactgtatgggtccgcttatacacaaattgttgtaaataaatacagtctgccctcccccataggcacgagttccacatctgcaaccaaatgctcatcaaaaataaagtatcccagatgcacaaccgcatagatgagggactgacttttcctatacgtgggttccacagggccgactgggtgtgacttgagtgtgtgtggattttggtaaaagcaggggtcctggaacaaatcccccatatgcaccgagggacagctgagtctgatttagggaatgagtacctgtttcccacgggtcttcttcccacagttctcacagaagcatttgcttttgcttgataactccctgggctggaagaagcagtgcagggcgtcctcctgtcccacccaagagaacagggaaaaagcagcgttggtatttcccacctagaatactatattcgtctgttctcacactgctgtgagacaatagctgagactgggtaatttataagaaaagaagtttgattggcccatggttctgcaggccgaccggaagcatggcagcatctgcttctagggaggccgcaggaagctcccaatcatggcggaaggccaagcaggagcaggcgtcttacctgggaggagcaggtgcaagagaccaagtggggagctggagtgcaggagcgcgatctcagctcaccgcaacctccacctcccgggttcaagcgattctcctgcctcagcctcctaagtagctgggactacaggctgcaccaccacgcccagctaattttttatgtttttagtagagacagggttttaccatgttggccaggctggtctcaaattcctgacctcaggtgatccacccacctcagcctcccaaagtgctgggattatgggcgtgagttaccacacccagcctggctccacacttttaaacaaccagatctcatgagaactcactgtcacaaagacagtaccacgggggatggtgccaaaccattcacgagaaacactcccccatgatccaatctccttccaccaggctttacctccaacactggggattacaattgaacaggagatttttgggcagggtcacagacccaaactgtatcaggtacagcctccccacactttgcagctgagggtttcagcttttcttctggttctcctcatatcccccttaatgcctggcctggtgtggtccacttggcaggatctcaaagggcacctactgactggaggaacaaaacaggagggggctcctattaagggagcagtatgagggaagtggaggtaggagggaaaaacatttttgccaaaacaaaggagaaattggccagcgccgtgaaaatgaaataagtgactttccagaagccagagatagatcaaagaggcaagggggaattggccacactgtgctgtgtggtgtgatggtttgagggtttgtcctccccaaaacccaggttgaaactgaatccccagtgtggctgtatggaaaggtggggactttgagagataattggggagggcaaggtgtctcatgcctgtaatcccaaggaggctgaggcagggggatcacttgaagtcaggagtttcagatcagcctggccaacatggtgaaaccccatctctactaaaaatacagaaattagccgggcatggtggtgggcacctgtaatctcagctacttgggaggctgaggcaggagaatcgcttaacaccggaggcggaggttgcagtgagctgagattgtgccactgcacttcagtctgggtgacagaggaagaatctgtctccaaaataaaaggtaggggggttattgcgtcatgagggcacagccctcataaatgaattaatccactcatggattaatgggttaatcggttatcctgggagtgggactggtggcttcatatgaagaggaagagagacttgagccggcacattagcatgctcagccccctcgccatgtgatgccctgcactgcctcgcctcaggactctgagagtccccaccagcaagcaggtcctcaccaggtgcagcccctcaaccttgacttcccagcctccagaactgtaagaaataaattacctagtctcagatattgagttataacaacagaaaatggactaacacatacaggtgcagcaaataccaagagaatccccttaccagtgtcttcaggggctttgagtccacatcaaaaaaagaaagtcggagggtgagcatgctgctgtttctgctactctccatggcacagtcaaggcaaatcaaggagtccttcatccggatcatatacagggcctgcagtctctccacctgcaagagggagagcggagaggtgagatgggaacaccaccataagccaggtcaggccaactgccagaaggtggagccaagagacagaagctcctcacaaaggtgcaaaataataccagtaacaatattatgaaactgtgataagtgttttatgtggattaactcttttttttttttttttgagacagagtctcgctctgtcacccaggctggagtgcagtggcgcgatctcggctcactgcaagctccacttcccgggttcacgccattctcccacctcagcctcccgagtagctgggactacaggcgcccgccaccacgcccggctaattttttggtatttttagtagagacagggtttcaccgtgttagccaggatggtctcgatctcctgacctcgtgatctgcctgcctcagcctcccaaagtgctgggattacaggggattaactcttttattcctctacacactacgggaacaacagctgaatgaatgaaatgagcagcatcttaagcttccgagtgctctggttctaggttcttaccaagtgcacatcagcgatctggtccttaatcaggttccagagtttgaggtacagttgggcagcatcatgttggacaaacactggccacagagaaaaggaacagccaattagtgaggtcttcagagtcacttctcatgccctggtacttagacacacatgaacactgatcactttgtctcttcctagccctccaccccactgcaaggctaagtcggcacgacagaagaagtgatcaataaacaaacagtaagtttggtattgatttttgagaacgcctcttaatacttaagctccagtgccagatgtagtggctcatgcctataatcttaacacttcgggaggccaaggtgggaggatcgcttgaactcaggagtttgagaccagcctgggcaacatagcaagactccgtctcgataaaaaatttaaaaaagtacttgagagtagcggtgcacgcctgtagtcagagctacttgggaggctgaagcaggaggatcactggagcccaggatgttgaggctacagtgagctgtgatgtcaccactgcactcagcctggggaatgagatgtccacagggactttgaaaagcactgatacattcctgaggatctagaaggccaggcgcatgcccaagtaagacctgagagggctccgatccctcccctctggctgaccacaaggccacatgcaagaaagcaatgaaggcgaatacagaatcatgaactgcccagaaacgataaaacagcaacaacaacaaaccctgctgtggggatctctgatgtccagtgttgccaccttacattatctaaaatgttcattttccaacaaaagagacaagacctacaatgaaacagaaaagcatggccacccaggaaaacagcaatcgtagaaccttccactgagaagccctagatgttggcgttactaaacaaagactttagccgttataatatgttcaaagaactaaagaaaaccatgtcaaaagatgtaaaagaaagtgtgaaaatgctgcctcaccaaataaaaagtatcaataaagaaaaaactataaaagaagaaccaagcagaaattcttgagttgaggagaaccataactgaaatgaaaaatgtactagaggaggtcaatagcagattagagctggcaaaagaaagaatccataaacctggagctaggttggttgaggttctccagactgaggacggaaggaaagctgaacacagtacctatgcagcgaaaagctgaggagctgctcactgcgtgtagagctcaactaactctgatacaaaaaaaaatgtgatacaaaaggttttatacacaaacgtgaacttattctgaagccagcctggggcaaggagcaagacacatcctgccttttaatgtgccatttctcctttggaggagagaggggcattttcataaggtgtgttgtgggggtggggggagtgagcaatggcggttttctaccgggcagttatcaagttcccagcagctgagttggcgcctttccgggcagaaaagtggccgagtgggcatgctttctccatgccttcctagtgggtgaaagacaaacccctagagggtggaagtttcgaagccaccccctggcagggagagttccctggtgggtatgctttgggctgcaaatctactgccaagtctcaggaaagatcagctggaagatcttgccctgttctcaatcaaacctccatcagcctacctccatttacagattcttccttttgcccagcagggaatgtctggagaggggtaggcgaaaggtgatatttgcatttctaaagggctaacaggaaacaggaaacacggccgcggtgaggggtgagggatgggaagaggagaagtgaaaagaaagtaataagaaaactaatataactatctcttagaaaatgggagtactcagttacacccagatgggttcactagtgaacgatgggttctaccaaacatttatgggaaaaattataccaattccctacaacctcttccagaggacaaaagcagagagaacacttcctaactcattctctgaggccagcattatcctaacaccaaaaccagacagacattgtaagaaaaaaacctaaaaaccagtatctcccgtgaacataaatgcaaaattcctcaacaaaatattagtgaatcaaattcaactatgtataaaaagaatcacagagggtgacacaagcgagatggtagagaaggaggctcctggtgctccccttctcccatggacacacggtaaaactctcatctacacacagatcaactccctctgaaagaaacccagaaaccagctgagagaggcctgcacagggggcaatggggagaacacccacatcgcaaccggttggaaaagctgagacacactcgaaccacaagccccaccccagacacagtaccttactgtgaggaaggaatccctactcccagctttctcctggagaggggagggtttggaccacacataggcagccccagcttttgcagttcccactcaagggcttggctgctgggtcacctagctctgggagcagacatgggttagcagttatgaatcctctgcgaccacagaggacaaagaggcagttttaaacgggcacgtgagcacttccagcagctgtgctcagcacagagcaaacaggcagaaatgccaggctcccagttcctccctggaaggatatgtctgcgggctctcctagctgttgcccgagggatgggcttctattaataactggcctgcacctggagccaatgaggcaggtaaacaatagatttccaggagtctggacaggcctgtgggcaagtcccatgccttctcccaccccctgctgtatggtaaaatcaggtctctaacttcacacattgagtacacatttacccctctcaaatgaaggtctagctcctcaaccaccgagctttgggagctgacaaggctctgtatttgtaagtcccacaggggcacagagaccaaagaacatccccccaggcccagtgcagcgtgaacaggcaaaaaggcccggctcctactttctccctagaaggagtttgtctgcacagtgcagctgctgccctggggtttctatgcatctgggagctgacagagcaggaaaccagtgctcctctgagaccctgaacaggcaggtgagcacctccacagctgctcccactggtttgctcaacagatagcgtcaagcttccaactaacctgtccgtctctaagcagagaacagccagcatttgctaggcccctgggggtgacaaagagtaaaacaatgcatgaaggagtgtgcagtttaaacttgagtgcaggcacttgccacagatcctctctccagcattttgcagagcgagtggcagataaactcatgctcccagcttttccctgaggatagaataaactggaacacacatttaatgccccaacgtctccagctgcacctcaaggggctggtttctatctcccctgtctggggcactgacaggacatgacacattctaatctcctgagggccgctaagaacatagatgacagtttggacaacacaaaaggtcaagaggtgctccgagtgtctggcagggctaattggtaagttcgtctcttatacaaggcccgtgggacaagactgggagaggtatttttcttttttttttttgagacggagtctcgctctgtggcccaggctggagtgcagtggttcgatctcggctcactgcaaactccacctcccaggttcacgccattctcctgcctcagcctcccaagtagctgggactacaggcacccgccaccacgcccagctaattttttgtatttttagtagagacagggtttcaccgtgttagccaggatggtctccatctcctgacctcatgatctacccgcctcagcctcccaaagtgctgggattacaggtgtgagccatgatgcccagcctgggagaggtatttttcttaactaaagtacagaaaataacagagaatcaagaacaatgaagaaacagagaaatctgttccaagcaaaagaacaagataaatctccagaaaatgcccccggtgaaatgaagataagtgacttaccttacagacaattcaaaataatgatcatgaagatgcttaccatgtctaggacagcaatgcatgaacaaagtaagaatttcagcaaagagacagaaaaaagttcaaaagaaataatagagctgaagaatacaataactgaaataagagctcaaaagagaagctcaacagactaaatcaagcagaagaaaggattagcaaactagaagataggtcactggaaatcattcagaggagcaaaaatgaaaaagaatgaaaaagagtgaagatatcttaagagagttaggggacatcaagccgaccaaaataggcattatcagagtcccagaaggaggagagtgagaagagatggaaagcttatccaaagaaataacagtcacgagttgcagatcaacatttcagtcaatggcagaccgcatgagcacagtggccatagcatgcagcctagctgtgtagtaggctgtcccatctaagtttgtgtaagtgcactccatgatgtccacacaatgacaaattcaccttctgatgcattttcagaacgtatccctgttggtaagcaacgcatacctataatgactgaaaacttcccaacccagggaaggaaatacaaatccacatccaggaagcccaaaggacaccaataagactgatctaaagcaacccacatcaagacacatcataatcaatttcaaaagttaaagacaaagaattctgaaagcagcaagagaaaagcaatgtattatacacaagggaaaacccgtaagtgtaggatttcttctgggggtgatgaaaatgttatgaaattagattgtgatgatggaggcacaactctgtgaatacactacaaacctttgaattgtatgtttttaaatggatgaattttacagtatgtgatgcacatcccaatatagctatctaaaaaaaaaacctgacctatttgtgaattattttgtagaacatgttttctcttttttattcctttattctgttttcctgcagttccctaactgtggtggaataagcttggaggagatgccttcacctactctactgagaggcagagaaaggttaggtatggaagtaaaatgtccataaataatatcaattctgcacctccaaagatgtgtgcctcttacacaaatgtctctataatctgaggggtccaggctacctaacttgcttcttgttgcttcactgcccattagttcctctcttcactctctaagcttcccatcccctttggatcagcagccaggaacccagtgggagggtatcttacggggcacgttgtacttctgcaggcagtaggccagctccaggggccacactgctttctgccggctgtcctgcatcttctccagcagcagaagcatctggaaagggacgcttctcctctgctcgtcagctcccctgggcaccgtgatcctgccacacaagaacagccagaaacctccttacatgtagttctcaaagctaggtgcacactggaatcacctgggagaaattttaaatcttcatatccaggccactcccatacaaattaaaccagaattctgggtccggggggcggggcgcgggcagttatcagaatttttcagttcctcagattatttcaatgtgtggtcaaggttgagaagcaccatgtgagtgaatctgctctacaggggaccctctagagagggggatcagcatgactgctgccttggcccctctgcaccctgcccagcaatcgtgctagagcagacggcagatgcacgaggtcctggctccacatctcgggcaagcagcaaaatgtccagcctaaagctctccagactgcagaggcacatgctgggttaggtcctgggaagaaaggcaacatgaaaggctgtccgtgtggtttggcaatgattcatttaatcacaggcatttttcggatgggaaaaaggagagagcacagggcagaaaaggagtgatagagagagacagagggagagagtgcattgtgtgagtgttggtggaaggaggggtgtgtactccccactgacttactccttctccgactttggtctagtcccaactctgtcttttaaccaagtcagtggctgtcaatcctggctgcatttaaaatcacccaaagagggcttttaaaaagtaccaatacctggccgggcccagtggctcatgcctgtaatcacagaactttgggaagctgaggcgggcagatcacctgaggtcaggagattgagaccagcctggccaacatggtgaaaactcgtatctactaaacatacaaaaattatccaggtgtggtggcgggcgcctgtaatcccagctacttgagaggctgaggcaggagaatcccttgaacctgggaggcggaggttccactgagccgagattgcaccatccctctccagcctggggacagagtgaggctttagctcaaaaaaaaaaaaaaaaaagtaccaatacctgggccgcaccccagaccaacctaagaagttttagaaataatgtgtaggccagaatatgcagaagccgatctttcctctgccagcttttgagagaagatctcaaaaagtccaagtcactgtgaataactgaatatattaaaaatgaaataatacaggccgggtgcagtggctcacgcctgtaattccagcactttgggaggctgaggtgggtggatcacgaggtcaggagatcaagaccatcctggctaacacggtgaaaccccgtctctactaaaaatacaaaaaaaattagccaggcatggtggcgggctagtcccagctactcgggaggctgaagcaggagaatcgcttgaacccggggggcagagcttgcagtgagccaagatcgcgccactgccctccagcctgggcaacagagcaagactccatctcaaaaaaaaagaaaaagaaataatacaaacgcttatcagcctgaagaacagtcttacctcttcaatatcctggcgaagtccacattcattacaaacacctgaatcaaggagttaaggcagcaggtctgtccaatgttgtgtaaaccaaccaggcctataaggggaagagaaaaaaatgctgagggcaaggcctaggtaaagaagttgacaaggctgggcatggtggctcacgcctgcaattccagtactttgggaggccgaggtgggcggatcacctgaggtcgggagttcgagaccagcctggccaacatggtaaaacgtgtctctacaaaaaaatccaaaaatcagccgggtgcggtggctcacgcctgtaatcccagcactttgggaggccaaggcaggtggatcacctgaggtcgggagttcgagaccagcctgatcaacatggtgaaaccccgtctctactaaaaaatacaaaactagctgggcatggtggcacatgcctgtaatcccagctactcgggaggctgaggtaggagaatcatttgaaaccaggaggtgaaggttgtggtgagccgagatcacaccattgcactcctttctgggcaacaatagtgaaactccatcaaaaaaaaaaagaagaagagaacttacagcagggtgtggcgtttcacacctgtaatcctagcactttgaaaggccaaggtgggcagatcacctgaggtcaggagttcaagaccagcctgggcaacagggcaaaaccctgtctctactaaaaatacaaaagctagccaggcatggtggcaggtgtctataatcccagcttcttgggaggctaaggcagaagaatcattggacctaatttattgatttttttgaacttggaatatggtgtcatgacaaaatcatgccactgcactcaatcctggatgacagagcaagactctgtctcaaaaaaaaaaaggttactttttatttcctgaaaagcttgacttcctgacaatgaaagtcctaaggagcgagtggcagaagacagctggcagctggcagtcattggtggggcaaaggcagagataccactgctgactctactgggcctcgggcctcagcgctcatgggaagggaccctctttcaagcttttggaggggtaagggagggccaggtaacagtgcctacatcttaggcaccgaaaacaactggagctgcttcatgcagtcaagaatcccctgaagaaggaaggcagttacctccctattctccagatctcttcagctggcctggctctcatcctttccaagacctggctgtttgctttgcatttagttatatgagctaattcatatgcttctaataaatgcctttcatccttctccaaagttagccctagagtatattgctgttgtttacaatcaaaaagccccagaggtgtactctccaattctcttaataacctcatttttctgtcattacccctgttttagtacaagtagctgagcttcagagaagttaaaagatgtgcccaaggtcgcacagctaatgagtgtcacagtcagaatctgaacccaagtctgtctgatgtggggtcatgacaagagcatgggttttcttgggagaaaaaaatgacttcaaatccccacttcccgcataaaaatgcacaatgggtgtagcaatgccgaagccacagagctattgaggatggatggaggtgacgcataggaaagcacatggcctagggtatgtattcccaacactttgggaggccgaggtgggcagatcacctgaggccgggagttcaagaccaacctgaccaacatggagaaaccctgtctctactaaaaatacaagataagctgagtgtggtggtgcatgcctgtaatcccaactacttgggaggctgaggcaggagaatagcttgaacccaggaggcagaggttgtggtgaaccaagatcatgccattgcagtccagactgggtgaaaagaacaaaactccatctcaaaaaaaaaaaaaaaagaattaagaaaaaatatttgaacacttctttttatccctaatttattcatgtttttgaacttggaataggaacactactgccaacaaaagtaattagagaatatagatgttaaatctattctctaaatgaattattgcttattttaaaattgcatattaattaattacaggaaatttggaaagtaagagacatatgaagaaaaaaaggtaaaaatgatttgtaatccctctgagagttaccctttaatgccatttttggtatatttcctctcagttctttccccctccaccaccagtatgtgtgagtagtttatgttttataaagctgggttcatacaatatgatttcttggctggtgtggtggctcatgcctgtaattctagcactttgggaggctgaggcaggcatattgcttgagcccaggagttccagaccagcctaggcaacacagtgagaccccatctttacaaaaagtaaaaaattaggtggtggatatggtggcacttgcctgtagtcccagctacttgggaggctgagaccagaggatcacttgaacggaggaggagtctgcagtgagcctagattgtgccactgcactccagcctgggtgacagagtgagaccctgtctcaaaaaacccaaaaaagatttctctataatttctttttttattcagtaaaatattgtagttttctctatcttgattaaacagtctaaaatggttttaatgtcaccatagtattccattttataaatttgtcaaaatttatttaacccttattgttacatttccattttttaaaatagtgctgcagctgttgatttgaaaagatacttttttcaggtagttgacaaccaaaatatccccttgatgggttccagcataccccatgcctcagtatcacacagtatacctttgtaactaacctgcatggtacccccgattctaaaataaaagttgaaaaaaaatcatctagtgttttaaaacaaattatgtattatttttgggccaagcgtggtggctcacacctgtaatcccagttctttcagaggttgaggtgggaggatcacacaagaggatccactgagaccaggagtttgagaccagcctgggcaacatagtgagacccccatctctacagtaattaaaaaaaaaattagctgggcatgatggcatgcacttgcagtcccagctacttaggaggctgaggtgagaggattgcttgagcccagaagtttgaggttacagggagctatgatgatgccactgcactccagcctgggtgacagagcgagactctgtctcaaaaaaatatactattttaaatttataaatgacaattgaattacatttatatagtacaatgtgatgtgtgatgtatgtatactgttaaagagaaaagcctttgactaaatttgacagagtttagttgaacagaaaaaagattcatgaaccaggtagcactgagaaccaaaagtggttcagagatctctgctccacaggtgggcagggaatatttatagccagaaaacgtaagtttcattgagaaatagcctgttggttacagctctgcagttgccttgtttgaacatgtttttggcagcttgcagcctgtgaagggctgagagctcagctgctgtgattggctgagactgggctacttattccaagggcatattctcaggttaggttgcagtttgttttgtttacctatgtgaacccccaatagctgagacaggtctcagttaatttagaaggtttatttgccaaggttggtgacatgcacccataacacagcctcaggaggtcctgacatgtgcccaaggtggtcagagcacagtttggttttatacattttaaggagacatgagacatcaatcaacatatgtaagatgaacattggttcggtccagaaaggcaggacagctcgaagcaaaggtgggacaactcgaggtggggagggggcttccaagtcttagatagataagagacaaatggttgcattcttttgagtttctgatgagcctctccaaaggaggcaatcagatatgcatttatctcagtgagcagaggggagactttcaatagaatgggaggcaggtttgcccaaagcagttcccagcttgacttttccctttagcttcttggggccccaagatttattgtcctttcacatctattaagttagattacagtgtgctatatatggaggcagctttattttattttaattaattaattaatttatttgttggtgatgttgatttctcttgttttaaaatcaacattataggctgggcatggtggctcatatctgtaatccctgcactttgggaggccgaggcgggtggatcacttgaggtcagaagttcaagaccagcatggccaacttggcaaaactctgtgcctactaaaatatatgaagattagctggtcacggtgatgcacacctgaaattccagctactcaggaagctgaggcaggagaatcacttgaacccaggaggcagaggttgcagtgagctgagattgcacgattgcactccagcctgggtgatagagtgagactccaactcaaaaataaataaataaataaattaattaattaaataaaatcaactttacggagaaaaatttacattcaagaaaatacgcccattttaagtgtccagctggatgaattttcagaaatgtgtgtaccctcatgaccacttcctcaatcatgatacagaacattcccataacctggaaatccctgtggccctttgctggcagtttccccacccagccccaggcaacccctgatctgccctctgtcactgtagactagttttgccttttctagaatctcatatagagggagtcatgcagtatgtactctcttgtagctaatgtttttgaggttccttggtgttactgcattgttttctattgctgagtagtattccgttctactcagtaccataatttgctcatctactcttctgtggctggactttccagtttggcgctaatatgaattgtggaggcagttttagaccaaatttaacttaacaatacaatatgaaaagattaagtcaagctaatgaacatacctgttacctcacttacttggcattcttttaagttgatgcactagaaattttctctcttagaccgggcacagtggctcacacctgtaatcccagcactttgggaggccgaggcggggggatcatgagatcaggagatcgacaccatcctggctaacacagtgagaccccgcctctactaaaaatacaaaaaattagctgggcgtggtggcaggcgcctgtagtcccagctacttgggaggctgaggcaggagaatggcatgaacccaggaggcagagcttgcagtgagccgagatcacaccactgcactccagcctgaaagacagagactccgtctcaaaaaaaaaaaaatttccttagttattttgaaatattcattattattgactatagtctcctgctgtgcaatagacctcaaaacttttttctcctgcttggctgaaactttgtaccttttgaagaggaagtctccattcccttgttctgccacctcgccagctctggtaaccattattcttctactgaatgaattcaactttttttttttttttttgagatgtctcactctgtcacccaggctggagtgcagtggcacaatctcagctcactgcaacctccgtctcccaggtttaagcgattctcctgcctcagcctcccaagtagctgggattacaggcgcctgccaccatgcccagctaatgtttgtatttttagtagagacagggtttcaccatgttcgccaggctggtctcaaactgctgacctcaagtgatccacctgcctcagcttcccaaaatgctgggattaccagcatgagccagggcgcctggcccaaattcaactttttttttttttttatgagtgagcagcagcaagatttattgcgaagagcgaaagaacaaagctcccacagtgtggaaggggacccgagtgggtagctcccaaattcaacttttaaaagattccacgggcatgtgagattatgtggtatttgtctttctgtggtatttgtatttcacttagcagtatgtcctctagatttattcgtgtcattcccaatgacagagttttgttcttttttatttttttggagatggagtttcattcttgttgcccaggctagagtgtaatggcatgatctcggctcaccacaacctccacctcccgggttcaagtgattctcctgcttcagcctcccaagtagctggaattacaggaatgtgccaccacacctggctaattttgtatttttttttaatagagatggggcttcaccatgttggtcaggctggtcttgaactgccgacctcaggtgatctgcccacctgggcctcccaaagtgctgggattacaggcatgagccactgctcccggctgagttttgttctttttaaggctgaatagtacttcgttgtatgcgtgcaccgccttttctgtacgcattcatcttaggctgattgacttaggcagattccacatcttggctactgtaaatggggccgcagtgaacatgggagtgcagacatccctgaacacactgatttcaattcccttggatatattcccagaagtgggattgctggctcacatgatagttctatgtttagtgttttgaggaacctccatgccattttccatcgcggctgtactacacaccggcagtatactaggattcccctttctccacatcctggccaaaacttaccttccatctttttcataaaacttgttctgatgagagggagatgttatgtcacggtggttttaatttgcattttcctaaagatttaggttgccactggtcagctccaggccccagagcttcttcaactgaagaagtacttgctgtctatagtaagcatctcaaactttaacgtgcatgtggatcacctgggaatcttgtcaaatgcagcttccaggtaagtgggtctgcagtggggcctgatattttgccttttgaacaaactcccagataatactgatgttactggtcccaggacctgcctttgaggtagcattttttcatgaacctattggctgtttgtatgtctacttttgaaaaatgtgtttggttcctttattcattcttacattggcttattggttcttttgctgttgagttgattgagttcctcatatattttggatattagccccttttctaatgtatggttagcagatattttttctcacgacgtgggttatctctttgttacttgttccttttgctgtgcagaagcttttcagtttgatgccatcctgtttctatttttgcttttattgcctgtgcttttggggacatacccaaaaaatcattgcccagatcagtgtcatggagcttttcctctgtgttttcttatagtaattttacagtttccggcataatgttaaagtctttgatccattttgggttgattttggggcatggtgtaagataagggtctaattttattttctgcatatgaatagccacttttcccagcaccatttattgaatagagtgttcttaccccttggcgtgttctttgtgcctttgtcaaaagtcaatagacagtcagctgggcacggtggctcacgcctgtaatcccgcactttgggaggccaaggcaggtggatcacctgaggtcaggagttcaagaccagcctggccaacatggtgaaaccccatctctaataaaaatacaaaaaattagccgggtgtggtggcaggcacctgtaatctcagctactcgggaggctaaggcaggacaatcgcatgaacccaggaggcagaggttgtagtgagccgagatcactccactgcactccgtccagcctgggcaacattccttctgtgttctgggatatatattcttgagggtattcccatctgtggatagttgccagttagatttctgtggtggggaagtggagctagagtattcttttcctttttttttgagacagcatctcactctgtcatccacgctgcagtgcagtggcattaacatggcttcattgatctcttgagctcaagtgatcctcccacctgagtctcctgaaaagctagggctacaggcatgcatcagcatgcccggctaatttttaattgttttgtagacatgggttcttgctgtgttgcctaggttggtctcgaactcctggactcaagcagtcctcctgccttggcctcccaaagtgctgggattacaggcgtgagccactgctcctggtctgtttcttttgtttagtatttttgtttgctttgtttcatgagctgctattttgactacagttttaatatttttagcaattttttggatatgcagaaatttaattcttattcatcaaatatattttagtattttgtgtgttttttagatttccttttttaggagtctttccaaccataaactgccaaatagaaatacacacacacacatacacagaggctatgaatagacaactaattgaaacagaaaaaaattgattaattaaagcacctatgggatttttctccagccaaattagcatttttatttaaaaaaatcttttagtgttatttagcctacataggaagaggcttacttatgtagttgataagagtgtgaattgatcaactttttggaaaataatctgccagtataattaaaattataattaaaatgtatcataggtcagttacaccactttgagaatcctatactacagaaaagaagaaatataaaacaaaaacatcagtgggatccatgtatattgatgattattgtagtcatcagtggtgggaatttttaaaaacaaccttaatatccatctaatagggaataaagaaatcagaacttatctacaatgcgcattactacacagaaattcaaatgatacatttgatctacattagctggaattagtaatgtccatgtactctaatgggagaaagaaaattactaaataatgtaagatttgagcacgttctttaaacaaaacaaatcaataaagccctaaaaggacatactattgaaagcaagtcacaaaatccagaaatggcagggaaaatgttcaacaatttgactatgtaaaaatgaaagtttcttcaaaacaaagataatataaacaaaataaaagttatgatacagaccttaagaaacaaacttgctaattatatggaattaataaatgtgcagaatatataaagaatatcattacatgaattagaaaactagtaaatcataatgaaattctcagcgagaaatacaattggccagtaaacatatgcaaaaatgcacaatctctctaataagtggagaaatccaaattaaaaatggaaatatttcttaatcataaaattggccaaggttagcattggtcatttcctctgtaactaagggtgtgtggaaataggaactctcatatactgatggtgggagtataatatcattaaatttttttgaaacacagatttttaattttttatcaaaatatggccaggtgcagtggctcacgcctgcaatcccagcactgtgggaggccaaggcaggcagatcatgaggtcaggagatcgagaccatcctggctaacatggtgaaaccccgtgttatttgtaaaaatacaaaaacaaaattagctgggtgtggtggtgggcacctgtagtcccagctacttgagaggctaaggcaggagaatggcatgaacctgggaggctgagcttgcagtgagccaagatcacaccactgcactccagcctgggcaacagaacgagactctgtctcaaaaaaataataataatattaaaaatttatactttgcctcagtattttatttttagaaatcaatcataaaagaaaaaacccacctaactaaggtaccaaaaagatgaatatacaggtatgcccaggatagtgtaggtaacggtaacaaataactgaatccaacataaaaattccacagtgaaaaagtgaccaaattatggtcagataccctgttgaataatgatgcaactataaataagaatgagagagacctatatgcactcataagcaatgatcaccacattctattttatatggaaaagccagttagggaacaacacacaaagcaggattacgttatgtaaaaacatgggcatgtctatctgtgtgtaagtggatgtagacgactgagtgggctgggagctggcggtgacacatttcattctacagacctaagcagtatttgaatttttataacaatagcatatgtgtttcttatgtgatttactagaaacaatttaatttcttcagttgtaaaaggtgtattttaaacctatataaaggtacatggagatcgtcattcagaataacaaaataaaaagcaatataaagacacaaatagatatagtacaatattaaatactacaatattcaagatgatattaaaattatatatatctacatctatatgcatgtaaggatctcagtaaatgatattgtctaaaattaaactgtggtaatttttgcagacctctgtgaatatattagaaaccattgaattgtgtgtacactgtgtgtgggtgaaatttattgtatttgaattatatctcaaagttctgttaaaaaatgaatggcttgatattctagtgctaagggatggttttatttaaaacataaactaatagtttccagcagagtcccttaaaaatattacagcagggatttccagatcacactcactcccacctttttagaatttttgactattttccaaagtattgaattcaatgaggtgcaggtggaagaaagcgtttacaaagtcagtgggttacgggagagctggtgtgggttgaggcagagtggggagagaggctcctttcaaatggaagcctctggaacccacagacggcaagcgtaaggcagggcaatcttctggagacctaccagagaaaggctttagacccaacactcccattcacaaacatggacaggggcatctcagtgtttccttaacttcactctttctatattgacacaaggaaataattaaaagggggtaattctggtttagtttatttcattaaattatcaacaaacaacttttgaaacaaaaactattaaagtggaactcaataaaattactaggtttaataatctgtatctgtgactcagatacagatcaggcaaaccagctgtggatgaagctcccagctgtggatgatgcccccagacatggatgaagcccccagctgtggatgatgcccccagatgtagatgaagccacaaatgatgcctgtgtggacagacagaatgatggacaggcagatgaatgtgagggttttatgtgaaacaagtccacttggttgttgacaagatgctgttttaaagtttcattttgccatactttgaatagcttttcattagctaaatttagccacatgtaaaatcactaaggcagacacctggagttcccatatgaaaatcaaatgtaaaccagcagtgacctacttcaatgtgatcatcggaagtcagaagttgagctcatttttgatgtttaaagcctgcataatattcactgtgttattattcagtgtattactatttccttcatgatggaaatttggtttgccccaactttctattctatcaaaacactgctacatagaaaatccccatgcacatatttctcctaattgtggaaatattttacataaaagactctagacatgggatgaaattcccaggttattggaattttaaaatagataggtactcccaaattgccgtcttacaaattatatgaattcgtaagcttccaactgttatggagttacccattttgagaaatctgtgctaaaaggacccaaacaatgctgatgacaatgatcaggataataagtacgctgggaagacaacaaaatgatttaaatcttagacaagtcattctaggtgtctccactgtttcagttcttgcattcattcttgtggtatcttttcccttttaccaataaaaaagctccctgacatcacattgtggcagtccccatggtttgccgcagttactgcgggactgaacgaaggaggacgaatgaagaaatgaaaaccaaggaaaaaaggagctgtttaaagaagggtccagggaagaagaagagggctcccagcttctagtgagcaagggcagcagccctgagcttctacagcccttcatatttattgagtagaaagagcagggagcaggaggtaatgattggtcagcttctcaattgatcacaggttcacattattgctaacaggtttcagatgtgcctaatctcaagaaacgccgcgcctggggcatgactgccctcagcattccctctgggtggcagacgcagtttgccaacattctgcattcatgagaacagtttactgtttactcatataacctccagtggtacaccgagttgatcatgaccctccctctttcggcctgcaacatcacatgaatccaatgagtattggttagtaaaatgcctatgactagtcatcttcatctatgcaattaaatattaattcatcaaacacttcaaatgtaagcaattaataattagtgaatgaaaaatacataatacatcaattagaaaaaaactctattaaaaagacatttgtgtgataaaagagattgccatttttgtatttttctacaaagttaaagaaaactaagtcagcttatataagtgaattttaaaagcctttaggccaggcatggtggttcatgcctgtaatcccagcactttgggaggccaaggtaggcagatcacctgaagtcaggagttcgagaccagcttggccaacatagtgaaacccatctctaccaaaaatacaaaaattagccaggcgtggtggcaggtgcctgtagttccagctactagggaggctgaggcaggagaattgcttgaacccgggagacggagattgcagtgagccgagatggtaccactgcactccagcctgggcaacagagtgagactccatctcaggaaaaaaaaaaaagggcatatatatccattatttcactgggccttcacacagccctgctagtcaaccctcgagaattgaggaatcagagaacttaggaacaagaacatgacctgggacttcttatgtaagtgagaatcttaggctaaattgtcttgcggtaaatgcctttcccatcctcagaagtctatagtgagcagaaagcagtaacagcatcctcccttccactcttcccttcaggctgaacacatccctgtccctacagcctttgcagagacacaggtgacagagcactcaatatagaatccctgggctcacactggctttcctacagacacaggggatccatgaggcccacagtgacatacacatgtacacaaggatgcacgtactgacactgatgagccctggaagtcaacacagagtggcatacagaagaacacatgcaggcacacacacagccacaactggacctgcgaggtctacagccccacaaatgaaaagaggtgcataccatctcacaacaaactagaactttgagagaaccacacacacacacaggtctacaaattcacctgaacaagacgccgtccatagtcactggcgtaaggcatctactcactatcacacagaacacactcaggcaagcagacatagatgatacatccacaatctacagagatgaactgcagagttacatgcacagatatgccagtcatacattcagatctgtgtaaacagtgaggcacacacacacatacacatgtgcacttatacagaaagactcagacccagccaggcatggtggctcaggcctgtaatcctagcactttgggaggtcgaggcgggtggatcacgaggtcaagagattgagaccatcctggctaacatggtgaaaccccatctctactaaaattacaaaaaaattagccgggtgtgatggcgggcacctgtagtcccagctactcagaaggcagagattgcagtgagctgagattgcgccactgcactccagcctggacaacagagcgcgactccatctcaaaaacaaaaaaagaaagactcagacctgacctgttagtcaacagccagatgccaacagataatcacattagactcatcagcaagcacaccgtgcacacaagttccactcccatgtacaggttcctgtcccatgtacacaagcctgcacacaaacacgtatccagactccagaactgttgagacagtgcccacatacacactcatagagtcacctgtgcacaggtgcacgtacacattgtttcacagaggcacaccaggacagaaacacataagaaatgtgaggcaaaagcggacccacacctacacctgtaagatacacagagaaacaaacacatacacaaacttacacatagactcatgcactgtgtaatcaacagttctataccccaccaaggctcttgtcctggtgtgtccagaattggtgggttcttggtttcactgacttcaagaatgaagccacagaccctcgtggtgagtgtcacagttcttaaacgcagcgtgcgcggagtttcttccttctggtgcgttcgtggtctcgctagcttcagaagtgaagctacagaccttcgcagtgttaacagctcataaaggcagcgtggacccaaagagctagacacaaaagttctccacgtccccactagattagctagatacagagtgtccactggtgcattcacaaaccctgagctagacacagagtgctgattggtgcatttacaaaccttgggctagatacagagtgccaattggtgtatttacaatcccttagctagacataaaggttctccaagtccccaccagagtagctagatacagtgttgattgatgcattcacaaaccctgagctagacacagagtgctgattggtgtgtttacaaaccttgagctagatacagagtgccgattggtgtattttcaaccccttagctagacataaaggttctccaagtccccagcagagtagctagatacagtgtcgattgatgcattcacaaaccctgagctagacacagggtgctgattggtgtgtttacaaaccttaagctagacacagagtgcccactggtgtatttacaatcccttagctagacataaaggttctccaagtccccaccagactcagaagcccagctggcttcacccagtggatcccgcaccggggccgcaggtggagctgccttccagtcccgcgccgtgcgcccgcactcctcagcccttgggtggtcgatgggactgggcgccgtggagcagggggcggcgcttgtcggggaggcttgggccgcgcaggagcccacggcggtgggtaggctcaggcatggcgggctgcaggtcccgagccctgccccgcggggaggcaacgaaggcccggcgagaagtcgagcacagcagctgctggcccaggtgctaagcccctcactgcccgggtccggctggcagctccgagtgcggggcccgctgagcccacgcccacccggaactcgtgctggcccgcaagcgctgcgcgcagtcccggttcccgcccgcgcctctccctccacacctctcggcaagctgagggagccggctccggccgcagccagcccaggaaggggctcccacagtgcagcggtgggctgaagggctcctcaagcgcggccagagtgggcgccaaggccgactaggcgccgagagcgagcaagggctgtgaggactgccagcacgctgtcccctctcactgggttgctattaaaaatgggcgctgaatataaaaattaaccgggcgtggtggtgcatgtctgtaagtcccagctactccggaggctgaggtgggagaatagtttgagcccgagagactgaggctacggtgagccgtgattgtgcaactgcactccagcctgggcgacagagtgagacccagtctcaaaacaaaatcaaacacgggcgctgccctgggcaggggaggtctgggcacagctgtgctgatgtgggcagtggacaggtgtcacgtgagagcctgtggccaagcctaagctgcggttaaggtgggaggctgaagggtttggagtgtgcaccaccccggaccacctctcagtaggaatgtggcaatgcacttcggtgctggattcctacttctggctgtgtgatttgcgacacgttaccccacgcacctgtaccacaacttcctcatctcccaaatgggatgacagtagttagcaaacctccctggactgctgtgagcattctgccagaaaaatgtactccaagctcttgaagtaggcctggcgtttggttggtgctcagtacatattcaatgtttctgtcgctggcgtcatcactgtgttcatggcagagctctgtgccgccaggactgggccgccacccagaccttcctttcccgccccaggggtgaactgtggacaggaccctctggggggactaggccaaggctctcccacctctggggacccgcgcccatgggcctcagatatgtggctcgagaagggggagtgggggcagggcccctggaaaacccctcgaggccagacccaccactcccaatatccgtaagaccaggggcttgagtctttcctgcagacagatgtgggcaggaacccacccgactcccagctacgtggggacgtggacgaactaacaggacaaattctagttcctggacaccgccctcccagtatcctcgcaattagacacccatgcagcggcactacactgatccgcacacggagatacacagcgacatccgcccgcaagagcatggtgggtgccggagctcccggctgtgggcccaggaactacatttcctagaaggatgtgctagatactcgttcgcgtcgggacgcaagcaccggcccgaactcgctctaggaaatggagtctgacgcctgcgcggcgcaaacgctcccgggaggtgtagtttgcgcctatttcgcgcaggcgcgctttcccgcagcggccgcctgctgctctttgtggcagtcgcagtccttttgtgggagtccggtctgtccacttgccggtccctcagaccgtcggcggtctctgtccgcttcgggacctgtccgctggtcgctccgcgtccgatggctcctggccgcggaaccttaggcctggccctggtctccgagcgcgggttcgccgggaggagcgtgtggcgggggtgtgccggggcgtgagtgcgccgagcatggggctgagcctggtgtggggagtgggtatctgcggagccggcctgaaccccacctcagccgggcgcggggagggggctccgtgcgtgtgatcgtgcagctgtgagcgcgtggccgccccgcggggctccgctgcaggcccctcagccccaggagcagtactcgctcttcagggcctgccctggatcctggaggctacacagctgcccactcctcctggggaggctgccgtggaggccatggagatccctgccccggagcccgagaagacaggtacagcttcactcttgtagtcagtatgtctgtggatttgcacttgaggatattgacactcagagagatcaggccagtttcccagaagcatccagcatctttttttttttttttaaatggaatctcactctgtcacccaggcgggagtggtgcaatggcttgatctccgctcactgcaacctctgcttcccgggttcaaactattctcccgcctcaacctcccaagtagttgggattgcaggcgcgcgccaccacgcccggctaatgtttgtatttttagtagagacggggttttgccatgtttcccaggctggtcttaagctcaagcgatccgcccgcctcggcctcccaaagtgctgggattacaggcgtgagccatcgctcctggcctcctgcttctttcttccccgcgcccaatcatttgttcccactcagacgtgcttgattgggggtagcagctcttttcgtcatgaattggagtgtctgagacacaggcagattattcctcgatgctgtttctgttggtgctagctactggggctcgttccccacctggccttgctggcaggttctgcctcctctctgattctcacttgtgccacgacaggtgggctttaagctcagccgtgagcctggtagccgtgaccttgactcatttctccttcgccagctctttcctctcaggatcctgctctttccctgaaagagaatctcgaggatatatcgggttggggtcttcccgaagccaggtccaaggtgagtggctgtgtgttcttccttctttatgaagagggttggcacattccctccccagccctggatcgtcagccttccacagaccttcacccgggtacctgctggccagtcctcaggaagctctgggcagtgggaacagctccaagtgaagagtccagatgttgcccgaggtgtgccctcgagatgtgctctattgaatgtctcgcccagtccaattcagtgggtcagttgctggggatctctctgcccagcgctgtgctgggagctctgaggagtggttttagtggaatctgagaaagtagttgacggctcacatggggtcgctttgcctatccacgtgctggccaggggttggtgcaggatgtttgcacggttggtttactgggactggaatcagacaggggcacgtggagcagctcaggaagggctggattgcagcacttggttaagagtggcggtaggggacacatccctgtgtgctttcctctgtacccagcccctggcatggggccttcatggagagtcctggagatttagagaatctgggggctcagcaaggaattggccctgggaacttctgcagccaaatgggacccagatccctccttttacagactgtgaactctgttcctcattttgtttttctaccgcaaccacctcaccccatggttgtatttagaagggtgcagttgacaaagagagcacagtagagtgaaagatgtggaggaataaggggtctttgggtttttgttttttttttagcattttgtgattttgtcagtctgccactcaaaagaggtgatggcagattatagccagctagaaacagctgcaaaacgtgtattgtgagctgtgcctcacttctgtagtgtgtcacaatgctttatagtcctcaagaaacttgacagtcaaatgcaatgcatgttccttgcttaggggatagatccaaaaaaattgataaagggcagtttgggacaagaggaaatttgaaaatgggctgtatcttaggtcatattgtatcaatatgaaatttattgcatgtgataatagtactgtgattatgtaagagaatatccacaggagatacaagctgaagactgtagagtgagacatcatgatgtctgcaacttaccttcaaatggttcagcaaaaaaaaatgtgtgtgcatgtatgtatgtctgtatgtgtctgtgcagctccgtctaggtggtagggccctcatgcatgtgttattcctattcctaaaatattagcttgttagatctttgaataaccagttgactctcctgagtacacatcagctttggcattttctcttgacagtctcattctcactcacagttcaagttgttctgtctcctgggacatcttgtgtggtctgttctgacttctctgctagtgtcattaccacatcagcatctgattccaatgcatactgtctgggttttttattcctttccctgcagaatgatgacacattagacatggacttctcccagtggccagaaatacccatcaaaaaggcctgtgcgggcctcagaccctaccctactcttgctggttttgctccccacactgaagccatgtagcctctgacagcctcactggccaacaccatattctgatacctgtggagctatttttttgtttttctttctttttctttttttttttttgagacagagtcttgctctgtcgcccaggctggagtgcagtggcacaatcatagctcactgcagccttcaactcctgggctcaagcaaatcccccacctcggcctcctaagtagttgggaccaacgtgtgtgcccccacacctggcttggagccttgtttcagcccattttctccttccctcggctatcgtcatccttcatgcctgcatgcctcagttaggggtgtgttctcagcatttgtcctcatctctacctcctcatctgaaatccagtgttttggggggtaaggttttattgaggtgtaatttatatacagcacagttgtacaattttaagtatacaatttgatgaggttgagcaaacgtatacagttgtgtaaccagcaccacaatcatgatatgggacgtttccatgacccaaaaatgtcctcatgcccctgtgcattcagtggtctcccctctccccttggtaaccactatagttttgctgtagattttcctctttaaggatttcatatggaatttatattatgtggtcttttgtctctgctttatttcgcttagcatatgcttttgagtttatccatattgttgtgtgaatcagtagtttgttcctttttattggtgagtaatattccatttgtattagtctgctagggttgccatacaaagtatggcaggagggcttaaatgacagaaatgtatttcctcacagttccagaggcaagaaatctgaaatcaaggtgtcagcagggttgatttcttctgaggcttctccttggcttgtagatggccaccttttccccgcatcttcacatggtcttacctcttctatgtctgtgtccaaatttcctcttcttatgaggacaccagttatattggatcaaggcccactgcattgaattcattttaactgaattacttctttaaagaacctctctccaggccgggtgcagtggctcacgcctgtaaccccagcattttgggaggctgaggtgggtggaacacttgaggtcaggagttcaagaccagccggccaacatggtgaaaccctgtctctactaaaaatacaaaaatttagctgggcgttagttctcgcctgtagtcctagctactcaggaggctgaggcaggagaatctcttgaacccaggaggcagaggttgcagtgagctgagattgcaccactgtactccagcctgggtgacagagtgagaccatgtctcaaaaaaaaaaaaaaaaaaaaaaaacctctctcggagttaccaagcattgagacataagaatttgaggtgaggggtatacatttcatcccattgctccattggatggagcaaactgctccgcagtttgcttatccattcaccagccgatggacatttaggttactcataggcttttgctattacaaataaacccgctataaatatttgagtacacgtatggctgtgcattttaatttctcttgcataaatacctaggtgtgaaattgctgagccatatagtaaatatatgtttgtcaattttattgatcttttcaaaaaacaatttttttgttttattgatttttctctattttctgttttccatttcagagatttctgatccttattatctccttggtgtcttaagattgaaacttactttacttactttagtgtcttaagattgaaacatagatattgatttgataccttttttcctcatatagcattcagcgttgtaaatttctaagcactgcctcaactatatcctacaacttttgttatgtcacattttcacttttattcagctcaaaatagcttctaatttccctagtgatgtattcttcagccatatgttatttcagaatgtgttgtttcatttcctaatatttagggcattttccagataactttctattatggatttctgatttaattctattgtcatcaaagaatgaactttgtgtgatttaaagtctttcaagtctaccaagatttattttatttcccagagtgtggtttatcttggtaaatgttccacatgcccttgaaaaaatatgtattatgcctttgttggttagagtgttatgtaaatatcagttaagtcaagttgaatgatggtgttttttaattgttctgtcagtttttgcattatgtattttgaagctcttttagtagatacatttatatttaggattgctatgagttcttaatgaattaactgttttatcattatgtaatattctctttgtctctgatagtcctctctctgaaatctactttgctattactataggcacttgagctttttttttttaaattagtatttgcagggtttatctttttctatcctatcacttttaacctatctttgtatgtaaagtgggtttctgtagcttgctttttgaattcagtttgacaatctccaccttttaattggagtgtttaaactattcgcatttagtgtaattattaatatggttggatttacatgtcctttttttttttttcttttgacagagtttggctcttgtcacccaggctggagtgcagtggcgcaatcttggctcactgcaacctccacctcttgggttcaagcaattctcctgacctcaggtgatctgccaccttggcctcccaagtgctgggattataggcgtgagccaccccacccggccttgctattagttttctatgtcttatgtcttttttgtttctcatttcctcccttaatgacttcttttgaggtaaacacatactgttctaatatactcttaattcctctgatttcattaatatttttcaccttttagttatttgattggatgctggacattgtgaattttactttgttgagtaggtttttggaattccttgtttctgggatttgttctgggatgcagtgaaattacttggcatctatttgatcctttcaaggatcaaagcaagtctggagttgggtggtggccaggatgcccaggcccagggggagcaggcaggaaggattggaaggcagtcaggtgaggactgcaggtagcctctcttagtcccttggggcacagaacttgctgatatatacaaggtttccttccttagagtgtaataacagtttctagtctgggatcggatccttttgcgttactgagctttgaatagagttgctgggatttttgtactattaatattctctcaaatttttaagtttgaaattcttgactccaggaagcatagcatctcacccaggacttagagcctgatacaacagccatgtacagcccctgggtcccaccgcaagttgccagggccctgtggtgtctattcagacctgctttcccaatctagaaggtggtgtgggaatgcatgccaattcccagcccccctccctgcccctggtccccgaattcagtcatggtcagtgtctacagcacaaccttctggcatgggagaaggtcacctgaggttaaccctttacttgtagggtccttaatcaatctctggctcctttggaaccatggacacagaatcagtcctgggtgagaacctatatgtcatttcaggaatcggtgagtttcaaggatgtggctgtggacttcacccaggaggagtggggtcaactagactcccctcagagggccttgtaccgggatgtgatgttggagaactaccagaaccttcttgccctaggtaaaatccccccagccccaggctgggcgtcggctgtcagccttcttctacatggtagatattaaggagaatcccttcagtgccggccctggtgccagatatatcatggggtgggaagcaaggcctgtgccttggggcactcatggccaggggcctcggccacgccagaagtccccaagggacagcgtgggagctggtagcatccttgcttggtgtttcccctggtcctgggataggggcagggagagaagagaagaaggtgggaccctggagcccagctggctctggaacagtcctcaagcaatgaagtaaggacgtcagcacacgtggggtcttcagagtatacactgggatttgggttccagtctgagaccctcactgcttttggcccagaggacctcctgttcccagagagggtgtccacttcacaggcattgtccttgttagggggcggcctgtaaggtcgactgggcctggagagctgcagcatgcccagcccactttctctccacgagcaggacctccactgcacaagccagatgtgatctctcatctggaacgaggcgaggagccatggagcatgcagagggaagtccccagagggccctgtccaggtgagcagaggcacaggtggaagggtgccagccccagcacccctggtggcacctcctcctatggcccctattttcctccctcagtttgccccggctccatctccccttttcaggtcccccgccagaccctcctgcctgcctcccttcagcacgtactgagcactgcctgtgtgctgagacctgttctgggatacaacagggaacaaacctggccactgggaccaaatggtcacctgctgatggggatggggaggcaggaatagaaatattgagccattggtgttggctgggcagccgggggtgtgggattgggggcagggggccaccagggaaggggcagctggcgttggtcagtgtcagggtcagcatgagcatcagcatcagggccagcgtcagcgtcagggtcagagccagcatcagtgtcagggccagcgtgagcatcagcatcagggccagtgtgagcatcagtgtcagggccatcatcagcgtcagggtcagagtcagcatcagcattagggtcagcatcagcgtcagggtcagggtcaacgtcagcgagggcttccaggctgtggccaagatggcagccctccgtaagggaaaggggactggggtgggtgttgagcagaaggtagtctgcttttcttctccaacattctttttgtagacttctcttctgagttggttgataaataagtggtaaattcggcttaatttattggacagtgactgctgagcatgttaggtgtctagaaagctcgagaaacacctttctgtgggaaaggcagccgataagctgtggagcacagaacacgggggtcggggaaggcagcccctcctccatccccctccactgccacataccacccagccccaacctgcaacagtggctgcagccccagctttctggtctttatttctcaccccagcctctgatgcttgctttgtcctctttaacaagattacaggtttcaaaaaattcatatttttgtttgattcatatatgaatatactgaaaatgaggctgaaaggttactgaaatcctgcataatctttccacccagagatgacggttctctaataactgaccatgtcactgattcctctgggcccttcctctgtgtgcggatagacttctaaagctacatgtggccaggcgtgatggctcacacctgtaatcccaacactttgggaggccgaggcaggcagatcacctgaggtcaggagttcgagaccagcctgaccaacatagagaaaccctgtctctactaaaattacaaaattagctgggcatggtggtgcatgcctgtaatcccagctacttgggaggctgaggcaggagaatcgcttgaacccaggaggcagaggttgcggtgagctgagatcgtgccattgcactccagtctgggtaacaagagtgaaattccatctcaaaaaaaaaaaaaaaaaaaaattagctgggcgtggtggtgagcacctgtaatcccagctactctggaggcttaggcaggagaattgcttgaacccgggaggcagaggttgcagtgagccatgatcgcaccattgcactccagcctgtgtgacagagctaaactccatctcaaacaaataaataaataaagccttatgcaccctcggaagcacagcactcacgccggagtctggctaccacactggccatggcatagtgagcgtcctcacgtgatgtttactgattgcacagtatcccttagatgaatgtgccctgctgtgttgttggccctattgctgccaaaacaacttttttctggcctgggcctcttctctctgctctgtgcaacttccctagactcttacctctcacttggtgtggatgtggtctacactatagcaacaccagctgagctgcagccctgtgtcactgaccatctcgtgggcctctgcttgcatgtctaaaaccagacttggaactggcccttcctcctcctttataaaagcttccaccatccacccaggcttgggtgtttgctgaggtctcatcctctcccccatttcctctcttgccaccttcagtcaacagctagggccatcagttttagcacctaaatggctcttagatctgctgcttcctgttcattttcacagccttggttccagtctgaagttgccatttttcacctgaattattcagatggcctccctaactggcctccctaactgctggctccaaccaccttacacaccaccaaagccaccttcaagacaaaccattatgccaggcacagggactcacacatctaatcccagcactttgggaggccaaggcaggaggaccacttgagcccaggagttggaggctgcagcgagctgtgattgcacccctgcactgcagcctggacaacagagcgagactgtgtccccgccctctgcttcccccgccccccgtcaagacaccatatgatcacatcaccctctgtgcaaaaggcctttcttccccggctgccctctgagtcaggcatctggtcacctcgaacccatccaccttgccagggtcacctctcagccttcctgcctctgcgtgtcttgtcttcatcttactgtctcacctctgagcttctgcacatgctgttcactctccacctggctacctgccatgtgtgccatggccagttccacttgccctgctcttctgcatgtgttggggccacaggcagcaccaccatgcagctctgcccgctgcactagactgctcccttttaagcctggggaggacagaattagaaataaaatctcctgccagctcagaaaaccttgctatagagatagaaaagaaagaaagccttcttattgaataagtgtttaaccagatgtggtgtacaggagagaaagaaacctccccctttgacagaggagacacatccaacccagcacacagggcaactgtcttcacctaaaggaagagtacagctttttgggttttgtttgtttgtttgttttttgagacagggtatccctctattgcccaggctggggtgcggttgcatgatcatagctcgaagcctcaacctccctaggctcaggtgatcctcccacctcagcctcctgagtagctgggactatagacaggtaccatcattcctggctaattttgtattttttgtagaggggtctcactgtgttacccaggctggtcttgatctgggctcaagtgatccgccaccttgacctcccaaagtgctgggattacaggtatgagccaccgcgcccagcctcttgtagctttttgacaagcaggaagttacatcttggactcgactcttggactaggctcattttgcttctgaaaaggtttgcatgcgtctcgagacagagaaagcatttgcaattcccagtgttctaaagggaagcgctggggtgtggggagcccttttttccttttggcaccacagacaatttttaattcatttgttagtcctagctactcgggaggctgaggccggagaatggcgtgaacctgggaggcggagcttgcagtgagccgagatcgcgccactgcactccggcctgggcgacagagcgagactcggtctcaaaacaaacaaacaaacaaaaaacatgtatttgtcctgtgtattgcgagcacctgccatggtattgatacagagcagtcggtcagccgacgtgtccgtgaatgagtgtaatcctcatcaacagctcccaagcttgcccctttctcagcccccttggtgcttgtagctgttccttccgggattcctttggcttctccgcctctcccggtctttgctctctggtagctccttccgtgttcttcctctcccttcttcccgctcttgcttgcccatctcatcctgggcgctcccttctctctgcctgcaccttccagccttggccctggtggcctctcctctcttttctgggcttatctgcatctccaggccaattctcaaatctgaattctaggccaggtttccgcttgctcacagaaaatcattttcaatatcttacagaatgggagctgaaggcggtgccctctcaacagcagggcatttgcaaagaagaaccggcccaggagcccatcatggagcggcccctcggcggggcgcaggcgtgggggcgccaggcaggtgctctgcagaggagtcaggctgcgccctgggcgcccgcacctgccatggtctgggacgtccctgtagaggaattccccctcaggtgtcccctcttcgcccagcaacgcgttcccgaggggggacccttgctggacacacgcaagaacgtccaggccactgagggcagaaccaaggcccccgcgagactgtgtgcaggggaaaacgcctccacgccaagtgagccagaaaagttcccccaggtgcgccggcagcgcggggcgggcgccggggagggcgagttcgtgtgcggcgagtgcgggaaggcgttccgccagagctcctccctcacgctgcaccggcgctggcacagccgggagaaggcttacaagtgcgatgaatgcggcaaggccttcacctggagcaccaaccttctggagcaccggcgcatccacaccggcgagaagcccttcttctgcggcgagtgcgggaaggccttcagctgccactcgtccctcaacgtgcaccagcgcatccacacgggcgagcggccctacaagtgcagcgcctgcgagaaggccttcagctgcagctcgctgctcagcatgcacctgcgggtgcacaccggcgagaagccctaccggtgcggcgagtgcggcaaggccttcaaccagcgtacacacctcacacgccaccaccgcatccacacgggcgagaagccctaccagtgcggctcctgcggcaaggccttcacctgccactcatccctcaccgtgcatgagaagatccacagcggggacaagccgttcaagtgcagcgactgcgagaaggccttcaacagccgctcgcgcctcaccctccaccagaggacgcacacgggcgagaagcccttcaagtgcgccgactgcgggaagggcttcagctgccacgcgtacctgctcgtgcaccggcgcatccacagcggcgagaagcccttcaagtgcaacgagtgcggcaaagccttcagctcccacgcctacctcatcgtgcaccggcgcatccacacaggcgagaagcccttcgactgcagccagtgttggaaggccttcagctgccactcgtccctcatcgtgcaccagcgcatccacaccggtgagaagccctacaagtgcagcgagtgcggcagagccttcagccagaaccactgtctcattaaacatcagaaaatccactccggggagaagtcgtttaagtgtgagaaatgtggggagatgttcaactggagctcgcacctcactgagcaccagaggctgcacagcgaggggaagcccttggccatccagttcaacaaacacctgctcagcacatactacgtgcctggcagcctgctgggtgcaggggatgctggactgagggacgtggatcccatcgacgcgctggatgtggcaaagctcttgtgcgtggttccccccagagctggcaggaatttctccctggggagcaaacctcgaaactaacatgatgtgctttggtgtcagtagctgctttctgagctactcaacaaggaaagcaccctggtcctccctggctcctagatccagaccaccttcctccaggtgtgggagccttgccttatcacccccatcaggtctgcatgccagggtgcctcctctagttaaagtcagtcacctccccagaagggccacactccaggaggagtgttgagagtcatttgaggtagtcttgccacctgttttccttgatgggcctggaagttgttgacaaggggaaagatctttcttgccaataaaaagaagggatatcgttgggtgccatggctcacacctgtaatcttaacactgtgggaggccaaggcaaggggatcacttgagcccaggagtctaggaccagcctggacaacatggtgagacctcgtctctacaaaaaatgcaaaaattagccagatgtggcggcatgtccctgtggtcccagctactcaggaggctgaggtgggaggatcatttgagcctaggaggtcaaggctgcagtgagccatgattcacagcactgcactgcagcctgggtgacaaagcaagaccctgtgtgaaattaaaaggaggtatatcaactgttgtatcctcggacgggctcctgacacggctttaatcaggagtttcctccataaactattattttcagaataataataaaacaagaattatgactagcatcactttccagtgaacattattatattgctagagaggagaataatcttgggtggtgggcatttggaaaaagtgaatttcctggacttaactcatgtaaatagctctactgcagagctgtgtgtttagtgacagtgcagtcaggggcattcccacagctgtcacagcacggcccagcatcattgtagccagatcctaacatgccaacatcacctcttgccatttagcccctagtgagaaattgggagctaccaggcaggtgcccagtgcattcagggaagatgggcacaacatcaggatgggtgtgtctggaagctcctcttcactgaccagggctgggcagggccaccctgggctggtgaggctgccctgcagggcttctcactatgtagcaccagtcaccagcccaggtcacagaagaagcccctcccagcacccactggagaggggaagctgaagcccagggagacgggctccatggtggtcccacatggagctgttttgcaaaccctggaaaaggcggctctccctgtcccaacactcttcagagacaggaagacagagttaatcttgaatgaatgttatttctacttagtcctaagcaagaataagctgccctcttggtgatcatactttatacggagtgctatcgtttatgaaatgctttcagtatgctttttaaattatgcaggcaaaataaccacacttcagaaaatgtggacttctgaaaaataaaatccccataattcttaataaaactgccttttgcactttgatacattaccctctgctttgttcatgtagaactttgcattattttcaacacagtgtatctatagtttttatcttttttccctctttagctttgtagcagatttttttttcaagcatctaaactgtcctcgttatacttcttttttttttaaattatactgtaagttctagggtacgtatgcacaacgtgcaggttagttacatatgtatacatgtgtcatgttggtgtgctgcacccagtaactcgtcatttaacattaggtatatctccaaatgctatccctcccgcctccccccaccccacaacaggccctggtgtgtgatgttccccttcctgtgtccattgttcaattccaacctatgagtgagaacatgcgatatttggttttttgtccttgcgatagtgtgctgagaatgatggtttccagcttcatccatgtccttgttatacttctaaacagaggcacagtgttctctctggtctcttagatactcttttgttggatgttgaagttatttccatggtgcagtggtgtgatcacagctcactgaaacctcaacctccctggctcaggtgatcctcccacctcaacctcctgagtggttgggactttgggactacaggtgtgcgccaccacgcccagctaaatttttggggggggcagggggtctcgctgtgttgctcaggctggtattgaactcctggtctcaagcgatcctcccacctcagcctctcaaagtgttggggttacaggcatgagccactgcacccagtctattgatctttctttttgaaaaatatttgaatatgccctttgtccctctttatattggagtcttgatgtttttcttttatgtatgtaaaaacttttccctgattatgaatattatatgtatactgcagaaaatttttaaaaatcacaaaatcataataaaaatgaccctcaggttccagctcagtggctcatgcctgtactttgagaggccaaggcaagattgcttgagcccaggagttcaagaccagcctgggcaacatagggagatcccatctctacaaaaaatacaaaaaaaaaaaaaaaattagctgggcatggcggtgcgtgcctgtagtcacagctactctggaggctatggtgggaggatcacttgagcccaggaggtcaaggctgtagtgagtcataatggcaccactgcactccagcctgggtgacagagcaagactgtctcaaaacaaacaccttcagaatcagttcatggatcattaccattattaacatttagatgcgttttcttgcagttgttttctatgcatgtatacatatcttttttcttttaaaagaaaattaggctgggtgcggtggctcacgcctgtaatcccagcactttgggaagccgaggtgggcagatcacctgaggtcaggagtttgagaccagcctggccaacatggtgaaacccctgtctctactaaaaatacaaaaattagccgggtatggtggccggtgcctgtaatcacagctagtcaggagcctgaggcgggagaatcgcttgaacctgggaggtggaggttgcagtgaggccagattgtgccattgcactccagcctggtcaacaaacaagagcgaaaccctgtctcagaaaaaaaaaaaattagattcatattctacatattatttttatcattttccatttaacattttatgataagcattttctatgttataaaatattttcagacataattggccacatcattttctgtcttacagttgtatcttaatttatctattcccttactattgaacatcaagattgtttgtgcctataaataattatttaacataggcctctgttcccatctttgatcatttcctctgagtacgttctgagaaatgcagttaactggtgaaggttatgaacactgaagctcgttggtgttcctgggtggaatctgatctggtggacctgctgtgagctgttcccatcggctctgacatgacgctgtgagctgttcctccctggacgaacatgttcctcccatgacgctgtcaccactccctggccagcatggggtcgttccggccttgatttttatatctgccattttgaggctttaagaatgttatttgtccctgcttgttggccgtttgtttttctcttcatatgtgtggtctgttcttgtcttttgtccactattctctttggtttatttcacacacacacatacacagagagacacacagatgcataaatgacatacacatacacacataaacagatgcataagcacagacacacacacacacatatatatccccttggcatgtacattttctgtctttgttacagcatttttaatgcccagaggttttctttttcttttttcttttcttttctttttttttttttttttatgagatggagtctccctctgttgcccaggctggagtgcagtggtgtgatctcggctcactgcaagctccgcctcccgggttcacgccattctcctgcctcagcctcccaagtagctgggactacaggcacctgccaccacgcccagctaattttttgtatttttagtagaggcggggtttcaccgtgttagccaggatggtctcgatctcctgaccttgtgatccgcctgcctcggcctgccaaagtgctgggattacaggcgtgagccaccgtgcccggccaaaaaggactcttaaaactcaacaataagaacatgaacggctgggcacagccgttcatgacacagatggctgtgtcatgggccatagaataatttaaaaaacaataaaagtctcagctgggcacagtggctcatgcctataaacacagcattttgggaggctgaggtgggaagatcacttgaggccaggagctcgagaccaacatggacaacatagcaagactccatctctaccaaaaaaacaaaaaaaattagttgggcatggtaatatgcacctgtaatcccagctgcttggagacttaggcaggaggattgcttgagcccaggagttcaagtctagtgagctatgattgtgccactgcactttagcctgggcgacagagcaagaccttgtctcaaaaaaaaaattctattttttaataaatggacctgaatattttaccgtaggtcttcccaaagggtccagggatgccatcacccgattgcatagctagaaagcggatggactttttagtaagtgtgggttctagtaagtgttgccgcactgaagaacatctctggccaggcgcggtggctcacgcctgtaatcccagcactttgggaggccaaggtgggtggatcacttgaggtcaggagttcaagaccattctggccaacatggtgaaacacttcctctactaaaagtacaaaaattagctgggcatggtggtgggtgcctgtagtcccagctacttgggaggctgaggcaggagaatcgcttgaacccaggaggtggagcttgcagtgagccgagatcatgccaccgcactccagcctgggcaacagagcaagactccgtctcgaaaaactaaaaaagaagaagaacatctctgctctcagcttaggtcctgggcccctaaagtcagcgaggcagccattgtcctagggtgatacgatgacatggatttgggactccctggaggaggccacacacacacaaaatgcaactctacaaggggagggaacagaaactgaaacaggtatctgcaatgtgcctggatccgaatttcaaaatgtgttgaagaattatggatttacaccatgagaaaagcactggttggcttttgtgcctgcttcactttggctctgagttaacttcaaacactgccaaacacaatgctagcacatggtgaccctcaaactaataatttataagatgggatccacttccccggtggaagtggccacatgctgccctctccccacccccacggcatacttgggcatgacctgcagccttttgttgccatccaggttcgtgttcattctgctggtgcagtaaatcaaccactatgacatggttttgcaaaaaagaaaagatttattcacaagggcactgatcggggaggtggatcctttttaagtccttaagtctttcgtcccccgaagataagtaacagcttccttctgtgtgagcatggctggagttcatggcatttcacaagacacgtgtacagaagagggtagcattagcattttccaaaggcggagtttttggccctccagtgtcaaaaggccacctttcgggcacttgtgcaggcccaattgaagggttggtggtctcaaccagtttgaactggacaggagctggcccaagttcctgaaaaacaactgaagaagccggcaccatggtgacttatgcatgttatctatacagtagccagggaaggttaagtttcagcattcagcggcaaggctttcagctactgtggcccttaagcttcacagaaaaaggagaaaaaaaaattaaaaaccaaatgacccaaaagcaagcagagcaggcagacctggccaaattaacccttcagtttcactttcccttgctctgttgggcatttgtggcttggaaaatggccccctcctgccgcagacagaccctttactgctgacaccaatcattacattgatctgtcgtggttcagtgcaccactgcactccagcctgggcaacagagtgagaccctgtcaaaaaggaaaggaaaggataggaaaagggaagagaagagaaaggggaaggggcaagggaaggggaaggggaaggggaaggggaggagggagggaaagaaaggaagaaaataaaagaaagaaaagagaaaagaaaagaaaaagaaaaaaagaaaagaaaagaaaatgcacagtgagttagatttggcctggaggctgtagcttgccaactcctcctctggattcatggattagagtttaaggaagagatggagaagtatggcagaagaactggagtgaggccgaaccccgtggtgttctagaagaaaggctcttgacacaagcatctggcagttatttttcaggggagaacctacaaattataaggctgtgcagctccccttactagtcaagtgattacacttttgttttcttttatttttttttagagacaggatctccctctgtcacccaggctggagtgtggtgccgcagtcacagctcactgcagcctcgaacttgtgggctcaagtgatcctgcctcagcctcctgagtagctgggactacagacacactccaccatgcctgggtaattgtttctagttttgtagagatgaggtctccttgtgttgcccagaatggtcttgaactcctcgcctcaagcaatcctcccaccttggcctcccaaagtgctgggattataggtatgaaccaccatgcccggcctcatgtgactactcctacagaggccctcgatggcctggaatgattgattccaggaccctgtcttctcatcccaaagcaccaaaccctactgacaaggaaagagcccccatttcagaacttccatggccaccccccaaccctgggattggcaactttgcaacctgggcttctccgataatcagatttacggtaagaccccaaagaggtccaggcgcttctaaaacaagttagacagagaatccaaacccaaatcctcaagatgtgagcccacatcacatcccccaaaatagagcatccgtgaccactccagccttgctagggacacagcatactccttgaccctcaccaaaggacaattgctctcacaaacacggggatccactggttcccacgcactaagcaaacttttatggccttaattgacactgtttccccagagaccccactaaatgtaagggaggaaccctctctgttccctgggacataagattgaaggcaaacaagtccgccttagcctgatcactggtgcaatagctttgcagaatattccagtggtctcagttctttctgctcttgaatttctatcactgggacagatgctccaattggaataaaacccacactttgtcccttactgttggtcttggcagatgagaccctgaggacctgcccaagccattaaaatcattaatatgacccaaaataaattaaaacagggacttcaaggattgagagaaggggtgaccatcccctctgtttctccatttaacagcccaatttgacgtgttcttcaaatggaaaagaacaaatgacatctcacagtcgatgctgaaaccttaacccagggggccatgggggccccagcccctgcagactgaaaggatggagcccattcagtcttttgctggccgatattttgctatttttgcttccttgcagtgttccacagtacctaattcaacaggctctcagcctctactcccattctatttattgtggtaaaatatataacaaaatttaccgttttaacctttttctttctttttttttttttttgaaacagggtctcactctgtcacccaggctggagtacagtggtgccattgcagatcactgcagcctcaacctcctgggttcaagtgatcctcccacctcagcctcctgagtaattaggattacaggcttaagccaccatgcccagcctactttaatcattttttaattttaattttatttatttttttaaattttactttaagttctgagattcatgtgcagaacgtgcaggtttgttacataggtatacacatgtcatagtggtttgccgcagctgtcaacccgtcatctaggttttaagccctgcatgccttaggtatttctcctaatgctgcccctcccgcagccccccatcctcagacaggccccggtgtgtgatactcccctccctgtgtccatgtgttctcattgctcaactgccacttataagtgagaacatgcagtgtttggttttctgttcctgtgttagtttgctgaaaatgatggcttccagcttcatccgtgtccctgcaaaagacatgagttcattattttttatggctgcatagtattccatggtgtatatatgccacattttctttatccagtctatcactgatgggcatttgggttggttccaagtctttgctattgtaaatagtgctgcaataaacatatgtgtacaggtgtctttacagtagaatgatttataatcctttgggtatgtacccagtaatgggatcactgggtcaaatggtatttctggttctagatccttgaggaatcgccacaatgtcttccacaatggctgaactaatttacactcccaccaacagtgtaaaagcgttcctatttctccacagccttgccagcatctgttgttttctgactttttaataatcgccattctaactggtgtgagatggtatctcattgtggttttgatttgcatgtctctaatgaccagtgatgatgagcgtttcttcatatgtttgttggctacataaatatcttcttttgagaagtgtctgttcatatcctttgcccactttttgatggggttgtttttttcttgtaaatttgtttaagttccttgtagattctggatattagacctttgtcagatgggtagcttgcaaaagttttctcccattctgtaggttgcctgttcactctgatgatagtttcatttgctgtgcagaagctctttagtttgattagattccatgcgtcaattttggcttttgttgccattgcttttggtgttttagtcatgaagtctttgcccatgcttatgttctgaatggtattgcctaggttttcttctagggtttttacggtttttgggttttacatttaagtctttaatctattttgagttaatttttgtataaggtataaggaaggggtccagtttctgttttctgcttgtggctagccggttttcccagcaccattattaaacagggaatcctttttccatttcttgtttttgtcaggtttgtcaaagatcagatggttgtagatatgtggtgttatttctgaggtccctgttctgttccattggtctatatatctgtttaaaaatatggaacactttggctgggtgcggtggctcacacctgtaatcccagcactttgggaggccgaggcgggtggatcatgaggtcaggagatcaagaccatggtgaaaccccgtctctactaaaaatacaaaaaattagccgggcgtggtggcgggcgcctgtagtcccagctactcgggaggctgaggcaggagaatggcatgaccctcggaggcagagcttgcagtgagccgagattgtgctactgcactccagcctgggtgacagagcgagactccgtctcaaaataaataaataaataaataataaaaaataaaaataaaaatatggaacgcttcacacatttgcgtgtcacccttgggcagaggccatgagaaacttctatcgttctgattttagtatatgtgctgccgaagcgagcactattttaatcatttttaagtgcacggtttagtgacattaagtacattcactgccatctatttctagaatcttttcatcacccgaaactgaaactctgcattcctattaaacactaattcccatacctcccagcccgtggtaaccacggttccaccttctgtttctacagaattttttttcttttttttttttttttttgagatggagtcttgctctgtcgcccaggctggagtgcagtggcgtgatctcggctcactgcaacctctgcctcccgggttcaaacgattctcctgcctcagcctcccaagtagctgggactacaggcacacatcaccatgccctgctaatttttttgttttgttttgtttttgttcatttgttttctttgaggcaaagttttgctcgtcacccaggctggagtgcagtgccgtggcagtggcgcaatcttggttcaccgctactctgtctcccgggtccaagtgattctcttccctcagcctcccaagtagctaggattacaggcacacacgaccacatacggctaatttttgtatttttggtaaattttgtatttttggtatttttgccaggctggtgtcaaactcctgacctcaggtggttcactcacctccgcctcccaaagtgctgggattacaggcgtgaggcacctcgccccgcctgtctctacgaatttgactcctctagatactccacatacatggaactgcacagtatttgtcgctgacttctggctgtcctcacctggctatgcctactttgggggataatctgggcctgggacaccacatccccgtagcaggccccaccgggccgcacaaacagaactgcgccgaagttcccccaggctgttacccccacttgtttaggctcttcaaagatgctaccggccgggcgtggtggctcatgcctgtaatcccagcacttcggtgggccgaggtggtcagatcacttgaggtcaggagatcgagaccagcctggccaacatggtgaaaccccgtctctactaaaaatacaaaaattagtcgggcttggtggtacgcgcttgtaatcccagctactctgtaggctaaggcaggagaatcgcttgaacctgggaggcagaggttgcagtgagccaagattgcgccactgcactccagcctgggcgataaagtggatactctgtttcaaaagaaaaaaaaaaggtggcaccggcccggtgcggtggctcacacctgtaatctcagcactttcggaggctgagatggaaggatgtcttgggcccgggggatggaggctgcagtgagcggttattgagtgactgcgtccagcctgggcctcagagtgaggccgtgcctcaaaaagaagaaaaaaaaaaaaaaaaaaagcagcagctacccatccagccgccagatggcagcacgattccatggcccccactagccgctggctgcctggtgccggatgcagtccgaaaggcggttctgagctccaagggccggcgccgcgcgtgcctgcggtcccagctgctcgggaggcccaggcaggagaatcgcgtgaccgggagttctgcgctgcagtgcgctgtgccgatccaggtcctcactgaagccggcatcagtatggtggcctctgccaccaggccgcctagggaggggcgaggcagccccagttggaaacggagcgcgtcagtagtggcatcgcgcctgggaatagcctctgcgctccagccgggtcgacctgccgagactccgcctctaaaaccagcaaataccgggaggctgagggacgaggaccgctggagcccgggaggcggaggttgcagtgagtagctgggattacaggcaggcgccaccacgcccgggtaatttttgtgttattagtagagacggggttccaccatgttgaccaggcaggtcttgaactcctgacctcaagtgatccaccctccttggcctcccaaagtgctgggattacaggcgtgagccattgcgcctggccaaataagtaatttaagcaattttttttgtttcagaaaaaaaattaactcataaaggagcccccccgacacacacacacacacacacacacacacacacacacacacacacacgggaagcagcagtgtaattggaatgcccactgctgaggctctcgaatgagtgtcatgtgtgcacattttgcccctcacaatgcacgtcagactattaataggaagcagccgctggaatacctctggtggggtgtgtgcagcaggcagctttggaattacggtatccccaatgtgacagcaggacaatggcttcttcactggcactgtccaaccacagtgctgtggttatgtctcgaggtccattattgggcgaaggtcactgcagactcagggaggcccaggagctcaccccaaccagcttctttaccaggtgagtgacctcagccctgcagctggactcatggagacaatgacctcacccgaagatagatgacccctgtccaccgtccacacaacaactgaactggccccaggttgactcctctacaccctgcttcctactgtacccctgtcaaaggccttcctcccacccttcccactcctcttcctccctggcagcccaaccaccacaaattcactaacttgttttcaactcttacaggctgccctcctaaccctagccctgacctctgccctcctaaccccagccctgaccccaccgccctctcaggaggctttaccaatcctctgcatgttagccccacccaaggaacaggcctattttcaagcatactaactgttgggtgtgtcgcttacctatgcatatgacagccaatccaacctacctaaatgacagcacagctccatccatggatgtggctgatcacatctccaaaccatcttcccactggggacaaattcttggattttttagagacaggttctcactctgtcacccaggctggagtacagtggtgagcctcagactcctgggctcaagggatcctcccacctcaacctctggagtagctgggactacaggtgcacaccaccaccgtgcctggctaaatttttaatttttttttttttttttttttttttagagatgggggttgctatgttttccaggctggttttgaactcctatcctcaagtgatcctcccacctcagcctcccaaagcactgggattatagatgtgagccaccaatcttagcccaaatttttaactaaactcaattaaacaaatgaacaaacagaaaagactctcaaaccacacactgtcgtctctcacccaacagagacaagacgtctataaaccaccaatctgtttaaagagaccaccaaatgttcagaccatgaaactgaaagaatcaaaataaagttgtcactatgccaccaacggacaaaagccaggagcacacaaccaggggtcatactcactgaaggtcccccaccctgatggccagtcaggggcggcttgcgggtctcagagagggctcaccacctgcttgcagtcattggggatgggaaggtaagtccaacccatgccaggtcaaggcacaaagactgtggggggaatgcaccagacacataaagagatgactttattcaggctactgctatgggaagaaaactcactaatgaggaaggaggggcctggtaaataagagactcatgtggaaggctggaggcggggtcttagaatggacaagggcaaagtgctccttctggtctcactatttctcagaacgcaaaggaagaggcaatttctcagtgagcaccatttccctggaacccagggctgagatgaatttcagtactgccagcggcctccgcgttctcctgtgtgtgtaggagtttgtgtgttccagtgtgcgtgttcccactgtgtcttggtgtttctgtgtgcctggtggcatgtctgtgtgtgtatctgcagggtgaaagaccacagatactatccgaattcccgtgctcaagtgcgcctcctgccttggctttcctgagtgtggggatgacaggcgtgagccaccacgctgggcctcatgatctgtttctagtgcagtgagtgcatcttagggtgggtgcccgcctccatgcttagtagggcatggatgctgtgtatgccatctgtcggtaggatggttacacttctgtgtgttggctgatgtgtgtgtctcagtatttagtcggctctggtggcacatgtgtgtgttgcaggttgtataagttgctgtttctctgtgtctggtggaaggtgtctatggttgcagagtgagggtctcttggtgtttctgtgtgtcagagggtgtgtgtgtgtgtgtgtgtgtgtgttttgcaggatgaggtgtgttctgtgagtgtgatgtggggggtgcagggtgcatatctgtgtctacatttcttttttttcttcttcttcttttttttgagacagagtctcgctctgtcgcccaggctggagcgcagtgatgcgatctccactcactgcaaacactgcctcccaggtttaagcaattctcccagctcagcctcccaagtagctgagattacaggcgcatgccaccacgcccggctaattttttgtatttttagtagagatgcggtctcaccatgttggccaggctggtcttaaactcctgatctcaagtgatctgcctgcctcggcctcccaaagtgctgggattaacaggcgtgagtcactgcacccagcctgtctgcatttctgtctggtggtgagctatgtgctgcaggtagtgtgtttaatgtgtttctctcatgtttccgtgtatctggtggaagatgtgtgtctgcaggatgagtgtctcttttgtcggtgtatcatggattgtgtgtttgtgtgtgttgcagggaatgtgtttgtctcagtatctgagtgtgtcgggtcgtgtgcaggtgtgtgtttttttgtgtgtttgtttgtttgaaacagagtctcactctgtcgccaggctggagtgcagtggtgtgatctcagctcacctgcaacctccgcctcccgggttcaatcgattcttctgcctcagcctcctgagtggctgggattacaggcgtctgccaccacacccagctaattttttgtatttttagtggagacagggtttcaccatgttggccaggctagtcttgaactcctgatctcaagtgaaccgcctgcctcgtcctcccaaagtgctagaattacaggcgtgagccaccgtacccggccgcacgtgtattttgtatgatatatatctgcttctgactttggtgaagtgtgtgtgtcgcagggttgtgtctatcttgtggtttctatgtggcctatggtgtgtgtgctgcaatgagtctctgtcttggtgtttctgtgtctggtgatacatgttgtatgttgcagagtgagtctttttttccatttttatgtgcgtggtgtgggttgagtgtcctccatagtagtgggctggctgtgtgtgtgtcacagcgcgtctgtctctgtgagcggtgggttgtgtgtgtgtgttggagagtgagtgtttctgtctgatggagtgtcgtgtgtgtgtgtgtgttggcaggtgagtggctgtgttcctctgggcccagtgctgtgtgggcgtctgttgcagtgtgtgtgccgtctctgtgtttctgagattctgctggctttgtgtgtgcatgtctgcgtttcgggctgtgtgtctgtgttggtgtttctgagtctagaggagcgtgcatgcggcgtagggttagtgtctgcaggcctctgtgtgctgtggcctgcgtctgcttgtaaccaccaggctgggcctggtccccacattcctcccactccattgtgctctgtgctacaaaaaatatttgcgttttccaccactcataatttttcctcctcaatcgctaccagatgtgggtcctgtggtccccatccccatggcaacggaggttccagcagccgcggttcccttttgtggcgcctgccctgggagctggcactgctgtgagccccgagggggtggggagaagcgggtggtgggaggcaggaggctggaggggtcccagcagctcccttcccagcagccactggaaccctcctggggggaagggaaggctggtggtaggttggggggggtcccctgttttgtgaggcacccacaggtagagtcttcgacacctagggggcttcccagagaagggcaaggagaggtccccagaaaggcctggtcactgggacatccctgttctctccaaatcgtgctggtccaggctgggggaggagaaatagcaagagctgagggcttgggggttcagggaacagcagtgtggcatcctcatcgttctggggggtgggcaccgcctagacaagaatgtggtctgagcccctgcactgcccacccctcacccacacgcaggcactgccctgccctcgcggagcccggctgggcatctgccctcttggccttaaccccagcagcccgcatggcgcagtgcccaaacagagcagaggctttccagccacagggccatggctgggagggtgcccagctggctccagggaagcagtatggcccagaggcagggatcccacattccacgtgctgcctgtttgtgtcctgccagctgctctggacggccgacccagggcaggacgcagtctccactcagatggctgggccttctgagatgggtgacccctctaagatgggtgaccaaagttgacctccgtggggcatctggtcagaggatgagagtgtgcccaggacgagagccccaagttgccagcgtgagaccaatgagtgctgtgtggcggctgcagggtgatcagaagatcctggcagcaggggaagactttgagctgggcatcaaaagatgagatgcaggagaacaagaagaggcctgccgggcagaggcaggaggtgggaggagaacagacaggcaggagctgggggaacttagtgtggggacagcaggggccatggaaggtgagggtctgcggcttaggagggtcacttaggaggcctgcccgggagggtaggcgggtcaggagcagcgaggccgtagggcacagatggtcacagatagccaggcagccgggtctggcttgggggcaggggatctgccccgggcgctccctccgtctccctcaaccttccgcagtagcaggcggggctggcaggcaggagagtttccggctgaggacaaggaacccgttgaggcagacagcagggctctgtgcagcaggagaccggcttgtttgtgctggaggaggcccggctggagtaagcgcccgcggccccctggccgcagcctctgcaccccccgcaagctgccaccaacagctctgaggcccaagtttaacagcagcggccaggggaaaaggccgggatccgaggcaggcccatcgcctgtccctttcagtcagggactctgcctgatctgcccccacccaaccttcctccccgtgaccagtccagaatggggcaggccagatcggggccgcataaacttgataaacaaacgaagcctgtgggttgacacagcccacttccaccatggtcccgggagacccacgcctgggctccagggctccccgctgagataaggggtgggggagagtgcaggacaggtcgtcacataaagttacttctggggggcatctttggccgaagcctgcaaacaggaagtgatcagagcatgaggggaaaggcattttattaagaaagctttggccaagcccccgccgggaggagcccatcctggggcaccggccgaggggggagcagccctgctgggggcctataaatacatctcctcaggccactagagtcgcccctggaggtcccgcggcgtgtggggcagtgggaggccatcaaaaccagctgacagctgaggggcctgggcccggggcgccagggaagggaaggggtgggacggactaagcccctgaggagcggagaccagccctcctccccaggctggggtcaaccagatgcccgggagcctggccagtggaagtagccccgggctctattgggacggccaagggagggagcctccagccagaggcaccaggccctagcgggggagaggcagcccgggcagaagtgcctctggctgcaaccaatgagaaggtagccctaaccaagtccactcctggccagtaagaggcggtctttaagcggaaccctcccatctttggccaatgagacgctgtctggtcggagcgctccataactcggccaatggggagggagtcgcccgctaagcgcctgtcaggcctcgaccaacgggatgggcccttcccgccagagcacactgctccaatccaggagcggctgcaggacctgagccaatgagacgcaacctccgctagccgcgcggtgcccggccaataggaggccgcccgtgcccggtagcgtgggaggtgtggggtggcgggcggcgctgcgaagctgagggagctgcgcgcggacgagccacagcctgctacagggtgggtgcgcccgccctgcccagctcgcccgccgcctcccggctcttcttgcgcggcggcttctggatgggggtcttcttccggggggtctcaggcgcgggcaagtcggtcgccgccttctcaggccccggggtttcggtcgctgggggcgcgcgggcgggcgaggctggcggcacggagcgcttggctttctgtgggggcgccggcttttccctggggccctgcgcgcccagggccacctcggcgcggcccaggctgcgagtcttgccgcgcacgtcagcggccaacatggaggcagcctcggcgcgcttcgcgggggaccgccggcgtccgtgggctccaagaggccggggcgcggcgcgcgctcgggccctgggcggcgagggcgcagcgagggctgtcgcctcctcgggcagccccggggggcgcggcgttgggtcgcgggtccgggggctgccgtgttcgaccgtatgcgccgatttgtcgctgggcgtccgtttcctcttgctggggctgggcgcggcctcggagcctggcggcggtggtgagggcgcacggccagctgcagcggcgctgtgcttgccgtggatccaggacaccttaggcttggtggcggggtcaggtggcggcggtttcctgcgctcgggcgatggcgacagcgacaggcccccaatctcgccccgggcccgggccggccgggcctcgcgtcgggccacgcgcgcgtacagagcccctccgggcccctccacgctggacgccgaccgctcgctgtcggaggacgcggggaggggtatcgcctcctcggcggaggctggcgtggtcaagggcacaggggacggcgccggcgcctcggcagggacagtggggacttcggggtcccggctctccgctggtgcctctggcaagggaagagcagggcggtcacagccttcaggaatacctttaggggctccaacctccaggcgcaaaccttcacctttcctcctctacccacgcccttggcactgtgtcaccctggcatctagacgtgcctggcacagagcaccaaccacacatgtgtacttcagagcctcaggctatgcggctgactctgaactcaggctgtgcaaggagtgatgggcgcattcccgcgactgaagcccaaccttggcctggcctggcagccctgccccaacacccctccagccttgggcgcctgcatcatcgaatttgaggctggaacatccccacaggggttccattatccttctttaagagagaaggcttctagctgggcgtggtggctcacgcctgtaatcccagcactttgggaggctgcggtcacctgaggtcaggagtttgagaccagcctggccaatatggtgaaaccctgtctctactaaaaatacaaaaattagctgggcgtggtcgtgggcgcctgtaatcccagctactcgggaggctgaggcaggagaattgcttgaacccaggaggcagaggttgcagtgactggagatcatgccactgcactccagcctgggtgacagaggcagactccgtctcaaaaaaaaaaaaagagcgataaggcttctgaggctctgagttggtcacctgcccgtggcatctgggggcacagtcaagggaggagacagggcagaatcccagaccatcaggctcctttctgctatctgtggatcaaaggctgtgtgtggatccaactcccatactctgtggatcccttcctcctgtctcctctgccaccccctacctaagcccagaaacttctctctgcctactttcccccaggagcaaccctgggctgtggcctacccatctccccacacctgtctccggtactgagcagcagagtccagctctatggcctcagctctgtgggcaaccctcaggtaccagcatggccaaggccttcctctccatgctgcctgcccttctcctgtgtcccacccagaacacagcttttccatgggaacatttcactgggctggagtgatgcccaggtagggccttacttaccctcatggggtacacagtacacagggccttcatcagtggtgtcaaacgaggagaaggaggcccgagaggaccaggatggtgagggctgctccagccctgagggtggctccaggaagctgcagttgagtgtgttatccaggtcgtggtgggccactggggaaggatgaggcagagctgccaggggtccactctgccccagccggtgccctcattagcccctgctgtgacaaatgttgatggggtgaccaagaccagccctattcttggactgcagggggcacaggcaactcaacaggtacagtgacactgggccaggactggagaatgggtagaggtgaacccagaaaagaaacatgggcacaacatgtgttaaggtgcaaggcaagtgtgtgcatccagggagctggaaaaggttgggctgacgtgttgagaaaaggccagaaaggtgggagacggggctgaagaagacacctggctgggacaggccaccaaggcctccaagctctgttttaggccctgccttgtgcgaataaggaagccttggagcacttctgagcccaaatgcgcagtggcagggctgccctttggctcagcccatctcagcaagctgcaccctaggcctggcctccagagatgcagaccccacaacagggggccccagaagctggctagcctggcctccattccacagagggatgtggggtccactccccacacctatgtccccagatgccatgctgctaggtgggccaaggggttttctctctcttgcttgcttgctttttcttttctttcgacagttttggggtttctcctccctccctccctccctccctcccttccttctctttcttcttttctcttctcttctcttctcctctcctctcctctcttctcttctcttttttcttgacagttttgctcttgttgcccaggctggagtgcaatggtgcgatctcggctcactgcaacctctgcctccctgcaacctctgcctcccaggttcaagtgattctcttgcctcagcctccagagtagctgggattataggcatgcgccaccacacccggctactttcgtatttttagtagagaccgggtttctccatgttggtcaggctggtcttgaactccaggcctcaggtgatccacctgcctcggcctcccaaagtgctgagattacaggcatgagccaccatgcccggcttggctaaggggttttctcagctgtttccttcatctcccaagagtctgagcccccttcccctccatctttagaaataagtgggaaagagaggaagagagggtccacccaggtgcaagtcagcatggagagaagcggcacaccccacccccctatcctgttggtgggtggggaccagcctgcccactttccaggaggatctctgggtactgctggggatgtaggcaggagggtgggtcctctccgtggggcagggcactcccgtggccacgcattcccccagcagctctggccgggatatacagcattctcctacagactgggggagcctgcgggacccagatgtccacacacccctgatgcgatcactctcagggccaacgtttctgacatatgcccacatcagccggcgcacctaggactcctgccttcctaccttgcctcgccctcagcagctgccacacctcttaccttccctctggtcgcacctcctcgcgcccacgcacatcaacactcaaggtcccccatttcctcactgagatctggaccccctcacacccatttcccagcagcttcctgcgtcgagaggtgtttctcccagataccccgcgctgtcatccttacctacgactttgggtagtttctgcctccggagcgggatccggggcagcttcatgctgatgcgactgaagcgcccgcatagtcggtgcggcgccttcttcctcccaagcgaaagctccctgcgggggcggggtctgagcggaggggcggggccggggcggggcccaggggcgattagatctcggccggagccaagcacagaaggggcggggccacgtccggggcaggggcgcggaagggttggatctgggtccggtggcacccagagggtgcggcctgaacccaggcgaaagcggggcagtatctgggctcaccggcgcgtagggtccttgccgcggcaagcgcagcagcagccgagcagcgagagcagcaggcagacgagcaggacgagcagcgcgcccgcgcccatcacgcccttgcgctggttggtttctgtagggggttatggggtcagcgcggtttctggcaccccctgcattccttaacgggacgcccctcatccacttacctaggtggcaggcaccagtgaccgggtcgcacgtgtcctcgtggcagctgcaggcctgagcacagtccgcgccgtggagtccgggcgggcacgtcacgttacagctgccgggacatagggtcaaggcatgccacagccgcccccctaggatgccccctaccctcacccctcacccgcggccagggcccagggtccagggtcccagaaccgggctctctctcgctgcattcgtcgtctagggattgaagccccgccccgcccgtggcacatattgggtagtggatgttttggaaacgaatgttgcacaacactagtgggggggcctgggggataggacccgtggtggccgcgccgcagcgcccactgctggggctgactcggctaggtgggaagaggggctgctgaaccagacccttggctgtaagtggaggtccctggtccttctgtaccaactcggggtcaccttaagagcccactgacacaggctggactggtcaccagatcctgcgctgaacgtgagctccccgacatccaggcaggaaactgcccccaaagagcctactgtcactccctagctggggtaagggaccaaggctgaggtgataacccagctcagggtggagaggccacctcgtcggctggacccccctctgtggcaggtacaagcccccaaccccctcccggtcccggggcactcactggggcccgtggacgccagggctgcacaggcagcgccccgactggaagtcgcagtgtccgctgccgcagtcggcgcacacgaaggcgcagtcctcgccgtaagtgccattgctacacttggtctcgcaccttggaaagaggggaggaggcgtcagcagaaatggaggcaaacggaccacagcgccctcgacattggggcctttgttagggaggcagggcgggggactgcgtgtctgggccgacgcaggcagggctgctcaccggtcgccgatccagcccgcgttgcagcgcgtacacttgccggtgacatggttacaggcatgcccgtcgcggcatggcggacagcggtggctgcagccctcgccatagaaaccggtggcgcaaggctggtcgcacttggttccgttccagccgggctcgcacgtcaagcagcggccctcggccaccgtgcacggctgctggcccttgcactggccacacctgggggaggggtcggaggctagggaaggctgggacccgcctcacccctgtccccatcggcggcccgcccttccacctcctccctccctggccgagagaccgcgcttaccggcggcgacagcccaagccgtagaagccggcggggcacggctcgcgacagtacttgccgcggtagcccggctcgcaggcacacgtgccgtccacagggtggcagcggccgcggaagcactggcagtagcgatcgcagcgcgcgccgaacgtacgctcgcggcactgacagcggccgctctgctgctcgcagggagacgagttgcaggcgcactggttgttgcagctgcggccccaccagcctgcgtggcacaggcaggcgccggtctgtgggtcgcagcgcgacgtggcgctgcagtagcacgcgctggcgcactgcgcgccccaccagccgggctcacagcggcacgcgccgctccgcgggtggcacgtgccgtgctggcactggcacgcatgctcgcagcgcgcgccccagcgccgcgcgtgacaagtacactggcctgtcacgtcctcgcactgcccgtgtgggtggcagctacacagctccttgcagtcggggccccagaactggcgcgggcactctgcaggggaggagcggagggggtggaaggccccggtgcttgagtaggtgcccccagccagccggaacctgcccgcgtcccgcactccagccgccacctctggggacccgccccgaaggcggatccgaccccgccccaccttggaccccgccccatctctccaggattccgccccaccgaccaataccggcccgaccccacgctcactggtgtcgcagttggcaccgaagtagccgtggcggcagcggcactcgccaggcctcacgcacacctcgttctctgagcacgtggagttgccttcgcacaccgctgtggacgagacaggccagagctgctgcgcgtcctagccccgccccctcccccgccccaggtccccgggatgacccactcaccaatcccacactcgtccccttgctgcctccagccagcgcagcacgtgggcacctgggagctgcgagcagagggaggacatctaagcccgatgcccctcccccagcccccatctgctccgggctcctccgcagcctccgcacagcctccctgcctctgcagttgcgctcctgtcctaggggggtggttaatgaggtcctgccaggcagtcgtctggcggtggaggattgccacaaacagacctcaccgccaagaactttccagcccagaaccacccaccccatctcacctaactcctttgtgtcctcctcccacagccattaggcctgagaaaagtggccttggagtcccaggaaggacagcagtgaggcagcagccagggagaagaccatgggcctcaggacctgcccaaatgtgagggtctagggcatccctccaagtggagggcccagcctaatgggtgtcatggatccagatgtcatgtgatgtgacatgatgaggacggcactaggactagctgggccacagggacacacctagatgcccagttggggttgagctccagtggggaggggcagcctctggacagggggacggggggtggcatgtagacacagtgaggtgaccacttggcagaggggcttctggagggaggtggggtgaggcccacccagccactagggaaggagcaggcacatggggagtcctccacgtgcaggaggaaagtcaaactgtggcaaaagggctcagggaccagggtggaggaaggagctattagagcatctgtttatgcctttgttgttggttttgaaacagtctcgctctgttgcccaggctggagtgcagtggcacgatctcggctcactgcaacttccacctcccaggttcaagcaattctcctgcctcaaacctctcaagtagctggaattacaggcacgtgccaccacacatggctaatttttgtatttttactagagacagggtttcgccatgttggccaggctggtcttgaactctgacctcaggtgatccgcccgcctcggcctcccaaagtgctgggattacaggcatgagccagcgtgcccggcctgtttatgctgattgtcttccacttgttccatttgatttggctttacagagtacacaatgctaccgcagcacttcaggagagcacaacctctaaaaccctgggtggatggggtgtgtgagcacaaaggtttggaggccctgcctgagtgaagccatgatggctagagagggttcgtaggggatgagctggggttagcccacattcaggggcagaggaggctgagaaggaagagccaccaaggctgcgggatcctaggttcccagccgacccagaacttcgcctcgatcctaaaggcatgtaacagccattcgcactttagagaaaaggagcacgcttcttcacaagcaggcttggattcagtatctgaatctagaaccggaaggtggtggggggcggagtttgggaggaagcctgaagaccctagcgggatgggatagactggccctacaccatgcatttcaggatagtacatgcctggcatgctcctgcccaggcttccgaggatgccccagccattccccagctagacagaataccaccccttgtacagagcacctaggcctcgaggcccctcctcctgaacaaggcttggttctccttcaggccaaagatgggacctggcgaacaggaccataaaatctcaaactttggggaattggtccagtgtattttccacaataaaactggaaaccagagacaggaatacaaaggcctggcttttcctggcccctgcccccactgtctccacccacccagccctgacccagggggcaccaaggtgcccatctgcagggagacccaggtctgctggccatcacccacccacttgtgtctgcttctgaaccatgttcactggatggagagcctctgcaggtgtccctcctgtggggagctttgccaggtggcctgctggaattgccccggaagcactaacccccttctgccctggacataaggctctgtggctaggaccctcgttttagggccacactcagctgggtttgatgtctgggtttgccacttgctgtgtgacctcaggcatgcagcttaagctctttgagcttcaggctccttagctatatagtagggctctactgtagaaagattaagagagccaagatgtttttttgccgggcgtgctggcatgtacctataatcccagctactcaggaagctgaggcaagaggattgcttgagcccaaggagtttgaggctgcagtgagctgtgatggcaccactgctctccagcctgggcaacagagtgaaaccctgtctcaaaaagagagatagagataggagagagagagagacagagaaagacgacagagagaaagagagcgcgcgccaagacctatgaagtggtttggcacatactaagcacaaaggatcctgagcacaggctgcagtgcctctgagtgcactcggtcatctctggtttagcgggcacccaggcctaaccccagcagagctaatgcccaccagcaggacagagtccatttgggttcactgagaacaagatgctttccttcttggaagggctggcagaaaaggccgggtggtggtggcaagcccactctctgaagatcttacaaagacgggtggggaaagatggcctgctgcagggctgctcccacgcttgccctgtaagtcggcaagaccctcagaagccaggccataggctgggcccaggcccctcagcaagcaagacatgccgtaggcttctccctcgtagagcattagttctgtgattcaaacccactgtgagttcttacatcttcaagttggctcatggggtccatacctgtccatgttctcccccaaatccaggcagaaaagcttctctgcctgccacacccttcagaccccacaccagcccgaccctcctgctgccccgcctggacacctctcctctggtttctgtccccatcctcagatctctcttgtgtccacactagctccctcgggaagctcactgaacactgacaacaccttggaccctccagcagggctctccccatcaatgctagacttgcaaatccaactgcccaatagatgatgtcaccagaaggagacctcatgggcctcatgcccaaccagcccaaacctgaactcttgacctccttgcaccctgagtcttccctgcctcagataaccctgcctgtcctttcaggctgggaagctgagacctggagaagcatctctgactcttctttcttgtctacaccagatccattgagaaaaaagacgctgagctctagcttctaaacgatatctaaaatgggatcacttcctccttccctatcccagccttgtgagagccaccctccatctccctggctttttgtaactggccccagcttccaccccctgccccccagggtgcgaagtgtttgccacctggcagccaatcctggtcagatcccaccctttctctgtacaaagcccccagggggtcccatggccctcagaagaaaagcccaagtcttctgagcagtggcagcccacggtggcctgcccaccctcactctctggcagctcctccgccagcccctcctggactctgcccagcctcctggatccttcctgtacttccacaggccctctgccttgggaaccttgccccagacacccacagggcctccgtgctcttctgcaggcctgtgctcactcaccaccttctcagccgttctcctcagaacaccctaaaggaaacagcactccccaacccaacacctcccagctcttgctagatgtctagacacacttgcttttctggactgtgtctcctctgccacagggtcagggtctccactgcagcttccctacaccaatacaggcctggcacagtgtaggtgcataggattttactggctttgcactctcctctccccatcctcctgcctcccaggaaagggaagggctgatggaagccttgcaagatgtgggaggacaacaaagacatgacccagaccccaggtgggcagtgcccagagtggctgtccttcccatcgacccttgccactcatgaccacagcgatctccacttagccccatgagggggttgtgatcactatcccattttacagaggtggagacaggcccagagaggtcaaatgacttgcccaggtccacacagctgggtagggtggcaccaggatgggaacccaaacccaggctcggttcctggagcaggcgcctcctgggaggtctgcagaccaggggagcgggagcaaagggctctcaggctccggacagctagagcctggcaccggacccccattcctggtcccgggcctgtctgggaaagagggctggagtgagtagacagagaccacggcgatcgcgccctccccctctccaggcaccgccccgcccgccgccgccgctgcattcctggggccggggaggcccgggagtccgcggcggcggcatcgatgcgaagcagatggcgggccaggccggcccccgccccggaggcggggctcgcagcggggaggggtctgcgcgcctccggaccagagttcggaaaccccgcgctgccccctcgcagccccttgtctctggcgccgagcccctggactcggcttgccccgggtccgtggctcaggcgccccgacgcgacccagctcggagcccggcggccgcctctgcggctgccagcccgtgcggcgtctccaatccgcgccaaggcgcccccacacgcccgctcctcacccctgcgtggagatgcccttgaccttgtggcctttggccagcccaccggctcccccgaccccagctcctaactcctggcgtccggggctcacctctctgccctccgtgcaaactcccggactcgcccccccaccggccgggcctgtcgcctgcctgtcccacactggcttccccagccggcgccccacatttgcgcggccccttcttgcacccagaatccccacctggttgtcgccagggttcccacatcctccggtcccctgtgcctgtcatagtccttccgcctcccgcttctggtccacttcgagcgccggctcctcgacgctcgcctgggtcaccaccctcccacccgcgcccgctctaagacgcgaatctgtctttccaagtctggcttgctccaggacctccccggctagcaccgctcctcctcccctgaccttcctcctcactcccactcccggctccagtcggactagtgcggggctttagcacatgcagttcctttggcttgaatgcccttccccagcttttccccgtggacttcacaactcggtcaagggtccctttttccaggtctttcctgatatcccggacaacgcgtgtcatcccctgggtgcccacggcactccatcctcccctcaggtgacttctcgtccagggttccctgggatgcactgtcgtggcccatggccgaggctgggcctggaacggagccgcgctggctagggagccgaaggggcccacacttggcgtaggaaggttccggtagccccctcccaatgcccggcgccgccacaccactgcccagagcgtccctctcgccccctcccccagccaggccggctcctacccgggagcacggcacacgttgcggccgcgagggttcagttcctgaggcgccacggtgtccggcagcatccagagcagcagcagcagcagcagcgacggcagcagcggtgacggcggccccccggctccccggcgccgcgccggcccggccccccggggccctgcgccctccatgaggcgcggggcaggcgcggggcgggcacgggcgcgggtgcggccgcagcgagagcggccggaagcggagtgcgaggccgggcggggggcggcaggaggggcgccgagccgggcaggaaattccacatcggctccctgatcccgggccagccgcggccggccaggcggcagcgcccgccccgcgctccagaccccaccctccggcctagccaccgcccctccgcgcagcccccgcccccatttggccgctcgcaaacttgggggcgaacttggaggaggcccgccgagcgctggtggagggagggtccgcccgaggaatccccggttcccgcgcctttccctccgctccctagacatctaccgaagcagccgcccctgcgcgcccactgcgtaggccaggcccgggacgggaaggcggatcggggacacggacgcgactccgcaagcccacccccgctcccagcgcctcggaaccggccaagggagtggggcccgcagacagcccaggtcgaggccgaaagccaactccacagcaccccaccgcgaagtccttgtagtgctggggtgtgcggtcagctccccctgcgcactcctgcgcactcagagctcgcaaggggcggaccgagcaggatgcttgaggcctgtggtagactcggtccggaccagaggcctgggggaaggggtctccgtagggacggatgggagagatacagaggaagtagaatggccaggctgtggactgcggtaggaagtagaggtaaagacagaaggagacccccgggatggaaaccctgcagtcctagttgaggagtgaagggggctgggggagcctgggcggtggattctgctggctgtcggatttccaggagaggctggggctagagagtgggaactcctgcatcaggtaaggtgggtaacagcacagagcagaaggaaggtgtgggaagggagcaagacagagggacaggccctagggagccagcggggaagctggacttggactgggaggcagcagggtgcgggtccccggggggcaactggggcagaccgactctggaagttgggcagggagcacaaatgtcccgtgtgtagccaggtcctagtgaggatgtttgtcttttggggacttgagagctggcagaaggcctaagcagggagcgggcacctccgttctttggggagcaggccacatgcggcccacaggctcactgagggagggcaggcagactctgtccaggtgtggccagatagccccgaagggtggggctggaggagggggcttggaggaggagccactgaaaggcccaaggccatgggcatcaccaggctggcacaggcagagagtgggatggggaggagcaggcccctcactcagccatgctggtgcaggagggaggtggggtgggctgaaagagaagtggaactagtgtggacacgaatgcaactacctggggacaaataaacaggccaaccacttctgggcagctcagcctgggcacagccctgacctcagcaatgccctcccagtgctggggcccctcccacggaggatccggattgcggctcccaatagaggccagcagaggtcccagtggctgcaaggtctgtcccagcccagctcctggctttagaggcactgaccccctgggctggaggggacactcacctcagctggatggaggtcatgaataggcatatcaaattccatcacctttctccttcccccagacctgtccagggagggcaccacctggatggtgccccccaatcccccaggacctcctaaatgtcttagatctctgcccacccctgtctgccacccagagtagtctttttaatctcacatgtggctatccaccactgctctcaggatgaggaccatccccagtctcacctcacgacccggtacatacatcccttgcagtagatggcaactttgggtgtcatgggcagagccctcatttctcccaaccaccactgcacccctaggggaagactgagaagtatgggaggaatgaaggatcatccacatggcactaggatgtagaaggaacccacagacaattgaccaccacgcaggcaaactgctggagcccggagccctggcctgctggttttggccaggatggctgccagaaggaagtggactttgaaggctgaggagggttttgcatgaaagcagggaccaagagcctagccacactggagagcacaagttgggctgcctcagctccggggtatcaggtgtaacccttagaaacccagcttagccccaaggctgacagtggcagggccaggctgcgcccaactccaaggcactctccacccctccccaggctgtgcaggacctcagtgagcccttcctgcccctgcagaccagaggcctcctgcaaacctgtggctgtggctggtggctcaggtgagatgttgccagccagcatgttgtcaggacgcactggagagtggtggggcatgtctggtgctcctcctttccagaaacctctgaggtctgcaggagctattgccctggcctgccaggtggtagcagagacacaggaagtgctgggtctgagacccacagagtggggttcctactctgaacccatgctcttgcgcctcaccctcaggagaaagggagatgacactggagtgtatagccatcccgccccactagggctcaacactgggtctgccaccccaaggcaatgtcatgtttcctcaggggtactcagggcccaggacagtgaggaaggtcttcaggttacacacacacccacataccacagccctgggggcacaggccaactctgagggctttgtctctaccctcaagaatccttggggtatccatttaggagagcccagagtgactgatagtcccccgtccccatcccctctcctcccatcaaggagcacacactgcccccttctcttccgggacaggatgccagcaggaacacatggctgtccccatgctctgcccagtcaactgggaaaggatggggccttggcaagttacagccctgtctgcgggatggctctgggcacaaggctcatagtaggagtctgcaggtgcagaccctatgagggcatcaggatggaagaaagcttcgtgtggtgcagccctgcagtgaggctggtgtgggctcacagcccatccatgcagggtgcaggctaagcctggcagtctcaagagggcaagaaaagcatggggacaggtgaacaggggagggtcccagctgctgtgccagtgtggtccttgagactgggtgcctaagggttacctggcaaacctgtagcacatgcagctcccctccccagcacactcagcttcaggaggttgggaggagccgggcacaggccagaggggccccccccaccgaccccctgatgctgccccgctcccaggtgctgaagctctggttccctgaccctcaggctgagagactcctaacgagctgggctgaaactctgcgtgctgccctggttgggagacaagttccacaccagagaagacactcaagtggctgcacaaccacctgtcaccagaccagggcgagttccagctttcccactgagtgccctgttagcttgtggagtttactgtgcttccctctcaggcagggtcttcccagtgccacttggcttctggcctgggcttccacagcctctcccagatggcagctctgaccccagaagccacgcttcctggggacgcagcttgggtgcactgtggaaaggaactgaggctgtggctacagaaaaacagttaacaccttctgtaagatgctttatttcattgaccaacaacatggggtctgaaaacccagcgggaggggtctttttatcacagagccagtcccaggcgagctgatgcatctctgctcctctgcccctcaggagctctcatcctccaaccccagctgcccccacagccccaccccattcacagaaagagggctaccacgtgcctcagcccccctgcccaggctgccagctcccaggtccttttggagaaggactgatctaggcagggaggagagaaggccaacccctccagggctcactgaggaaggccaaagcctttcagaagcagttcctgcagtgacgtaatccacagcctgggatctgcatggccctgagatgcctgcggcaggctggccaaggggctggtgtgaagaaagagggcagggcccataagctgtggccaacaggggcaggggccctgcctggagtaaagtgctctggcctaggctgcgtgggtttcactgccctgcagccccagcctcccttccctctgatgccaggcacagggagcctagtcctcactggagttgtcaaactcctcccagtcagacacactcatcacctcagaggcaaagtccgggtcggcctggctgcggtcaggggtcccgcggggcggctcaaggagcagggagcggggcagggtgagcacacaggccgccaggcctgagatggagttgtccagctggggcccttcctcccagcagtccttctccacatcgtaaatgtgcacgtagcctgtgcggctgccgcggttgtgtgagcggccacctaacacatagatcctgttgtccagcacagcaatgccaggctcaccgtgcccagcagggagtgggcagacagatgaccactgtccagacgtgcagctgtagcaggccacctgcaaagccaaggctagaataaagcccagcacccactgggacgaggctgccagctcccccacaagcccactgaccaaggtggcaacagttacccaccattctgacaggtcaggccccctggaaggatggcacagggccagtgttgaaacatcctgtccatgggccaggctgctgctttctcacccagggatggccgagtctgcaggaggctgtcttttgggccctcccctagaatgatcctattctctctggctttgctccagcccagcccttcctctaggccacccggccctaagccagtctctgcccccgagtgtgtggctgtgcccccatcagcatgtggtcattccccatgtctgagggcactgcttctctcccctccaggaaacgaagctgcctgagagacatggactccactgaaatgtcttcaacctccttctgcagcactcaacacaggcagtaggacagggggaggagacagaaagtggaagtaattccttgcggagtagtcaacatcaatattctcttgtcttcaaaattgtccaaacagtaaacaaagacatggaaaaatgttcaacctactagtaattcaagaaacgcaaaatcaaaacatcagagacaaatttttcaactagcaaccactgcagagaaggaaaatcacaaaacccaatgctgttgagggtgtggtaaagccatactactatgtatctgtctgacatgccagaaaaggaatttggcaataagtattaagagccataaaaatcttaccttcttgactgattagccgtttttggttctctagctatggtgggcagaatagtggcccccaaagatgtctagttcctaatctccagaatatgctaccttaagcagccaaaggggctttgcagataggatcaagggtacaagaatacaaaaaaaaaaaggattaagggtgcagaccctgagatggggcagttttcctggattttccaggtgatccatccaattgcatgagcccttaaaagtggaaggggagaggccgggcgtggtggctcacgcctgtaatcccagcactttgggaggccaaggcgggctgatcacaaggtcaagagatcaagaccatcctggccaacatggtgaaacctcgtctctactaaaaatacaaaaatcagctgggcatggtggcacatgcctgtaaccccagctactcgggaggctgaggcaggagaatcacttgaacccaggaggcaaagggtgcagtgagccaagagcaccactgcactccagcctggcgacagagcgagactctgtctcaaacaaacaaacaaaaaaagtggaaggggaggccgggggtggtggctcacgcctgtaatcctagcactttgggaggctgaggtgcgtggatcacctgaggtcaggagtttgagaccagcctggccgacatggcaaaaccccgtctctactaaaaatagaaaaattagctaggtgtggtggcgaacacctgtagtcctcctagctactccggaggctgaagcaggagaatcgcttaaacccaggaggcagaggttgcagtgagctgagactgcaccagtgccccccagcctgggtgacaaagcaagactccatctcataaaaaaaaaaaaaagaaaaaaaggaagggtaaagccagacaagagagctgagaagtgaggaggactcaacctgccattgctggctttgaagacgaagtgtccccaagccaggaaaagtggggacctctagaagccaagaaggccctcaactgacagctagcaaggaaatgggactgcaactgccagggactgaattcttctaaccagagtgagcagggaggcagatccccactagggtctccacaaaggaaagatgccctgaccgcaccctggttttagcctggcaaggcccatgtcagaggacttatgaatgcagaataaatttatcttaagttgctatgtttgtggtgataggttactgaagcaatagaaaactaatgtgctggcccagaggatctcacaagcagaggacctgttaaaagccagatcgccaagacccaccctcagggcttccgaatcagtgggtctgaggtgcctcgtaacacagcgttcccaggtgatgcagactctgttagtctgagaatcacactttgagaactgttgcatgaacctaaggaaataatccaaaatacctgaaaagctcaacaaagcaactattacttgtcatgttatttggaatagttaaaacttagacacaagaggggatgatgaagattgagtgttaatctggaaaatgcccaggacaaaagtcactgagagaagcagaatgggatatgggatgctcttttttgtttgtttgtttgtttgtttgagacaaggtctcgctctgttgcccaggctggagtgcagtggcaccatcacggttcactgcagcctcaacctcctgggctcagttgattctccctcagcctcccaagtagctgggaccacaggtgcaagccaccatgcctggctaatttttttttgtatttttagtagagatggagtttcaccatgttgcccaggctggtatcagttcctggactcaagccatccacctgccttggcttcccaaaatgcagggattacgggtgtgagccactgtgcccagctcagaatgggatgctctttgactacaatcaggcagaaaacatacacggtcaatgctgaaaatggtcatactgaaaaacagtactgcaggggcctgattatgaatgcttttcctcacccttctctattttttttttttttttgagatggagtcttgctctgttgcccaggctggagtgcagtcgtgtgatctcagctcactgcaacctctgcctcccgggttccagcgattctcctgcctcagtcttcccaagtaactgggattacaggcgcccatcaccgcacctggctaatttttgtatttttagtagagatggagtttcaccatcttggccaagctggtcttgaactcctgacctcgtgatccacctgcctcaacctcccaaagtgctgggattacaggcgtgagccaccgcgcccggccacccatctctattttttaaagttccggcaatgtggttatattaactttataataaaagttttgttctgttgttttgttttattttgttttgaatagagacagggtctcattctgtcacctaggctggggaacagcggtgtgatcatagctcagtgaagcctccaactctgggctgaaacaatcctcccacttcagcctcctgagtagctgggactacaggtatgtgctgccagcctggatctaaaagttttgttgttgtttttttttgttttttttgagacaaggcctggctctgtcgcccaggctggagtgcagtggcgtgatctcagcttactgaaacctctgcctcctgggctcaagccatcccccaacctcagcctcccaagtagctgagagtacaggcatgcaaccacacctggctaatttttgtatttttgtagagatggggttttgccatgatgcccaggctggtctcaagctcctgagctcaagtgatcctctcgccttggcttcccaaactgcttggattacaggcatgtgccaccacatccggcctaaaagtttttaagagtaataagcaaaggtagatgtgtatgtgtgtgatactgtcatggtgacatttgtccaaacctatagaatgtgccaagagtgaacactgtggactctggttgatggtgatgcatcaatgcagtttcaacaactgtgacacatccacccctctggagcgagaggtctgcagtggggaggctatatgtgtatggggggaaaagggggtgtatggaaactgtaccttccacttaattttgctgtgaacctaaaactgctctaaaaaatagtctatttttaaaaggcacatgattcaattacattttccatcaataacaactgagaggcttgggaatgatgacgggtgtggactgccccgggccccactcacctggtgcacgtccctcctgtatccggcatcgttgttgctgcccccgatcacatacagcttgttgaggagggttgccatgccgtgccaggcgcgccgcacaggcccatcagccagtgtgtgccaagtgttgctgcctggatcgtagcagtgtgtctctttcaggtaatcctcccctctgcggccgcaggtgatatacatcttcccctccagcgtcgcgcctgcgtgggcatacacctgtgtggagccaccaggagaaatggcgtgagagggcagtgaggaagggtggctgggtactctgtcaaggccaatcaccaccccacacctgcctgacaacgctgtgaggcttcaccacttcccactcacatacagacaagaatcctccctcgattctcatgggacatactgtcctagtcattgacctctaacctcttcccaatagcggatacatctatagactcagaaatgaaatgtagcctttgtctttcctttgctcctaaagttaacatctgcatgggggaactccaagaaaataaaagcattttttccaagccagtctggaagaagccacagaaccctggggaccgctgacccaccctcagtggcctccacccctcccccactcccactggacatgcaatcctccgggcctgctgaccctgcttttaaaatgtttgtaaataatatctgacactaaactcatgatgtggggagaaaaatacacatggttcttgattctggtcctgaaccttctgtgggctttttaccctccctctgttgggctatctccatagggcccagcctgcccccatcatgggcacctcttaccctggccctaccacttccggaacccacccactcacacccagcaggccaacagaaggccccaaggcaaggccctgggtgttttgagggtagaggagcccctcagggtgtggaggctccagagctatgttactgggcaagtcactaacactgaggccatgcgggtggcaaaaacacaagagtctagagaggtggacggagcagtggggaggaagaacacacaccaagggtttggtttgggtcttctcctatcaccagtaggggtctggggaggtttttctttttttttttttttttgagacggagtctcgctctgtcaccaggccggagtgcagtggcacgatctcggctcactgcaatctccgcctcccgggttcgaatgattctcctgcctcagcttcccgagtagctgggattataggcgcccgccaccatacccagctaacttttgtatttttaatagagacagggtttcaccatgttggccaggatggtctcgatctcctgacctcgtgacccacctgcctcggccttccaaagtgctaggattataggcatgagccaccacgcccagccgaggtttttctttttaattaaacttttcattttgagataagtgtagtcacgtgtagttggaagtaaaaatacagaggtctcacgtgccttctttcccccatggtaggagcctgtgtcactatatcacagggtcaccaggatgctgacgtggacacagccacagaactgtcctatcaccaccaggatcccgaggggctgccctttagggtgacatccactcacctcccttaccctaatcccttccttaagccctggaaaccaccaatctcttctctatttctacagttttgtaacttcaagagtgttgtctgaattaaatcagtatacaaccttttgacattggctttctaccccaacccaggttctaccaggttgttgcatgtacaggttgagtacctccaaaatctgagactttttgagcacaaacacggcactcaaaggaaatgcatttcagacttttggataagaaatgctgaaccagtaactataatgcaaagattccaaaatctgaaaaaatctgaaatccaaaacacttctggtccccagcatttcagataaagggtactcaacatgtaccaatagttggttccttttctattgctcagtagtattccatgggtatctaccacagcttgtttaaccattcactgttgaaaacacctgatttgtttccagtttctggctattaccaataaagctactattaacattcatgtacagataagttattttttatttttttgagacagggtcttggtctattgcccatgctggaatatagtggcacaatcttggctcactgcaacctctgcctcccgggttcaagcaattcttgtgcctcagcctccggagtagctgggattacaggcacgcatcaccatgcctggctaacgtatacagagtagttttcatttctctgggataaatacccaggatggtaactgccagatctgttttccagagtggctgtaccatttcacattcctatcagcaatccatgagcatagtttccctgcacagtcaccagtatttcgtattttcactactttttattttagtcatcctgaggtagttctctcactgtggctttaatttgcatttccctgatagctaataatgttacatatctccttatatgcttatttgccatctatacatcctcttcagtgaaatgtttcttcaactcttttgccttctgttttttgttttgttttgttttgttttgtttgtttttttttgagacagagtcttgccgtgtcgcccaggctggagtgcagtggcacaatctcagctcactgcaccctctgcctcctgggttcacaccattctcctgcctcagcctcccaagtagctgggactatagacgtccgccaccacatccagctaattttttgtatttttagtagagatggggtttcaccgtgttagccaggatggtctcaatctcctgacctcgtgatccacccaccttggcctcccaaagtgctgggattacaggtgtgagccaccgtgcccggcttcttttgccctctttttaatggggttatttgcagtattttgccaaggttttttgtttttgagatggagtctcactctgtcgcccaggctggagtgcaaaggcacggtctcggctcactgcaacctctgcctcccaggttcaagcaattctcctgcctcagcctcccaagtagctgggattacaggcgtgtgccaccgcgcccaactaatttttgtagttttagtagagatggggtttcaccatgttggccaggctggtctctggtctcgaactcctgacctcgtgatccgctcacttcagcctttcaaagtgctgggattacaggtgtgagccaccacacctggccgtttattgagttttaagagttgtttatatatgtatttatttaatactagtcctttgtcagataggtggtttgcaaatattttttaattttgatgaagtccagcttatcaatttttctttttatggctcatgcttttggggtcaagtctaagaattccttgcctagccctagctagatcctcaagattttcttctggtcatcacgtcgcgtggccgcagggagcagacccggacagctccagagcctccgggccggggcggcggcggcgacgcttcggctcctcctgagccacctgctggacccgcaccccactccatccccacaggctggggacaggccctggcgcggctgtgtgggatcagaagcagagttgcagaatccaaggacctatttttgttctttctccgcactgctttatgggaggcattatggcccccaaagacataatgacaaatactcatgctaaatcaatcctcagttcaatgaactccgttgggaagagcaataccttctgtgatgtgacattgagtagagcagaaagactttcctgcccatgagattgtgctggctgcctgtagtgattacttctgtgccatgttcactagtgacctttatagaaggggaaaccctatgttgacatccaaggtttgactgcctctaccatggaaattttattggactttgtgtacacggaaacagtacatgtgacatggagaatgtacaggaactgcttcctgcagcctgtctgcttcagttgaaaggtgtgaaacaagcctgctgtgagttcttagaaagtcagttggacccttctaattgcctgggtattagggattttgctgaaacccacaattgtgttgacctgacacaagcagctgaggtttttagccagaagaattttcctgaagtggtacagcatgaagagttcattcttctgaggcaaggagaggtggaaaagctaatcaagtgcgatgaaattcaggtggatcctgaagaaccagtctttgaggctgtcatcagttgggtgaagcatgccaagaaagagcagaaagactccttgcccagcctgctacagtatatgcagatgcccctgctaaccctcaggtatatcacagatgtaatagatgctgagcctttcatccactatggtttacaatgcagggatctggttgatgaagcaaagaagtttcatctgaggcctgaacttcagagtcagatgcagggacccaggacaagggctcgcctaggagccaatgaagtgcttttggtggctgggggcttcggaagccagcagtctcccatcgatgcagtagagaaatatgaccccaagactcaggagtggagctttttgccaagcatcacttgtaagagatgttatgtggcctcagtgtccctacatgaccagatctacgtcattggtggctgtgatggtcgttccagccttagttcagtggaatgtctagactacacagcagatgaggatggggtctggtattctgtggcccctatgaatgtctgatgaggtcttgctggagccaccaccctgggagatttgatctatgtctctggaggctttgatggaagcaggcgtcacaccagtatggagcggtatgatccaaacattgaccagaggagcatgctgggagatatgcagacagcccgggaaggtgccggactcgtagtggccagtggagtgatccactgtctaggaggatatgacggcttgaatatcttaaattcagttgagaaatatgaccctcatacaggacactggactaatgttacaccaatggccaccaagcgttctggtgcaggagtagccctgctgaatgaccgtatttatgtggtggggagatttgatggtacagcccacctttcttccgttgaagcatacaacattcgcactgattcccggacaactgccaccagtatgaccactccacgatgctatgtaggggccacagtgcttcgggggagactctatgcaattgcaggatatgaaggtaagtccctgctaagtagcattgaatgttacaaccctatcatcaacagctgggaagtcgtgacatccatgggaacccagcgctgtgatgctggtgtgtgtgttctccacaagaagtgaccattgttggagcaccatccagagctagtgaccagtccagtggacagttagtgggagaatcaagaatcctttctagaatgtctgtttctcactatgtgcacagggtgattacaggcaccagtgcagtgatgattgtacttatttgacacatactccccctcgtcctggttgttgttcctgagaagggtgggtaacagatactccagggaaaagaatgcacattgaatggatgtgagagaccacattacctctcccactactttggggagcactttcctgtcatttctaacttaccacgtgcttggtgtactatatgtatgttgtgcctcatatgttgcaaagaactaaggtgagtatagcctactagatgtgagcaatatccagcctagatgattggaaagataccaatttaagtaaacttggtaaaatccaagtcttttttttttccaggaacaaatacattttctaatctacaggtagctaggggcaacacagttccattctaaagggaaacaaaagggagagccccacaaaactttgggggcaagggagagatactcatctgacacttcttttggaggtcagggtttgtatatcagaattgaagttagaatcagtgaattaaactgaatttgatggaatgtgagtgaacctagaacagcactgaagtattacataacctggaagactgagaagggtatattctttgaatgatctttttatttccccaaggtctttcacactggagacagcataaaagagtgaaccaatgttgggatgagagaagatgacataaatgtgggagttcagtataactggggataaactagaagtacctgtgattttacagtcatcttattgcctgccaggggtcatctagccatggcagtgttaaccttgaatgggggtgaaagcctttctttgttgaatcaaatactactacactattacacttccacactatttatttggggatggactgggagtgacagtagcctagtagttcagctacctgattactgccccattcttttagaagcacacttctgccaaggagtggtttgtactgctgtgattggtacatttagtcttttttctgctataagttttccttacctgtcctttagtgtagattttattcattacaggacagaataatcaaggacaaccaaaatccttttgttagtttcagtacctcagctatcaacatttctgagctatcattcaatgttcctctgtgtcatggagtgaaattcttgttttatgggtattgggagtgtgggaatgtgataacctaaacaacctttgctctgaaattccatttttccctctttccctgaagtgtactgacctgtactacagagttaatttcttttgtatttttttaagaaaatattaaaaatcaatggtctcaaaaaaaaaagattttcttcttctttttttctagaagttttatggttttacatttaactccataaaccattttgaattcattttggtatatggtatgagacttgggttgatatccatttttttgccgacgcatgtctaattgctccagtactatttgctgaaagatatctttcctccactcaattgtttctgcacctttgtccaaaatcatgtgtaacatgactgggcatatttactcaggtctgtgggttttccattctgtttcactgatctatgtgtctatcactgtatccataccacagccttgattactgtagctatgtagtaatcttgaaattgggcagactcctcccatcttatcgttctttttcaaaattatttgagctattctagttcctttgcctttatatatacatttcagaataatctcatttacatctaatgtcacaagtaaaatcaaatcaaaattaaaaaatttattttatttattttgaaatttattttattattattttttgagacagtctcactctgtcgcccaggctggagtgcagtggcgcaatctcggctcattgcaacctctgcctcctgggttcaatccattcttgtgcctcagcctccccagtagctgggattacaggtgtgtgccaccacacccagctaatatttgtatttttagtagagatggggtttcaccatgttggccaggctggtcttgaactcctgacctcaagcgatacaccatcctcggcctcccaaagtgctgggattacagacgtgagccactgcgaccagcaataaaaaaaaattttaggctggatgtgatggctcacttctctaatccctgcactttggccgaggcagacagatcccttgagaccaggggttcaagaacagcctgggcaatatggtgaaaccttcatgatactaaaaatataaatattagctgggcatggtggtgctcacctgtaatcccagctacttgggaggctgaggcaggaggatcacttgaaccagggaggcagaggttgcagtgagccggggtcatgccactgcactccagcctgggtgacagagcgagactctgtctcaaaaaaaataaaaataaaaaaatttttaaaaagcttattgtgcatgtaaaagaagagttcatgaaccaggaaaccccaaactggaagtggtatgaagccccaattcacagcagttacaacacagtttataaagcatgaatgaggaagaatattgttccctactgtgcatgtggagctgcataagctttctttgtaaagctatcacactgagggaggaaagcttaagtttcagttacatggctacaggcagttggcctaggggtatatccaaacctcagcttcaattttcattttcccttaatagtacaaaaaaccttcctgaaattttgataggaatactagtattcctgtattaatactatatcaatatgaggaattctgtattaatatatgtattattaattgggttgggaaagaactgacattcttactattcttactcttccaatccatggacttggtatgtctctccatctattcacatcttcttttatttctttcatcggctttttgtaatattcagtgtaccaatcctgtgaggttttttgtttgtttgttttgagacggagtcttggcagagtcttgctctgttgcccaggctggaatgcagtggtgtgatctcagctcactacaacctctgcctcccgggttcacgccattctcctgcctcagcctcctgagtagctgggactataggcgcctgccaccatgctcagctaatttttgtatttttagtagagatggggttttaccatgttggccaggctggtcttgaactcctgacctcaggtgatcccccccgcctgggcctcccaaagtgctgggattacagacgtgagccaccgcgccctgccaacatgacctatcctttttcattccccaacatctgatccatcagcaagcctgatcagtttacctccacgctacactctgaaccctcccatctccctccagctccacagctgtgtgccagcacaggctactgctgtcttcagcccagaccacgcaatgacccagggccagcctcgcttgctctgctcttgatccttgggcttccttcttctacaagcatgccccatgcttcctctcctgctcaggaaaagctgtgagcccctctcctgccctggaaggtccttctgctagactaggcagatggttagatatgagcagggaagtggactccaggttggcctcagcccctagcatggccagagggactatgacctctgagacatgttaaccacacctggggtttcaaaagtcccaacccctctttcagttaagcttatccagctcaagtaggaactaaccccacaaggaactttccacccccgggagcctgtgttgtatagtttgccccagttttgcttgcttcgaaagtaaccttttgttcactgcagtggtaaaaaacacacctcctgggtgaagatttaagatgctaatgagacatgcgataaatacactagcacgtagagccacagtgcatgcgctgctagaagaccacccaaacaaaacatgcttatgagtaacacctcttcccgcccatttatgaataatcatgtaagcctcctgtaagggaggtttcccatgccagttggggcgatcttattctggagcagcctgctctgactcggccttcagaatgtaccttcacttttgcaataaactgccttacacttatcttcgttaatgcatgtctcttgcttaaagtcttaaccaagaagacaagaaccgaggacacattcccagtaacatttcctccctctgtaaatggcaggtctaattgacatctcctcagatggacattccccaaaaagtccctctagattcatcctaccagagccccctccctggaaatcctccagttcagccccctcttcatttcacttaccataattgtaaccactttactgatctgttttctggttaagagtggtttctcctacaaggctgtaaacaccatggagtggggagtctttctcatttcttgtcaccactggattcccaggacttggtacatggtgcttagtagttgcggaatgaatgcgtgcatgaaggaacaccggcagccacgatgcagctggttgaaagccaaggctgcccctctgtggccaagctggagaactgctgcttccccagctgccgcagacaaagaaactgctaagcccctcccacaacacccacctaggaggcttcccccaacacccttcctggaacagaacccaagagccctccttgtccacttggtctcaaggacctcctgatcttctccatgcaaaatctgctcctttccccaggatgggggtacggagtgtccttccaaagaggcttccttctccccaaagaagctgagagcaaggagcaggccacagcttgcagctcacagctgcccaagagacagaaatctgtgtgggctgtgtgaatgacctggataaagaagagctggatccattgaggagacactagccctgacccctgaagtcaaagtctaagtccctgggggaattgggggtcatgagagatactggaaagaggcttacaaaggccagagctcttgctaaactccctgaggcagtgcaggtagaacctgccccccataccatcctctgcctctcaggtgctcggttatccccaaaggtgtacctggcccatagcaggtgctccacaaatgctatgccagtactagcggggtgccctgctagggtacccctagtactgctagggtatgccctgttctcggaggctgagacccaggaagtagggggccagcaaggcctgttccttccctgggatcccatgtctggttgttacaccaggcctgagtaccccaaagtcgtaagataaaagagaggcacctccctaaaacatcatttttccataatgaacataattttaaacatcttcaaattggaataaaccaaggtattatataggatgcacgtgatttttttttcaagttgtcccaatattcaaacataggatttaatataaaaaataaaaccttagagtgtttcttggctctggaaggcgccacccttcaggggacctagagggaagaggtctgaggataggccagtgagctctcagggtcccttcctgtttaacatctctggaagtgtcccagctcgtctcagctgcacaaagagcaaatgttctatccacatttgaactacaaggtttaagcagcttgccagggccaaggtggtgtgacaaggtctcagcatgtaagactcacaagtggggcacaattctgagcaatggggtctggatccttgatgagcctccccaggtggactggctgaacctcatggggcctcatcaatgcattcaatgcagggtctctggagaagcatggattctgctcactgagcctgtttctctgacctgggacaggccttgacacctaggcctctcactctttgcacatcctggggaaggaaattaggcaggagaaggcccctcttcgagggcttccttacctccctcttgagtggggccacgtatgcccaggagttggtggcagggtcgtagcgctccacagcattcaggtcattgtggtagtcacggcccgccacagcgtagatgtacctgcctacaacacacacggacaggtcggcgtgctcctgctgcagggactggatctggaaccagcggttgtgccgtgggtcatacctgtgccgagacatgaggaaagcacagcactgactaggcagggaggctgctccgcaggcttgcacctcttgttctggtcccatttctgctttgcctcagcccagcctgaaccctccccaactaccccacataccagtgcacaccgatctacagccaggcccacaggctgttacacacctgagcacaggtgctccccaccacacagcatggaaggaatggccaggagcctcctgtgtttccacctaactgtccacctgggctgtccaatggctctttttttttttttttttttttttttgtggagagaggtctctctgtcccctaggctgaagtgcagtggcacaatcatggctcactgtagcctcgacctcctgggcttaagtgatcctaccacctcagtctcctaagtagctgggactacaggtgcgcaccacaacgcccgctatttttttttttttttttttttttgatagagacaaggtcttgacacctgggatatggacttaggcaatcctcctgcctcagcctcaatggctgttcgtacagccacttccatctcacttacctcatctcatcatccacatagccttgctcccactcaggagggcctccaaatacagcctctccactggatgggtgccatcagccccctcattggcctccaagccttgaacttcccccagcactccatcaggagtggtcttctcaggcacgccctgcacacagcacccatcataccctcagctttgtcaacagccgcacacacaaggctctggtcatcgtactttcacctcctcccaccatgctgccagccccgcgtttcctgacctcccctccactcaaggtctccctctctgggaaagtggaaagggttaactcccaccctggactgcaggctctgtaagggcagggtgtgtgagattccagggacccccatgggagaaaaggcactagactggttgcggcaggcccacgagggtggaggagtctggccaggacccaaggagggctcctgggctgagcaccaacagggagcatggcctgcaatgtggagcagagatgatcacagagccatgaggggccaggacccagtgagctcaaagccagtatctgaagtgtccttgcccaacagcccacagatagttacagcctctttcagacaagtgtttttatttctgcagaggaagacctattccaaagagaacaagtctaacttcaactggctcacaagagagtaaccaaagttttctttggcctgtgccctatgctggttagtgaaaagatcagtttcatcctttgcttcctgcagcccctgcagtgtggccagcccctccccgccgcctaccaggaatgcagcaaacaggagcctcagaaggcagggccaacaagagagggaacacacacctgggtctccctgacctggtgtgaatcctgggctcttccctgtctagctgggtgtgcctgggcatcagttttaatctcttgggattcgctcagttctgcacctgtccaatgaggtgatatcacctgcctagaaaagctatcaagaagaatcataaaagacgagcatgaaaagtgtccttgttaacttgggggttctgatggatcatggttcatttctatattcctagacctcagtgtagcctctggctcaggacagattatgttctgtctgctgaatgaattaaacaaaggagtaagattaccagcaatgaatcattcattcactctaccaacattcccaggtctcccactgtggatggggcacagtgctcagcactacatccagagggagcctcaagaggtcagggccctgccttcccctgcagaatggaaacaggctaaccagagcaaatgagtgcttaatataatgacagacactgtgaaagaaagaaagggaggtaagaagatgagtgacctgctggtcagcggggcctggggagggcagagctcccttgcagtgatcaggaaaggcctcctgagaaggcagggtctgagacctgcatgacctggggcacaagccagaagaaggtctggcaggggaccagcagtccaggattggggcacagcactcacaggggccccgtcaactggctgggatggtgctgttcactgcctttcctgtgcgccttcctcctttatatacaagtctctcctctcttgtgttcagtctggctcaatcaccatctgcaccccaagtgtctgcaaccagagtgagataggaccctccatgtgctcctgtttgctccttcgagtctattgtcctcacagctttttaagctgagttcatgtggatttgtggcttcaaatttaaagacacacacagggccgggcgtggtggctcacgcctgtaatcccagaactttgggaggctgaggcgggtggatcacgaggtcaggagttcaagaccagactgtccaatatggtgaaaccccgtctccactaaaaatataaaaaaattagccaggcatggtggtgtgtggctgtagttccagctactcgggaggctgaggcaggagaatcacttgaacccgggaggcagaagttgcagtgagctgagatcatgccattgcactccagcctgggcgacagagtgaaactccatcccccaaaaaaaaaaaaaaaaaaaaaaaaaaaaaaaaaaaaagacaccaacagtgataccatatgtcaataatttagacatagccaaagttacactgatttcttatttccctgttgtgtcctgtatccctcttcttctttattgaattaattttctactttatgagaataagtcctcaagtaatatttttctaataaaaataagctttatttttgcatataaagatataaacaattttacttattgctatggactagatgtttggattcccccaaaacccctatgttgaaggcctaacccccattgtgatggtagtgggaggcatggcctttgggaggtgatcaggtcatgagggtggagccccatgatgggcttagtgcccgaggctacagctctttctctccaccatgtgagaacacagacggaaaggaccttaccgggactaaactggccaataccatgatcttggacttcccagtatccagacagtgagaaatagaggtatgttgtttaagtcactccatctatagtatttgttatagcagctgaaactgactaggagagtcactttaactcagatttgtatcatcctattgtaaactcagacatgaaccctagagttggtacaaaaatattctggaattcttgttaaattcattagactgtggccaggcacggtggctcacgcctgtaatcccagcactttgggaggctaaggcgggaggatcatgaggtcaggagatcaagaccatcctggctaacacggtgaaaccccgtctctactaaaaatacaaaaaattagccaggcgtggtggtgggcgcttgtagtcccacctactcgggaggctgaggcaggagaatggtgtgaacccaggaggtggagcttgcagtgagctgagatcacgccactgcactccagcctgggtgacagagagactccaactcaaaaaaaaaaaaaaaaaaaaaaaaattcagtagactgtttttcttctatatttccatgacttaagtattttcatgactattaatgttttaatgtctattaaattttttaaataaattaaatgtactgaccgggcacggtgggtggctcatgcctgtaatcccagcactttgggaggctgaggcaggcggatcacctgaagtcaggagttcaagaccaacttggtcaacatggtgaaactccatctctactaaaaatacaaaaaaatggccgggcgtggtggctcacacctgtaatcccagcactttgggaggcccaggtgggcagatcacctgaggtcaggagttcaagaccagcttggccaacatggtgaaaccctatctctactaaaaatacaaaattagccaggcatggtggcgtacaccggtaatctcagccactcgggaggctgaggcaggagaattgcttgaacctcagaggcggaggttgtggtgagccaagattgcaccattgcactccagcctgggcagaaaacagcgagactccatctcaaaacaaaaaaacaaaaaaacaaaaaaattagctgggcgtggtggtcggcgcctgtaatcccagctattcaggaggctgaggcaggagaatggcttgaacccgggaggcagaggttgcagtgagccgagatcgtgccactgcactccagcctgggcgacagaacgagactctgtctcaaaaaaaaaaaaaaaaaaattaaatttactttaaaatattagcagccatgaaatgccgaaggaaaaattacattattatttaaaaaattttttttagagacagggtctcactctgttgcccaggctacagtacaggggcatgatcatagttcaccgaagtctaaaactcctggactcaagcgatcctcctgcctcagccttccaagtagccagggctgcaagcacgtaccatcaggcccagctaattttttttttttttttttggtagagacgaggtctcgctttgttgcccaggctgatcttgaactcctgggctcaaaagatcctgctgcctcagcatcccaaagtgctgggattattgacatgatctgcacatagcctaaattattattttaagtagggtcagggcacatagcaacatgtaaccagctactactaggtataccatgtagttggtgttcagtaatccacagggctatggctatgggaaaggtacaaggaatgatgcagataatatagatgcaaagaaagaaggaatgaaagagaaaaagtagtatattggagacaaacaccatttgctccaagagaggaaaggtttttaaatatgcggtttctgcaccaatgctttaagatataacctggtaagtaataactcctcaaaatgcaaagcctaatttactgcaaaatcttgtttccttatattctaaaagcctatagcttttagaattcaccagttctaaggctgatgaaatgagaaagcagagaaagaaccaaatcttagaatattcaaattaaggattcatctggaagttttgagtccactggaaggttaatgatgccttcattctggagagatgatacatccctgggttaaccagtagggctgtggtccttcctgccacctccactctgtggatacctactctctcaaggcaggtcttgccgaccccacttgccattgtgatcctactctcagacaggagtttgggactggttattggttacagggtctaatattagcattacccagagttcagctttggtctcacaccccttcacaaggggaaattcagactcctactttaagtgaaagtgagatcaatggcccatagcaggtggacagaggacaggggcaggcagaatcccaagctgtcacccccctagggacagctctgtggaaacatccagcattactgccaagcacacagctgtctctaccttctgctaagggccagaagccaaaacactctggagagattggctttgcaggtctgtaggttactctcagcagggtggtctggccttggccccccaactgggaaaccgagccccctaaaaaagaaggtttaaggtttggccaaagggaagtctaaacctagtgtggccacacccactgggggcacaactttgtttagagaggaaatgaaggtagctgtttccttttttctgaaacctgcccttcctcatatttaaccacaatgtgttattgccaacctctgagtctcatcagcttaacaaaggagatcacttcctggggccagcagtagagaggtcgctgagaaatggccttctcctccttggccaggatcactatgcttgattccaagtggcatggccaggccaggccctaccccaccctgaccccagaaaatagaaacatgaacatgaactcagtcagcatctagctcatggctgctggaaatagttggcaatctctctctctccaacacagctccatctttcagcatgaagggtagggagatttctcacatgcaccaaggtaaggtggaggggtccctggaaatctaatggtagctgagtcttgtgggcctgaaccactgtcccttgctctgcccagaaatggatttgtgagatcacagcctaagtgactgatggagccaggcgcatcctacggaccacagcagtccacaaaactctctcttgggaaaactgcctcttcccaggggaaattgtgccaagtgcgtggcagactgcagggcagagcggaaatgtagcatgaggctcggtgatgcttgttggcctttaccacgcccctgggctgaagaccgcatgctgctcaggcacagcagcaggaagcctgttccaccattagcaagcaggtaagagagaagagcaaagctgactggtgaagggaaactgaaacaacatgcatcaaagctcagagagagcatgatggagggcgaggctgctcagctggcactgctcctaggtcctctccatcccagtccgactgcctttcctgctgtgggctcctctcccctcccgtctcctcctgcacaatgcactcgcaacctagcctaccccaaagaggctgagcaagggtccagggtaagtgggtttctgaggagtaggggacatgcaggaaagaaggcgatccacatgtccccttctcttatctcactgctgtccaccttctctgaattcacctagacttcattccacaatggcaagtgatgctcatgtgaaaggctggggggaacctgaccagctctctcagcccatgacttccacaccctctcatcacctgaagacaaagggaccagctagcaccctgtcctacctccagcatcgggactctgctcgaaatccttggacattgttgtcccctccaatcaagtatacgaagttgttgagcaccgcgatgccctggttggacatgcggggggccagggaggcagtgaagtgcttccactctcccagtaaggggtttagatacttggcctggtcgctgaggacagtggacggcgtggagtgaatgcccccgaagcccacaacgcactggaagtccgaccgcagctccgtttgcgggctctgcaggctgggctgtaggctctcgttccggtggtacatgagggcgctggccactgtgtccctcaaagggctggggtccagcttgtcatgcagccgctgcaggacctcagcttccatcagcggaaaccgcactgtctcaaggagctttgggggctcgtgcagcgagatctggtcagcctgcacctgctccaggctataatggtagagaagggccccctcatatacctcggtctcgcaggagacctccaggcgattgctgctgaggagggagtagaccttctccaatggaagctggcggtacttgtcagtccgagagaaggccacaaagtttttgaggatataggtgtccagttgctcagtcaggcggctcaagtcaaacagctctgccagccggtagacatcgagaatgttctcttcgtccacccaggacatgaggaaatcacagcagaaatggataatttctgggatctgcagagagaatgacacccattcaagcctgggctggtgaacagcatctgggggtgggagagagaatgatggcagaaatacgggctgttgtgggccaggcaaagcagaagggaagtcctccttaattgtccccgaccttttctgacacactggagactggggcttactgcagactaggtttaagtcctggtttggaaacatactgggtgacaggatatacagcatgtttttttttggttttgttttgcttttctttgagacaaagtttcgctcttgttgcccagaatggagtgcagtggcagaatctcggctcactaacacctccccctcccgggttgaaatgattctcctgcctcagcctcccgtacagaatgtttttaacctctctaagcctcagtctcctcatctataaaacggggatcattaaagtgaagaggaacatgatgaaaatgagagagcacataggagtggacccttgatatatgtcagttccctcttagatcaaaagtactggctcggccgggtgcggtggctcatgcctataatcccagcactttgggaggacaaggtgggtgtatcacgaggtcaggagtttgagaccagcctgaccaacatggtgaaacaccgtctctactagaaatacaaaaattagctgggcgtggtggcgcgcgcctgtaatcccagctactcaggaggctgaggcaggagaatcgctggaacccaggaggcggaggttgcagtgagccgagatcgcgccattgcactccaacctgggtgacagagcgagactccgtctaaaaaaaaaaaaaaaaaaaaaaaaagaagtactggctctccagaaaagcaggaagcagcacaaatggtcactgtgtcatatatctgtggtttggaaaggacctaagaccatccccatccctaccctaggattctctggaagagcctgcctctccaaaagcgctgggaccagaaacaaacctggctttttcccccgccagaacatccaccctggttccctagaagtgctcagagcctctcagacacctaaccaatacccacccaggaacctgatttagaattatttttcttttttctttttaaaatttgagacagggtcttgctctgttgcccaggctgcagtgccatggcaagatcatagctcaccgaagtctcaagcttctgggctcaagtgatccctgactcagggttcttgaggttcccagctgggtcaagacccacttgactccagtaagtgcaggggctcccaggtggccatatcaacccttcccagccatggggaagcactagtggtttgaaaggacggcaagagagagaatgacactggagggaggtgggaacaaggccacaaccagcaggctgttaaaggccaccctgtgaacagacaaccaaatcttgggagaataggagacaaagggaagggccctagggaaaactgcctgggagaacaaaccaggtgttgataaattatttaggaaagcaggattttagagtttcagtggggccccccagtgcccacctcctttctttccatgttcagattgaaaatgacgagtaccttgacctctctgtgacccagacagctgcaggttctcccagcaggcttgaacccaaaccaggcccttgaacattcccaggcactgataaaggcatcaaggttgttacccaaaacactgaaggaaaaactggttctggccctgagacaaattccttaaaccctcatagaaactccatacactaacccactctgtgggcaagcctgggtaaagcctctcttttcccttgtctgtcttgaggacatgctacatcactctatacataagttcccctaataaacgctctggccagatcaccctggtgtttgatgcttctttctttggaatcccaaaacggctccatttcaggatgctgtggggtcccctcttgtgggaacccccttgctaccaactccagccatgtgttcaatgcaataaatcagtttctctaaaaatgggaatacctggcttatccaggatcatcaataaattaaccattacacatggaataattctgctggtatttatgtatttatttatttattattttgagatggggtctcactctgttgcccaggctggagtgcagtggcacgatctcggctcactgcaagctccgcctcccgggttcacgccattctcccacctcagcctcccaagtagctgggacaacagacgcccgccaccacgcccggctaattttttgtatttttagtagagacggggtttcatcgtgttagccaggatggtctcgatctcctgacctcgtgatctgcccgcctaggcctcccaaagtgctgggattacaggcgtgagccacggcgcccggccaaggtatttaaagcttatcaataaacactaactataacttttttaaaattcaaaagacatctaatattgcttgcaaggtgacatgctaagagctggatgagacctaccaaatgtcaggcaggtatgtgccctacatgaggtatccccatggtgctttgctaggccctgaccagcttcacttgaccttcttttttccctttttgccagtcttctgctttgccacttcttcccaaactactaggttttcctaaaattctggtttgtcatgggccagggtcctgaagaccaagttttgggcagaatgtgagcacaaacagccctgaagaagcctgggcagcagcagctccttgagaggaccctgctgactctcctttcagtcctatttttagagcagtgggccttctgttcagtgaaatctcacagaggaaccagcctgggctcaggatgtgcaaaagccccatacgaggctcacagaagggactgcatttgcttggggtaacccaataggacagtgttactgggaatcagactcaggcctctggggacaccgtgaagaatctggtcccaggcctactgcagggcacaacacatgggggaagcctccaaaagtcactagctatgtgaacatacatgattctacaggcctatggacttgacatggttatgccaagtaaaacctgctataaaacaatattgtgaagaagcctgtttttttttgtttgtttgttttttgttttgagataagctggcatgtagtggtgtggtgatcacagcttactgaagcctccacctcctgggctcaagtgattctcccacctcagcctcccgagtagctggaactacaggtgcatgccaccatgcccggctatttttaaagtgcttctgtagaggtctcgctttgttgcccaggctgatctcaaactcctggcctcaagcaatcctctcaccttggcctccaaaagtgctgggattacaggcatgaacctccaagcctggcccagaagcctgatatgttaaaaaactaagataggctgctgcctctgagatgacctctgaggcactgggggagatgacccagggctgtcgggagcactggccaaaccaacagagagagactgcaggcctccaagctgactggtgagagagggaaagtgatgttagaaagatgatctggtttcagtgtgtgtgatcactgcagggagaagaaagaaatggcagaaacatacagatggaggccaggcaaaagggaaggaaatggaaacacagaacagagatggctacaagcaataccgagaaggatgacctgtcctcacatggacgcagggaattaagaaggtggacgggctcaaggagccactgaggttgagcccagggaactggcaggatggtcacaggacacacagagcagggggactgacaggggagctccgggagagtggcaggtgtggaggaggagataggacagctggacctgagccatgctgggggagatgtttcagaggcagctgaatcaggagttaactgctgccagggtggagaattggatgagggttcccaaagcaacaatgacagggatgtggggacagaagagatctctaaataaaagaacagggggaaattcttttgttgtaaaagccaactccatctactcaccatgcaggtatggtgagacaagtcagtcatctcagatcaacccacccagcatccaggtcctatccaccaatctgagaacagggcacagggaggctgccagggccctgtcacatggggtggcacctccacatgcccccgaacaggttggttttcctgtgacttgagttgtttttttttaattgcgtcaaacctgctctcatgggaagaaaggtcagaatgatgaacttagcatagcattttgtttcacttttaagaaatgtgggaagaggtgactgtcaactcctatcaggcctctgcctgatagctcaaaggcacctgcaggcccagtcccgtgtaactgcacccacaccactgagaataatcatccaaaacataagtcacactgtcaaagcctcagaaaactttttgaattctgcaggaaaacaagtacttaaagttcaataacaggttgggtacagaggctcacacctgtaatcccagaactttgggaagccaaggtgggagtatcacctgaggccaggagcttgagaccagcctgggcaacataacaaggccccattcctataaaaaaatatatatatatataatatcagctaggcacaatggcacgcatctttagtcccagctactcagaaggctgaggcgggaggaccacttgagcctaggaggtggaggctacagtgaactatgatcatgccattgcattacagcctgggtaacagagtgagaccctgtctttaaaaaaaaaaaaaaaataggccaggcgcagtggctcacacctgtaatcgcaacactttggaaggctgaggtggatcacttgaggccaggggttcaagactagcctaagcaacaaagcaagcctctatctctataaaaataatttaaaaattagccaggtgtagtggcacatgcctataggtcctagctatttgggaggctgaggcagaaggattgctggagcccaggaggttgaggctgcagtgagctgtgatcgtgccactgcactccagcctgggcaagagagagagagcttgtctccaataaattgaatgagtggatggatggatgggtggatggatggatggatggatggatggatggatgcatgcatggatggatggatggatggatggatgcctgccaccatggatggatgcatgcatggatggatggatagatggatggatggatggatggatggatggatggatggatggatgcatgcatgcatggatggatggatggatgcgtgcatgcatggatggatggatggatggacagacaaatagatagataaagttcagtaacaaaacacataagttttcaagagactgaagtggcccagtgaggggacaggcaggaagggccctggcagcaatgctggtggatgctccccattgccagaccccagagcacacaggacgtccacatgcagcctcgggtcagcctacctgcttatgtgcaggatgctttcaatgacagggagactcagacagtggggaaacaaccagcaatagagaagagggcaaaggcagaggcctggggtgtctagagcggctctgcttgagctccaggaacaactccagagtcttccccacttcatggccttcgtcactgcttggtctcctcacattcctgacccatcttcaagccaatgctagtgcccggcaggcatcatgggcatctcagggaaccccacctgggtgtgggtctgccttgctagatgagacatgcctcacctgaagctggcaggcagccaccagtgtctcttgtacattgctcaggctgagctccagctcggaggtgtatatgaaatgtaggatttggcacatagcattgtaggacacaccgtggatcaggacctcttcctgttccatctccttcaatcccccagcaaacattcctctgcaaagtgaagacacaagaaaatggagttataccaacagggacttaagcccatgttgccaagagtgacagcattcagagaagaacctggcgctggtggcagggccctggtagtgggctgacccactctgtgctctgagtgaactgtgtgcatgcatgagccatcccacaaaaggatcctgacgaagtctgggcagccatcctggaaattgtcctgtttcccttttcatgggcccaaggagtcccatgtgagcttcgggaggtgaggccacaagcagcttgcttctgctgtgttcatcagtgcagttcctggatcggagcagtagcaactccagagcacatttcaaagcaatgaattaattaatgggaaactaataaaagtcatttcattcaatgtatatttatggagttcctaccaaatgccaagtatcattcaaagagcagaaggaggccaggcacggtgactcacacctgtaatcccagcactttgggaggccaaggcaggcaaatcacttcaggtcaggaattcgagaccagcctggcccacatggtgaaaccgcgtctctactaaaaatacaaatattagccgggcatgatgttgtgcatctgtagtcccagctactttggtggctgcggcacaagaattgattgaacctgggagacggagggtgccatgagccaagattgcaccactgcactccagcctgggcaacaaagcaagactgtctcaaaaagcaaaacaaaacaaaaaacaaagagcaaaaggagttatagtgaagtaaactggtaaaatagctgggcgcggtggctcacgcctctaatcccaaccctctgggaggccaaggcaggcagatcccttgagcctaggagttcaagaccagcctaggcaacacggtgaaatcctgtctctacaaaaattacaaaaattggccgggcgtggtggctcacgcctataatctcagcactttgggagggcaaggcgggcagatcacctgaggtcaggagttcaagaccagcctggccaacatggtgaaaccccgtctctactaaaaatacaaaaattagctgggtgtggtggcgggcgcctatcatcccagctactcaggaggctgaggcaggagaatcgcttgaacccgggaggcggaggttgcagtgagccgagatcacaccactgcgatccagcctgggtgacacagcaagactctgtctcaaaaaacatatatacatatataaataaatgctaagaaggaacccagcagggcatctgacctgagagtcactggttagaagaggggtaggtggaatgatgagaaggagcagggaaagccccatctgaggaactgagacctaaggataaggctgagagggtgtaggcagccggggagggagttccaggtgaaggagacaggtgtacaagttctggggcaaggcagagcttggcatgcaaggcagccaagatgatgacgaagtgagcagaaagtgggatgggcaggcaggccttggagccaggtccccctacctctagggtaggtacagtccagattgaaatctgagcattatgggatgctcttgaggaatttacccacagagtgatgtgaactgactggctttccgactcaggtgctggaggaggagcccctggaagaccaattaggcctgagattcctgtgggcctggaggccaagggtgaccctggccctggggagggcattgcagctagaaagcagtagctgagactaccctgggacacggcacagagaacctactgacagactgaatctaggaggacctgggaggactcaaggccctctgctgggccgaagaggaccctttactgatggaagaaaatctggacagctgggagtcccgtgattgtgtgatcagtgtgagatacctgtgaaacctccaagtgtagacactgattaggtgtttggaggtaagaggctggcaactggggctgaagtttaaatatgacagcaacatgaagattataagagaagctatttttacattttatttatttttttgactaggtaatacatatacatgctaccagatttaaaatacagtataggttaggccgggcacagtggctcacgcctgtaatcccaggactttgggaggccgaggcaggccgatcatctgaggttgggagttcgacaccagcctgaccaacatggagaaaccccatctctaccaaaaatacaaaattagctggtcatggtggcacatgcctgtaatcccagctactcaggaggctgaggcaggagaattgcttgaacccaagaggcggaggttgcagtgggccaagatcgtgccattgcactccagcctgggcaacaagagtgaaactctgtcacacacacaaaaaaaatacagtataggttgtggtgaaagtccccttgcctctgctcccagaccatcagtcagttcccctcccagggccacactatcctcagggcagtcatattccacatctcacttggcttttttcttttttttgagacgaagtctcactctgttgcctgggctggagtgcagtggtgcgatcttggctcagtgcaacctccgcctcctgagttcaactgattctcctgccttggcctcccaagtagctgggactacaggtgccccccaccacgcccagctaattttttgtatttttagtagagaccgggtttcaccgtgttagccagaatggtcttgatctcctgacctcgtgatctgcctgcctcggcctcccaaagggctgggattacaggcgtgagccactgcacccagcccggtttttacttaacaatatagcttggagactgatccatgcccatgtacgcaagactgcctcactctttgcaaaggctgtctcactttttttattttattttatttttttaagatggagtttcgctcttgtcgcccaggctggagagcaatggtgcaatctcggctcactgcaacctccgcctcccgggttcaagcaattctccaaactcagcctcccgggtagctgggattacagtcctgcgccaccatgcccggctaatttttgtatttttagtagagatggggtttcaccacgttggccaggctggtctcaaactcctgacctcaggtgatccacccgcctcagcctcccacagtgctgggattacaggcatgagccaccgcgcccagccagctgtctcacttctttaacccatttctacaggggtatatttaggttacttgtaatttccagttatttcacatgatgaacatcctcacccttacaacatgctgagtatgcatatgccaggattaagtcccacaaatacagttgctgggtcgaagggtttacatacatttatactttgatagtattgtcaagttgctgtttttatatcattcctgatagcagggcctggtgcctgcaccctctacccccaacccaggaagacaccagctctaactcaccaccacaaaagggaaaaaccttatcacataaggtacagaaaatctccttatatgttaaagagccatttccattttcttttctgaacagttcagattcttagtcagttttctgttagactgtcttatcaatttgaagaaatctgccctttctttgatgaggagtttccccgatcttttgattttgtattgcttttttgccatgcagaaatttgtcttttttttttttttttttaaacaagtctagtcaactgcagtagtgagaaggtgaaaaagtagaacctggagttggatctgtgactgtgaacaatcaactgaggtaactcacactaccttcggaccaacctatcttcgttttcaatgttgtcaaatttaccatttacttgcctctgagttttgtgtcaaacttagaaaggctttttctttctgagattattcagaaaacatttccgatattttcctctagtgtttttattattgaatctttcacatttaaaactgttgatccacctgtaatttattttggtataaggtatgaagcaagggtccaactttgtttttctagatggcaactctgtcgtcttccctccttcctctaatttttttttttttttaagacgaagtctcactctgttgcccaagctggagtgcagcagcgcgatctcggctcaccacaacctccacttcccgggttcaggagattctcctgcctcccagcctcccgagtggctgggattacaggcatgtaccaccacacccggctaattttgtattttcagtagagatggggttatcactatgttggccaggctggtcttgaactcctgaccttgtaatccgcctgccttgggctcccaaagtgctgggattacaggcgtgagtcaccgcacccagccccttcctctaatttttgaggctatctttatcacataggacaggaatagtctcctttcgttacttttgttttcgacaatttcctggccactgctagctttttacatttgaattttagaatcaagtttctgtaattgccccaaataaaccctcttggtattttagggggttatgttaaacatctaggttaatgtagagataaatagcatttttataatggacacagtggatctttttaactgtccagccatcctctgggtccatttggaagtcttataagtcatcttcctacagatctggcacatatttgttacatttattcccagacatttcactccatgcatggccaagccctcggggcactttcccatgctctttacagtggtctgtctggctctcctggactttccaggactgtgctcgtgcatgtacttctgtctgattcttctgctggcacctctgggactatattggcagcagtggagatggcaacatttcaagcactgcccgccctgagcagggtgtgggtgcttggattgacacagatttttttttttttttttttttttttttgagacgaagtcttgctgttgcccaggctggagtgcagtggcgcgatctcggctcactgcaggttccgccccccggggttcacaccattctcctgcctcagcctcccgagtagctgggactacaggtgcccgccacgtcgcccggctaattttttgtatttttagtagagacggggtttcaccatgttagccaggatggtctcgatctcctgacctcatgatccgcccgcctcggcctcccaaagtgctggtattacaggcgtgagccaccacgcccggcctttttttttttttgtgacagagtctcgctcttgttgcccaggctggagtgcaatggcgcaatctcggctcactgcaacctccgcctaccacgttcaagcgattctcctgcctcagcctcccaagtagctggaattataggcatgtgccaccacgcctggctattttgtatttttagtagagacagggtttcaccatgttggtcagactggtctcgaactcctgacctgatgtgatccacccacctcggcctcccatagtgctggattacaggtgtgagccaccacgtctggccggacacaaacttttaccattttaagaaaaaaaaaaatcttataatcctttcgggggccaaggcaggaagactgcttgaggccaggactttaagattagactgggcagccaggcaccatggctcacacctgtaatcccagcactttgggaggccgaggtgggcagatcacttgaggccaagagttcgagaccagtctggccaacatggtgaaacctcatctctactaaaagtacaaaaattagctgcatggtggtgcacacctgtaatctcagctacttgggtggttgaggcatgagaatcacttgaacctgggaggcggaggttgcagtgagctgatatcgcaccactactctgtgacagagcaacactgtgcctcaaaagaaaaagaaaaagaagggaaaaaaaaagaccagatggggcaacacagaaagaccccatctcttaaaaaaaattagctgggcatggtggcacgcatccataattccatcaatttgaaatgctgaggtgggagtgttgcttgagcccagtattttgaggctgcagtgagctatgatgacaccattgcccagcctgggcaaaaaagtgagactctgtctcttaaaaaacaaaacaacacaaaaaagttcactgcatggatcatgaatggagggaggagaaagaagatatgagacattgtgggtgcaattaggaaaatctgaacgtggactcaatgtcagatgaaattatagaatgattacacatttctttttcatttttatgtttttagagacagggttgctacgttgctcaagttggacttaaactcctgtgctcaagtgatcctcccacctcagcctcccaaatagctgggactaaaagcactcgccatggaacatggctcaatcataaattttcttatatcatgatagtattacaggtatgtcaaagaatctcctcatccttagagaggcgaactgaagttgttagagataaattgtcatgatatctataacttactctgaagtgaatatgcaaaatgttaactgatgaatttaagccaagagcacagttgttcactatacttaactttcaacttttctgtaggatttaaatatttcaaaataaaaatcagagagaaaaaagagcccaaaagaaaaataaaatatatagtcactcctttttattgtttttctttttcaccaaaaattttaccaaatttaatttttttttttttttctgaggcagagtttcactcttgttgcccaggctggagtgcaatggcgcaatctcggctcaccacaacctccagctcccaggttcaagcaattatcctacctcagtctcccgagtagctgggattacaggcatgcgccaccacacccggctaattttgtatttttagaagagatggggtttctccatgttggccaggctggtcttgaactcccgacctcaggtgatccaccctcttcagcctcccaaagtgctgggattgagccaccaagcccgccccaaacttaattcttttttttttttttttttttttttgagatggagtcttgctttgtcacccaggctggagtgcagtggcatgatctcggttcactgcaagctccgcctcccaggttcacgcctttctcctgtctcagcctcccgagtagctgggactataggcgcccgccaccacgcctagctaattttttgtatttttagtagagacggggtttcacagtgttagccaggatggtctcgatctcctgacctcgtgatcctcccgcctcggcctcccaaagtgctgggattacaggcgtgagccaccatgcccagcctcccaaacttaattctttaaacattcatttttggggctgggcgcggtggctcatgcctgtatcccagcactttgggaggccgaggtgggcggatcacctgaggtcaggagttcgagaccaacttggccaacatggtgaaaccccgtctctagtaaaaatacaaaaattagctgggtgtggtggcaggcgcctgtaattccagctacttgggaggctgaggaacaagaattgcttgaacctgggaggtggaggttgcagtgagccgagatgatgccactgcactccagcctgggcgacagagtgagattctgtctcaaaaaaaaaaaattcatttttggctcacggcagcctcaacctcctgggctcaagtgatgcttctgcctcaacctcccaagtagttgggactataggcatgcaccatcatgcctggccaatttttaaaaaaatatattaaaaaaaaattattactacttttctgtaagtcaggaattatgtcaaaataaagacttaaaagttttaaaaagttgttcacacctcatatccattaggatgaccactataaaaaaacaacaaaacaaacaaacaaaaagtaggccggatatggtggttcacatctataatctcatgtccataatcccagcactttgggaggctgaggtgggaggattgcttgagcccaggagtttgagaccagcctgggaaacatagtaagattctgtctctacaaataatttttttaaaaaactggccaggcatggtggtgcatgcctatagtcccagctacttgggaggctgaggcagaagcattgcttgagcccaggaggtggagccatgatggtgcccctgaactccagcctaggtgacagagcaaaatcctgtctcaaaaaacaaaacaaacaaaaaaccagaaaataacaagctttagcaaggatgtggagaaactataacccttgtgcactgttggtgggaatgaaaagtggtgcaactgctatgttcctcagaaaattgtcaatagaatgatctagcaattccacttctgggaatatagccaaagaactgaaagcagagtctcagacatttgcacacccatgttcatagcagcattatacacaatagacaagagatggaagcaaaccaagtatcccttgataggtgaatagacaaacaaaatgtggtatatccataaaatggcacactattcagccttcaaaatgaaggaaatcaggtcacatgttataacacacatgaaccttaaggacacgatgccaaatgaaataagcaagtgataaagggctaatgctgtatgattctacttatgaggtacttagaatagtttaattcatagagacagaaagtagaatggtagctgccagggcctgggggtaaaggagaaaagggagttgtggtttagtgggtatagagtttcagatttgtaagataaaaaagttctggagatctgtttcgtaataatgtgaataatcgtaatattactgaactagatggtaagtgttatttgtgtttattattttagaaccacaattttaaaaaattgttcaccaagtacccagtagcaggggaatgaccaaataaatagaggacatcgacagcacggaacactccacagcacagagagtgagggccatctctactgctggtgcctgggacctccaggatgtcacaggtacagaatggcaaaccagtatgctgcctctggtgtgagatgggggagaaaaatatttcttgggtcagcttgttcaggtcctcgatcccttgtccaaactctttaaatcaagtgtattttagaattcagaaggttccaacgtgagaaatactgtacacatgccacataggatcttatatcccacgggatctgggtcggtgcctcctcttcaaacaccttaatatgccccccaaaaaagtataaagactcacactaggataaaaaatataattagcctcgaaaataattttgagttttgggtgggttccgtggcttaatgagtttacgccaaacttttttttttttttttttttttgagacggagtcttgctctgtcgcccaggctggaatgcagtggcgcgatctcggctcactgcgagctccgcctcctgggttcacgccattctcctgcctcaacctcccgagtagctgggactacaggcacccgccaccatgcccggctaattttttgtatttttagtagagacggggtttcaccatgttagccaggatggtctcgatctcctgacctcgtgatccgcctgcctcggcctcccaaagtactgggattacacgcgttggccaccgcgcccggcctacgccaaacatttctttaagacgtttggctgggccaaagttagctgagttatttcagttgattgttcatagtcagtaacagatcaaactcattcgtctctgtccccccttctcactactgcacttaactagtctaaaaaataataatagataaaaataggccgggcacggtggctcacgcctataatcccagcactttgggaggccaaggtgggtggatcacctgtggtcaggagttcaagaccagcctggccgacatggtgaaaccctgtctctttcaaaaaatacaaaaattagccgggtgtggtggcatgcacctgtactcacagctactcaggaagctgaggtgggagaatcacttgaacctggtaggcggaggttgcagtgagcagggatcatgccactgcactcccgcccgggcgacagagagagactccatctcaaaataaaaaaaaattaaaaaaaaatttttttttcttttgtaaacggagtcttgctctgtcgcgcaagctggactgtagtgggaccatcttggcttggctcggctcactgcagcttcaacctccaggctcaagcaatcctctcacctcagcctcccaagtagtggggactacaggtgtgtgccactgtgcccagctaatatttgtattttttgtagagatagggttttgccatgttgcctaggctaatctcaaactccaggactgaactgatctgcccaccccagtctcccaaggtgctagggttataggtgtgagccaccctgcccagccccaaaagttttttggtttttgtttgtttttgagagatggacccttgctatggtgtccaggctgcagtgcagtgacatgatcccactactcaacagcatgggagttttgacctggtccatttccatcctgggccggttcacacctctttttaggcaaccctgctccaggaaggtcaccatattgatgccaaatttagtgtggataccctgttggcatggcacactgcaacccagaacttctgggctcaagcaatcctccggcctattctcccaagtagctgagactataggtttgagccaccacgccctgctcaaaaaactttttaactgtgagaatggatgctgaatgttatcacatgcctgctcaccatgtctgcagatatgctatatagacacgtatgcagatatgttgggttgtcatgaattgatggaatgccatgattccctggcatgtaactagtaagacagattccctagcatgaaaccaattttttttttttgagacaaggtcttgctgtgtcacccaggctggagtgcagtggcacactcacaactcatggctcactgtagccttgacctccccaggtttaagtgatcctcccacctcggcctccccagaagctgagactacaggcatgcctggctaatttatgttttgttttgtttgtttgtttttctttttttttttgagacggagtctcactctgtcgcccaggctggtgtgcagtggtgcgatctcggctcactgcaacctccgcctcccaggttcaagcggtacttctgcctcagcctcccaagtagctgggattacaggcatgcaccacaacacctggctaatttttgtatttttttttgacctctgaactttttattggcctcctgctccccaaaggataccctgcttctggtggcttaatgtctcagaactttggtgtcattggtctcagacaccactttgccatccattatctggcaggtggtggtcttttggatggtttgcatggagttgctgctgtccagggcatcaccaagactgaagtcctcgccatcttccagcaggcggcagtaggtggtgatcttagcctccagcttgaccttaacgttcaccagggcgtcctactcctaggcctggcactgtccctctgcccggatttgtgccacctctgactccaggtgcagcaggatcccattgagctgctccatctacagggcatagaaggcctccacctccctgaggctgttctacaagctggccttcagatttctcaaggagtccaggttgatctccaaggactggacgtacgtctcaactccgtgattgtcatctcagcagttccaacctcagtggactgcatggtgaccactgtggtgctctcctcaatctgctgagaccagtacttgtccagctcctgtcgtttcttccgagccagctcatcatattgagcctggatgtctgccacgatcttggcaaggtcctgagatttgggggcatctacctccacagtcaacccagagctggcaatctggtcttgtaggccttttacttcctcttcatggttcttcttcatgaagagcagctcctccttgagagcttcgatctctgtctccagctacagctgagggacattggtgtcatcaatcactttgcgaagcccatgtatgtcgctctccacagactagtgcatgggcagttctgtctcatacttgactctaaagtcatcagcagcaagacgggcattgtcgatctacagaaagatacgggcgttgtccacagtatttgcaaagatctgagccctcaggtcctcgatggtcttgaagtaatgcctccagtctctgatctgggtcccttcttctccaagtgcttctggattttgctctccagcttccggttctcggtctccaggctcctcgctctgtccaggtaggaggccaggcggtcattcaggctttgtatggtctccttctcattctggatgcttcccattcctgccagatccccagccatccccgcggccaggcccccagaccccatgcagccctggaagctggtggagcgggacacgaagatccaggaaccagagccctcggtgcctgcatagacgctggccacgctgctgaccagccaggcgccatagctgggagcctggacagagcccagggaccagtagttggtggagaaggtagagcgagtggtgaagctcatgctgtccggggaggagagcaagaggacaggactcaggctttgctgatgacctaatttttgtatttttagtagagacggggtttcgccatgttggccaggctggtctccaactctggacctcaggtgatccacccgcctcagcctcccaaagtgctaggattacaggcatgagccaccgtgcccagctttgtttgttttttgctttttgaggcagaatctcactctctcatccagtctggagtgcagtgacgcgatctcagctcactacaacctccacctcccaggctcaagcgattcttgagcctcaccctcctgagtagctagaattacaggtgtgcaccactacgcccagctaatttttgtatttttagtagagatgggtttttgccatgttggccacactggtcttgaactcctggcctcaagtgatctgccggccttgggcacccattgtgctgggattacatgcatgagccactgtgaccagctctaatttttgtattttttgtaaacatggggtttcgtcacgttgcccaggctggtctcgaactcttgggctcaaacaatctgcccaccttggccttgcaaaacgctgggattataggtgtgagccactgtgctcagcctttttttttttttttttacgagaaaagaggtctcttactttgtcatccaagcgagagtgcagtggcatgatcatggctcactgcagcctcaacctctcaagctcaagctatcctccctcctcagcctcccaagtagctgggactataggccacgccaccatgcccagctaattaaaaaaaatttttttttctttttctgaaactgctctgaaaaaatttaaatggcattggagtcttttcataaaaggcacacctaccctggaaaacatctgggctttgtgttttgtggggaatacaactttctctctcttttggggataaagtgctattaattttttaaaaataaaatcatcaattgtatccaaacttttaaagtaacagacattgagttcagctaagcagtcttttataattcacagatggaatgaaaactaagggagggacgaggtgacccatggaggttgtataaaaaggacagagcctttgggctcttcagactataagggtccaggaggagaggagaaaccacctcagaagcatacaaggttaaagcatacaaggtgggtgtagggtcaggggagccaaagtaagtgtgcaatgaaaagttattaacaaaagtcaaaaaaagaaaatgcagtctggccatccaattcctaaaccatgtacagagtacacagaaagagcacaggaggcttcctgcagcagggcagtacagctctctgcccttcaggaaaactgagattcctccacctgggaaacagcaagggacaattagggaaagctctccagaggaggaggcatctcaggtgggccaaagaagaaaaatttccacaggacagaaaaggcagagaagaggccaggcatggtggctcacgtctgtaatccgaacactttgggaggccaaggcaggcggatcacctgaggtcaggagttggagaccagcctggccaacatggcaaaaccccgcctctactaaaaatacaaaaattagccgggtttggtggcacacgtctgtaatcccagctactcaggaggctgaggcaggagaatcacttgaacccgggaggcagaggttgcagtgagccgagattgccccactgcacttcagcctgggggacagggcgagactccatctcaaaacaaacaaacaaaaggctgggcgtggtgtggctcacacctgtcatcccagcactttgggaggccaaggagggcaaatcacaaggtcaggagttcgagatcagcctggccaacatggtgaaaccctgtctctactaaaaatacaaaaaattagccgggcgtggtggcgcacacctgtagtcccagctactcgagaggctgaggcaggagaattgcttgaacccggaggcagaggttgcagtgagccgagatcacaccactgcactccagcctgggtgacagagtgagattccgtctcaaaaaaaaaaaaaaaaaaagaaatttatgttctttgtaaaataattcagacaatgcagtaaacagaagaaattcagcctccctctccctttgccctttgctgagtccccacggtgcagcaagatccttccagatcttcatggttgggatcatcttccaccaggtcctgaggtttttcactccctatcagtagacacaccacactgcccagtttgcaagtagctccattggataacacagaaaggctctgtcctgcaccatgtctcagcactgggtgcatcgtcccacaggaatgacacctagacacccaacatacaactgcagggccctaaactatgggccagcccacccctaaatgcccttctctctacccttgcccatatcaaatattacaagcctctcacacatatttaccagtcatactgggaaaaaaatagtcctttatcattttaacatttcacaagtaactaaaacaaataataaacatgctaacacttgggaatggtctatttcttttctttttttttttttttgagacggagtttcattcttgttgcccaggctggaatgcagtggcgcaatctcggctcactgcaacctccgcctcccgggttcaagcaattctcctgcttcagcctcctgagtagctgggattacaggcatgtgctaccacgcccagctaattttgtatttttagtagagacagggtattgccatgtgggtcaggctggtctccaactcctgacctcaagttatccgccctccttggcctcccgaagtgctggaattataggagtgagccaccaagcctggcctctttctaggctcactgcaacctccgcctcctgggttcaagtgattctcctgcctcagcctcccaagtaactgggattacaggcatgtgccaccacgccccgctagtttttgtatttttagcagagacggagtttcactatgttggccaggctggtctcgaactactaatctcaggtgatccacccgcctcggcctcccaaagttctaggattacaggcgtgagccactacatccagcctcttttttgtttttttgaaacagggtcttgctctgtcacccaggctggaatgcagtggcacaatctcggctcactgcaacctccgcatcctgtgttcaagcaactctcctgcctcagcctcccaagtagctgggattacaggcgcccaccactacacccagctaatttttttttttttttttagtagagacagggtttcaccatgttggccaggctagtctcaaactcctggcctcaagtgatccacctgccttggcctcccaaagtgctgggattacaggtgtgagccaccgtgactggcctctatttcttatttatacatacacacacacacccccctgtgaaatgactctgggctcttccaataatgttgccactctcccgctccccttcccaatggaagtggagggatgcagggggtgttagtgatgcattgtaatcatcccggagagcaggacacctctcataagaggtttacccaaggggggctgtggaaagggctagaaattgctcctggaggacgtggaaagccacataaggtttttgacagattagcgaaaggctgcctacactgtcatcttcagaaagagtggtatgacactaaatcaagaagggctgagagggtgagcccaggggatcccataggctccacagcctctggccatcctctcctatacaggtcctaagtcccctgcagggggccctcagctcctctaccctacccactgtcctgtatgttatcttaatgcttattaaaggcctcagctgaatttccctggtgaactgaaagaattctgctgctcctggacacatctgcaccaagccaccactgggtcacattctccaaaactccttttggagacagaaggcacttaaaccatacatattttgcttgatagttcctaattaaaaaaatagagagagataaagagaaagagagagagagagaactacaactaagccttgaagacaaaatgattgaacagaatcagagctagaatggaacacctcaggcttggagtcccatgacaaccttgctggggaccacgagtggccctcagtccttctcaggctcatgccacctatgtgaaataagggtggtgacacccacctccttgagtgcagagcagtgcagacaacagggcaaatggtgtattgatctgctatctgtgtacataaatttattcatttaagccatgggtattgtttgaatatgtgaaaaccatgtcaggtgctagggataagagacagattccaacccagtggaaaagacagataagccagtggttcctcacactgtgccaagtgctgggatggggtcacgaaggaggccataagaaaccccagaggggccacagagctcactgggagggccagaggctaacacctgagggatgagaggtgtgagccagaaggtgatgcatacacagcaataattactgacggaggggaggaatggtaagggaggggaggagagaaaggaggaaagaaaagagaaaagaaaagagagagaaaaggaaaagaaaaggaagagaagagagggaagagaagaggaggcaaagcccaagaaacaggatcactgaatgaaaaatgaactctaagacccccttctgtctctcacacttgttgactaagtcatagccacaaggagtaggggaggctctgaggtgagcaggagaccagccactgtcaccgccagtacctttactagcagagccaggattacctttgttattcttcttacaaacagctctagtgaactcacctgaagtaatcgcaggacgcagccagcaggatgcgatgggcctcgatgtgtctgccctccaccaccagcacaacatcgaagaggattccgctgtcccggagagccagcagccctcggagcagagcctgggagtgctgtgcgctgcggtaggtgttgttcacgcagtgtgggtgtgagggctgtgcaggcaacttgcagagctgggtgaactcctgctcctctgccatcctgacagccacaagatcccttacaactgtggcctgacagttggcaaaacaggggacaggggtgagcaggcaggcatcagccccaccacacacagactggccagctctgttgctccccttgctcctgtgcctccctcaggctcacctgttttccctctatttccaaatcccctaattccttctcccctcccacctctagtccaacttcctgatggccttcttcctgatgacctgtgtgccatcatgcccaagactcttcatctcattgtatcttcttcagcggcaaagtcaaacagaagggttttgggaaacagactgacctgggttggagcccaactccacagggacttacaacatgaccaaactgagcctcgagctccccaattttaaaaagagagataaaagtacctaccccattggggtattctaaaattggtaaaacaatgaacatgaagcataagcacacaccaggttctcaagagctcttcctccctcccattgaatgaacaaaattgggttcttcctcatagtaatggatgcataaaaatggcaagacctgagtagtggtcaggagacacacagccaggagtctgggaggtgggtgccaagggggtggcatttccagggcctactttcctttactgaaattctgagagtcaagcacagtaactgtgattgaacctgatgcatttaaattcatctgcattgccttttaaattaaagattatcttctaataattgagtcagtacgttcaaaaaccgcaaactgatttgaattggagcctctaaaacctaatcagtaaaatgaacctactgcaaatgcacttttgccatggagcaaccaaaagtgactgtggatagccagctgttcaggtcagggagtggccagtcccacactgtgaggcatggccaagctgcaggctctgtaggcacagcacagtcagctacaagatgtgaacatctgtcttctccacctcacttcatcctactttcctctccccaaaatatgtttattctccaattacctccagtcatgcatcacttaatgttggggatacattctgagacttatatcgctggaggcaatttcctcagtgtgtgaacatcaaagggtacacctacacaaacctaggtggtagagactactacacatctaggccataaggtacagccaattgctcctaagctacatacttgtacagcatgttactgtagttctgaatgaaaaaaacacactgtttttcctctcctcttataccacaacaacaaacacaggagacttctgtgaccaaatgtgtgagggtttttccccattaacaagcaagcaatcaattctgccacagataccagctgggtgtcttctaattcagcagtccccaatctttttggcactagggaccactttcttggaagacaatttttccacggggtcggggaatggtttcgggatcaaactgttccacctcagattatcaggcattagctagattctctttcggagcacacaatctggacccctcacatgcatggttcacaacagggtttgtgctcctatgagaatctgatgccacctctgatctgacaggaggtggagctcaggtggtaatgctggatcaccctccactcacctcctgttgtgccacctggttcctaaccagccacagactgatacaggtctgaggcctgggggttgcggacccctgctctaattcaactctaacactacctggagacagtgtctgatcccacaggttgagggctgagtctcccaggttgtttcacctgtgcttctgaccaataggctataaattgggttcccaagatccccttcttgggttcaactaatttgttagagcgactcacagaactcaggaaaatactcatgtctactggtttgttataaagggtattgcaaaggatacagatgaagagatgcatggggccagacatgtgggaagtggtgcagagcttccaggccctctccaggaacatcactctttaggagcctccatgtgttcaactatccagaagttttccaaacccagtcattcagaatttttatggaagcttcattatgtaggcatgactgattaaatcactggccattggtgatgaacttaatcttcagcctgtctcccctctccggaggttgagaggtgaggctgaaagtcccaaccctcttatgcctgccttggcctttcctgtcaccagcccccatcctgaagctacctaggggctgctggccagcatacaaaaaggcatcactctggaaagtccaaagattttagaagttgtatgccaagaaatgagacaagaccaaatatatatttcacaatatcacagtactgaatactataggcaactgtaacacaatggaatttgtgtatctaaacacagacaaggtacagtaaaaatatgggaccaccatccttcatgtggtctggtctgtcattgacggaaacatcactgtgtggcacatgattatatatctttaaaagaaaaaatgaaaaatatatgctgatataaaacttgccaaaaagaagaggtctctctcttcactactgaggctcagggccacccccaaccccatcccctggatgctctactgcttcccatcaaacacactcagttatctgtgcctgcccctgagtctgcctccaggacctgggacctctatccagccacccacccattcctttccccctcctgggctggctcatctttctcaccaaggccccagagatggccacagccaaggtgtataccccatgaccacctctcacttaggattctcttgcctggaaactctgctctatgataattctcccttttctgacctctctctttcatcccacacaccctgctcgagcccatccttctttcccagtggttcacattcccagtttcacctacagctcagtgcctaatctagctagtagccctccaacttgtctaattttactatcaaagctaccatttccatcttggaaacctcactgttttaatatttttcctttctaacccatgtgccctatgaacctactagttctgattccttcacctctcctccatctcagacagccaccctccactcctccagggccaccactctgggtcagaccacagcagtgatgcccctaccagtttccctacctcttgtctcatcctccccaggctgctctccttcaagccttacctactcagccccatcagcagtccttagtccaaaagggatacctgtcatcccctgaacacctttagtcacccatctaggccattctgtctctcatagtcccatattggtcaaggtctagctcgattacttctccctctatcattgtacagagaacatgacaaatatgccccaccattcaaacctgcccttttttttttttttagacggagtctcgctctgtcacccaggctagagtgcagtggtgtgatcttggctcactgcaacctctgcctctcaggttcaagtgattctcctgcctcagcctccccagtagctgggattacaggcgtgcaccaccacacccagctaattttcttgcatttttagcagaaatggggtttcaccatgttggtcaggctggtctcgcattcctgacctcaggtgatccatctgccttgacctcccaaagtgctgggattacaggcatgagccaccgcgcccggcccaaacctgcctatttacccacgacaaggagattccggcttcttgaggggtgaggttttatctcacaaacatctcaaaagcccccatggctggctgtaccacttgctaatgacagactctgggcacttgtctcatatacccacgcctcagctttctcatcaccaccatgaccaccgcagagtcaagagggcctccttctctgagggtgacctccacaactaccccaatagacatcaagcccccaggtggatcctcaccttccgtgagcatagtagtgcctctgctctcttgggaagggataaatggcagctactccctaaacccatactgcaaaaacaagtacggtaaaacagaaagacatcttccatgggcaggcaaagcacatttaccaagtccaatttaagaaacttagctaggggctaagggggatatgctgaaaaatgaatcaattctctgctgggaaggagcacagcacagggtgcaacatttaaaacatttaaaaccacatctatacggttttaaatcaccaaaacgtccaccctcaggagaacagatgtcatggcacagtgatctgacagaacattaggcaacagtcaaaatgcgcaaagtggccgggcgcagtggctcacgcctgtaatcccaacacttcgggaggctgaggcggatgaatcacgaggtcaggagttcaagaccagcctggccaacatagtgaaaccccatctctactaaaaatacaaaaaaattagccgggcatggtggtaggtgcctataatcccagctacttgggaggctgaggcaggagaatcacgccactgcattccagcctgcatgacagtgcgagactccgtctcaaaaacaaaaaaacaaacaaaaaaacaatgtgcaaagtaggctgggcacagtggctcatgcctgtaatcccagcactttgggaggccaacgtgggaggatcacctgaggtcaggagttcaagaccagcctggccaacatgaggaagccccatctctactaaaaatacaaaaattagtggggcgtggtggcgcatgcctgttatcccagctactgggaaggctgaggaagggggaagctgaggcaggagaatcgattgaacccaggaggtggaggttgcagtgagccaagattgtgccattgcactccagcctgggcgacagagccagactttgccccccccccaaaaaaaaaagtgcaaagtaggctgggcatggtggctcatgcctgtaatcccagtgccttgggaggtccaggtaggtggagttcaagaccaccttgggcaatatagcgcgaccctttctctacaaaaaatttaaaaattaactaggcatggtggtgtacacctgtagtcctggctatctggggtgagacagcttggggttcactgcagtctcaagctcccaggttcaagtgatcctcccacctcagcttcctcagaagctggaacaacaggagctcaccactgcgcccggctaatttttcaaattttctttgtagagaagaggtttcactatatggtgtaggctagagtgcagtggtagggtcttggctcactgcagccttcatctcctgggttcaagcgattctcctacctcagcctcccgagtagctgggattacaagcacgtgtcaccacacccagctaatttttgtatttttagtagagacggggtttcaccatgttggccaggctagtctctcctgacctcaggtgatctgccagccttggcctcccaaagtgctgggattacaggcatgagccaccgcgcccgcccccagtctcatatccccaattttagtcatcacaagccaagttccccgttttgtactgttcgaagtttcagtggggagaagaaaggaagcttaatgtgccacatagctacaaactgaaggatacaagatgaatttttatgaagtgatggatggcagagtcaaaatcatttcagaggaactttcagttcggtacgattttactgagtagataccctcagccttctgtagggcccccgaacgagcagtatcccctcaaagaaactcaatccttggcagcatgaagcaaggtcggccacaaaggcaaagggggcggctgcggtagaggagagggagtgggtgctgattcccagcggggcagccttccaaagggtgcgctctggaagaatctcccagggagccgtcttggaggcactcggccccgcggagggccggagcgagggcgcccagtgaggagcccaggcggaaggtggcggtgccccgctgcccgccccagatccactcggctcggcccgcaccggatctaaaatggtcagaactggcagccgacgcttcgcgctctggtgattttgcactgacagcgcgatctccggctcctctcaggaaaccgggagagctggcaaggctgggctcctacggctgcagtccccgggcccgatcgagggaactgaggctcgtcaggccggccccaaatcgcccgcctgttgcaaggccgcccgctccagcgcggagggtcgcggccaggaaggccgcattcggacctgccgcaggcaacagggcccgcccgggtgccaggaggccggcgcgccagcagccgcgctgaggaggcctcgcaccctggcccctggccgagcgccagatcccggcccctacgcgcccgcgcccggggatcccgccggccgcgtccccgccacgtcaggccgcgggctctcctcaggtcgccgcccccgagcctccggcccgcgcccgcccccgcgcccctcggactccgcgccgctagcttgtccccggcccagcgatgcctgcttgccgcccgacccccgcgttcgctgccgcccggcccgttcggctcacgcctcgcagctgacctggtgccgccgccagccgaggccgcactcgcagctggagggaggcgggaggcgggaggcgggaggcgcgaggcgggaggctgggcgagaggagccggcggggcgggggcctgggccgtcacgtgggtgcgccgcgcaggcgccgggcgggccagacgtaggcccgggggttcccggcctggccgggtagcagcgcgggggcggccctggggcggggagacagggggcggctccactccggcgctctgcggaggacagcagcgatcgccaaggctcagtgagtccccgcactagcgcggcacctggcacttggcggggccgaaccaacgaatgagcgaatttgccgagagtcgccccgtctgaatccattgactctttccttgcctcggtcctaccctcattcctcgactcacttcctcctgcccttcctcactatctccctccccgctcatatcctccctctcctttcctcattcccttcttcactctcttctctcctctcttactccccccctctcattccctccctccttcactctctcattccttcccttcctatcttacccaccattcccttcctccctcactcattcactccctccctgtctccccctctcatcccctccctctctcattccctttccctccctccttaactctcgttctctcctccctctctcattccttccctccctgtctcatttccccccttctttccctccctccctctcctcttctcccattgcctccctccctctttgattcccttctttcctcctctcctccacttgttcccttcgtcacgcgctcattccctccctcccgcggcctgctccttccccgctccctccgcggtcggtgccgctgaccgtagcgcgccccctgcgggatatcggggagaatcgcttaacaccgccagagtgaacaggtgctagtttgtgtgcccgttcctttactgagattttgcagtaaatctaattcccagtcttaaagcctggtcccagaggtccgtgcgcgggtcttggcattcattgttctccacctcaccttcgagcaggtcccatcctccgaggcgtatccgtaatggctgcgcccagagcttggagccacagagcctcctgatgggataaggttggagtgtcccacactgtggttttgagagggactgtgaagggtggagagagtggtagggggaggatgtggctggagatggctcatggttaaaaagaaaggtggggccgggcttggtggctggcgcctgtaatcccaacactttgggaggccgagacgggcggatcacgaggtcaggagatggaaaccatcctggccaacatggtgaaaccccatctctaccaaaacacacacaaaaaaactagccggtcgtggtggcgcgcacctgtagtcccagctactcgggagcctgaggcaggagaatcgcttgaacccgggaggcagaggttgcagtgagccgagatcacgcgccactgcactccagcctggtgacagagcgagactccgtctcaaaaaaaaaaaaaaaaaaaaaaaaaaaaattggtggaaggggaatgtaaaaggaggaaaatacacggaagagaattgctgtcctggctgagtccagagagataactgagggtcccagacaaggatcaagagaacgggattggcctccagaggcagaggttccaaatgggagtgggcttcctcctagaaagactttctggaggagacccccctactgtgtaacagaggaggactttgggattaagaaaagcattccaggaagccgacagtgtcagcaaacgtggaggtgagatccttcaaagtgagtggtgtggaggtttccagaattttctgagcctgaagggaaggttggagagcagaccctgccctttggaggcttgacttagccctgagggcaccctgtagccagggtgggcagatgccaatatggtagagacgaagactgagtagggagccagccacagtgctgtggtctcaggcagggagtgaagaccagagtggagcaggctagaaacctgggaaggaagcaggttccccagtataagcccagtgatgtgtgaagaatgagcccaggagatgggtggggaagtaggcccaccctgcctacaggggagccagagcaagagcaggtctgggggaagatgaggccccccttggctccaggtaggggaagactgacctccaaggcccaatgggaccaggtgtacgggtggacccagagaggagaggaaaaggaatcctggggcagcaacaagaaggccactgtggtctgaatgtcggtacccccaaaattcatatgttggaactgaatcctcagtgcgatactattataaagtagggcctttgggaggggtttaggtcatgagggtgaagtcctcaccatgggatcagtgtataaaagaggttcgaaggagctcatcccccacttttgccaggtgaggacactgtaataagcaccatcttcaaggcagagaatcggctgggcgcagtggctcacgcctgtaatcccagcactttgggaagccgaggtgggaggatcatgaggtcaggagatcaagaccatcctggctaacatggtgaaaccccatctctactaaaaatacaaaaaattagccaggcatggtggtgggcgcctgtagtcccagctacttgggaggctgaggcaggagaatggcgtgaacccgggaggcagagcttgcagtgagctgagatcgcgccactgcactccagcctgggtgacagagcaagactccgtctcaaaaaaaaaaagcagagaacggacccctcactagacactggggcttttttctgaaggctactgtgtcatataaaatttatattaaataaattgatatgcttttctcttgttaatctgtcctttgttagaggggtgtcaaccaggaaccttgtgatgcgtgaggaaaaaatattaccttttccccctactctttctggcacccaacaaacaagtggggtggcaaagacaccccacttgggacaactggcaaaaggtaagcattcttaccaaggttaactgtcccatatcactgcctgtagtactcagctgagagtggaaggtaaaaacttcttgtcccttcctttccaaattcaaattagcagaagaaaacattgtgtctggattgtgactcttgcttaaatttggttgaggggtaactgtttgttattgatcctttcctcccaggcacagctacctctttcctgtttgttttatttgtgtcctgagagcttggctttatgaccagtgagaatattctccctgatctctgaatagccagtgggtgcaagtgacagcttgctttaggacagcttgcgttagggttgcaagtaacagcttgcattattacaaactcctctgtcccggtcagaaaaagagaaagtttggtttttgtttgtttgtttgttttttgttttgttttaatagtcttgctctttcgcccaggctggagtgcagtggcatggtggcatgatcttggctcactgcaactgctgcatcctgggctcaactgattcttctgcctcagcctcctgagtagctgggactacaggcacacactaccacgtccaggtaattttttttgtatttttagtaaagagggggattcatcatgttgcgcagggtgattttttttttttttttttaattcttttctgagacggagtcttgctctgtcacccaggctggagtgcaatggcgggatctcggctcagcctcctgagtagctgggattacaggcacctgccactacgccagctaatttctgtatttttagtagagacagggtttcaccatgttagtcaggctggtctcgaactcctgacctcgggtgatctgcccacctcggcctcccaaagtgctgggattacaggcatgagccaccgtggctggcctcttttatttttaagatacagggtctcacccaagctggtcaggaactcctggcctcagtccacctgtctcagcctcccaaagtgctaggattacaggcatgagggaccacgcccggccaaagagaaggttctgaaccttctctttttctgaccatgacagaggagtttgtaagtgggccaagtctataaggggtttttgttgtctcagtattcattggtgtgatagatgagccagtccatgactggagacgtgacagtgttctgtacaagatgacatccttagtcacctgtgtcaacaaaggtgccttctggctaggcacggtggctcacgcctataatcctagcactttaggaggctgagccaggcaaatcacgaggtcaggagttagagaccagcctgaccaacatggtgaaaccctgtctctactaaaaatacaaaaaaattagccaggtgtggtggcgcatgcctgtaatcctagctattcgggaggctgaggcaggagaatgggttgaatctaggaggcagaggttgcagtgagccaagatcgcgccactgtactctagcctgggtgacagagcgagactccgtctcaaaaaaaaaaaaaaaacccaaaggtgccttctttcttttgactgtctttgcaaggggtctggatttgagagtgctgaatctttgtgcaccctctttggagtgtgtctttctctctctctctctctcttttttaagagacagagtctcacccagactgatcaggaactcctggcctcaggtggtcctcccaccttgacttcccagagtgctgagattacaggcatgagccattgtgcccagccttgaggatgtctcttttgtccatggttaagtcataaaatgcttattggtcttggttctgagttgcttggtaggtacctttggtttacaagaagaaaagtggtgggtgggcagggtggtagtagggaagagtgttcagtactgccaggaatatgtactatctgttctggctgaaaactgacaatgagatatttgaaaggattttttttttttttacagctctatgatcagaagatggcataagtggggctgggcacagtggctcagtgcccagctgggattacgcctgtaataccagcactttgggaggccaaggtgagtggatcacgaggtcaggagttgaagaccagcctggccaacatggagaaaccccgtctctactaaaaatacaaaaaattagccgggcgcggtggcaggtgcctgtaatcccagctactcgggaggctgaggcaggagaatagcttgaactcagagggcggaggttgcagtgagccaaggttgcgccactgcactccagcctgggcgacagagtgagactccgtctctaaaaaacaaaaaagaagatggcgtaatcagaagttgatattctgtctattggatcctgcttctcccctggggtcttcttggttccctgaagcccctcttccggagtccctgccctctatcggctctgcctcctgcttcttttctgtattgccatgatttttgctaaggataaaggacaacttcattggcttctttgggaaacttgcaatctccccaaacaggcccctctgagatttctcctttccatttgcttctgctcccccttcctccttttgccaccttcgatattttctccagtttccttgattcctttgatacgtccccattcaggccactctggccctccatccaacctgccagaactttttccacttcagcacttcagtcacttaaacattagggctccctgccctaaagggactcaaaatcctgcaaaaacaaccacctaaggataaaaagagaaaaaatgaaactgtttggaaactgggcaaatgaatactcttttaaaagtctttttctgggggccaggtgtggtggctcacgcctgtaatcccagcactttgggaggccgaggcgggcagatcacaaggtcaggagttcaagaccagcctggccaatatggtgaaaccccgtctctcctaatgatacaaaaaaaattagccaggtgtggtggcattcgcctgtagtcccagctacttgggaggctgaggaaggagaatcgcttgaacccgggaggcggaggttgcagtgagccaagattgcaccactgcaccagcctggcgacagagcaagaagactccatctcgaaaaatatatatgtatgtatatatacgtatttacgtgtatatatgtatgcatacatatatatatatatagagagagagagaaaccagtgagtttgtattactgtgttttactgactcacgactaccattttggaatgaaagctataagatctttgtgtttttacgtttatgtgtttatatttgtgtatatctatgtatgtatgtttgaatattatatataatattttttctatctccatattcagtattactaactgaatttttttttttttttgagatggagtctcactctgtcaccaggctggagtgcagtggcatgatctcggctcactgcaacctccgcctcccaggttcaaacaattctcctgcctcagtctcctgagtagctgggactacaggtgcgagccaccatgcccagctaatttttgtatttttagtagagacgaggtttcaccatgttggccagcatggcctctatctcttgacctagtgatccacccacctcggcctcccaaagtcctgggattacaggcatgagtcaccacgcccagcctaaattttttaaatcccttaaaggagttatattcaaattgtaccctcctttgaagatgtctcttttgtctgtggtgtcttaaaaggattattggtcttagagggaggtaaataagcattcatacaagctaaatattaccaaaaatttaagaaaaatagaaactaatccaactgctttttagtttacatgatctggaatattctttagtaaataaagctagtttgaaaattgatggactacgccgggtgcagtggctcaggcctgtagtcccagcactttgggaggccaaggcgggcggatcacgaggtcaggagatcaagaccatcctgactaacacggtgaaaccctgtctctactaaaaatacaaaaaattagccaggtgtggcagcatgggcctgtagtccccagctacttgggaggctgaggcaggagaatggcgtgaacccaggaggcggagcttgcagtgagctgagatcacgccactgtactccagcctgggcaacaaagcaagactccgtttcaaaaaagaaaattgatggactagtcaaacaagttttatgttatcactactgaatggtaaagataataaaactatcaatccaacctaagagcaaaatgtgcaataaaaatgaattgcggctgggctcacccctgtagtcccagcagtttgggaggccgaggcgggcggatcacctgaggtcaggagtttaagaccagcctggccaatatggtgaaacctggtctctactaaaaataaaaagtaaggccaggtgtggtggcgggacctacctgtaatcccagctacttgggaggctggggcaggagaatcgcttgaacctgggaggtggaggttgcagtgagccgagatcgtgccactgcactccagcctgggagacagtgcgagactccatctcaaaaaaaaaaaaaaaaattgggcacggtggtacaagcctgtaatcccagctacttgggagtctgaggcaggagaattgcttcaacctgggaggcggaggttgcaatgagccaagatcgtgctgctgcactccagcccaggcaacagagtgagactttgtctcaaaaaaaaaatgaattgcatggcttggcgcggtggcccatgcctgtaatccagcactttgggagactgaggcaggtggatatttgaggtcaggagttcgagaccagcctagccaacatggtgaaaccccatctctactaaaaatacaaaaaattagccaagtatggtggcgtgcgcctgtaatcccagttacctgggaggctgaggcagaattgcttgaacccaggagctggaggttgcaatgagccaagattgcaccactgcactccagcctgggcaacagagtgagactccatctcaaaaaaaaaaaaaaaagaaacaataaccactccctccctacctccacatacataagtgattacaggctccaggccaaacacacagaggagttacatctggctggtgctaggatggaaggtggggcaggtcaccacctcccagggactgagtgccaaagcaaggaggaagattggaggtgaggctgtatggagacagccacaggctcacagagcttgtgctgagctctctagggggaagcttgatctgcctgggaagcttccagctcctacctcctgcagagcccagaatggtgtccaggaaatatgtggccattgagtggaaccagccttggcatggtagcctgcaggaacccgcaggctagagacatggccacatgagcagtgaggatctcccccgagatgaggatccccagaacatagtgtgggatgcaggtctggcctctgcataccctcggcttcctccatcacttattctcagacatctaaaccactaacatccagactggggatcccaggagggtctacagtgtcaagagagggcaagtccacttcaggatcaaccttcctgtggccccttactttccttggtccacctttccaggtcacccatccagactgtcaccagggatcactgccctgggcaccaacccaatgcggggacaagtagaaaaagagctctggggaaaataccaaagggaatagtcactcaattttactgtgatgataaactcctggcaaagttccaggcctctctctgtctgtgtctgtgaattatgtgtctgtgtctccatcaaccatagtgcagaagggggagggttgtcctaagtatcctattaacatgtttgtttgtttgtttgtttgagacagagtttcgctcttgttgcccaggctgcagtgcaatggcataatctcagctcactgcaacctccacctcctgggttcaagtgattctcgtgcctcagcctcctgagtagctgggattacaggcacacaccaccatgcctggctacttttgtatttttagtagagacggggtttcactatgttggccaagctggtctcgaactcctgacctcaggtgatccacctgcctcagcttcccaaagtgctgggattataggcgtgagccaccatgcccagccagaacacaggactttcaaaacttaaacctggggctgggcacggtggctcacacctgtaatcccagcactttgggaggccgaggcaggcggatcacctgtcaggagttcaagaccagcctgggcaacatggtgaaaccccatctttactaaaaataaaataaaataaaatacaaaaatgagtcgggcgtggtggcgcactgtagtcccagctactggggaggctgaggcacgagaatcacttgaaccccggatggcggggactgcagtaagcgatcacgccactgcactcaagcctggcagacctagcgagactctgtctcaaaaaaaaagaaaacaaggctgggcgtggtggctcacgcctgtaatcccaacactttgggaggccaaggcgggtggatcgccaggtcaggagattgagaacatcctggccaacatggtgaaaccctgtctccaccaaaaatacaaaaattagccagatgtggtgccaggtgcttgtagtcccagctactcaggaggctgaggcaggagaatcacttgaacctgagaggcggaggatgcagtgagctgagattgcgccactgcactccagcttgggcgacagagtgagactctgtctcaaaaaaaaaaaaaaaaaaaaaaaaaaaaaaaccaagggccgggcgcggtggctcacgcctgtaatcccagcaatttgggaggccgaggcaggcggatcatgaggtcaggagatcgagaccatcctggctaacacggtgaaaccctgtctctactaaaaatacaaaaaaattagctgggcgtggtggcgggcgcctgtagtcccagctacttgggaggctgaggcaggagaatggcgtgaacccgggaggcggagcttgcagtgagccaagattgtgccactgcactccagcctgggcaacagagcaagactccatctcaaaaaacaaacaaacaaacaacaacaacaaaataaaacaaggaaaaaaacactaaaaccttggatgtcctgggcaaccccggtcaagatgatcactctagatagagtttttaaaaattagttttcagcctggccaagatggtgaaaccctgtctctactaaggatacaaaaaattagctgggcttcgtagcaggcacctgtaatcccagctacttgggaggctgaggcaggagaatcacttgaacccgggaggcagaggttgcagtgagccgagatgtcaccacagcactccagtctgggcaacagggcgagactccatctcaaaaaaaaaaaattagttttgccaccgggcacggtggctcatgcctgtaatcccagcactttgggaggccgaggtaggtggatcacctgaggtcaggagttcgagaccagcctggccaacgtggtgaaaccctgtctctactaaaaatacaaaaattagccaggcatggtggggtacgcttgtaatcccagctactggggaagctgaggtgggagaattgcgtgaacccgggagacagaggttgcagtgagccgagatggcaccactgcactccagcctggccaacaagggctaaattctatcccccccccctcaaaaaaaacaataacgattttgggagtattagagcagaaaacgtttgaaaacatgaacagctctcacatcaacacaagacatgaaactctgttggcaagagaggcctctttggggagagtgctcactcctctcccacccactctctaccaccttcaacctcctgtctggggcacagtaacaaggggtgtaaggggtgtacagtgcctagcaggggcctggcacttaggcttcagtaggtgccagtccacagtctcctgaggcccatgttggttggtgtccacctggtgcttattgaccacttgggctccagattttcctcacgtcacctccctccccagggtagcagataaaggccccatagttccaaggaggcagaacttttacattcctaaaagcattctcaggcccccataacccctcatcccaccttcagctcgctcaccttcacctatcaaattcgtttgacatctggcctccagcaactagctaggctgagttctccatgaaggggacgtggctgctggtcaaaagggaaagcccatgtctaaaaattaattaacgtggtttaggggcctcacattcccaacccccaaatacagccattgtgagatgtgagattcaaaaaatcgaagagtgaagcggtgatgagagtccatctggtcgctcttcggatgcggcgctagcaggcagttgcatgaaagcagatcccagatcacgttgcactggcacacagtaggtacccacacatatttgataaataaacactctctccctagcattactatagatagctggcagcttggcctggcatcccggaggggtctggatctcagggactagataaggccagcacactgaagagttgcagaaaatgcaggcggtcaggcgcaggtctgctgcgggagcacctgccgtgtccgacagctgcactggaagaggggcgtgtgtctcccagccgggcggaaccgagaccgcttcgtccccggcggggaacttcatttcccacaagcctgtgcgcgagactccatttcccacaagccctccttcacttccggctcggccgaggcactgcggacggcttccgggtttgggcctggctctgtgactgaggcggcggcggtggcggccaagcgggatacgggcggcgggagctggggaacaggcatggacgtttccgggcaagagaccgactggcggagcaccgccttccggcagaagctggtcagtcaaatgtgagtagtggtcggggcagggggctggattgtgggaccttcctccttagcgtggcgggcgaggccagggccggacccgtgagaaacctacggcgccgggagacagaaggcgccggggacttgcgtgggtcccagggctcgggcccccccgtctgtcccctccgttcccgacatggactgctcgtttgctttcctggggccgagctctgcaaaccaacgagccctggcttatgaatcatcgtcttgagctttctcattcgtcatttgtgtgctttgggtgcagactttcccccgctttttgaaccacactgaatagggaaagggagagaagcagccggctgtagtgggtttagcagggctgggtgcttcatggtttctcttccagaaaagcgcatcaacggtgaaagaaagtgatgggaggagggtggatgtaagatgagattgggaaggtagttgtttggggtgtgggcggtgggacggaggatctgagggtgaccccccgaaggaatgtggactttgccgaaggatggcaggaagccgctgtcaggaagcgatcgtcgtttctggaggagagcgtgaagagctggggtcagtggccccgctcagaggaactctagcccctcaccaccgactgcttgtttctgttagcagtttttttcatgcgcgtccgtgtgaagagaccaccaaacaggctttgtgtgagcaataaagctgtttatttcacctgggtgcaggtgggctgagtccgaaaagagagtcagcgaagggagataggggtggggtcgttttataggatttgggaaggtaatggaaaattagtcaattgttctctggtgggcagggatggatctcacaaagtacattctcaagggtggggagaattacaaagaaccttcttaagggtgggggagattacaaagtacattgatcagttagggtggggcaggaacaaatcacaatggtggaatgtcatcagttacggctgtttttacttcttttgtggatcttcagttacttcaggccatctggatgtatacgtgcaagtcacaggggatgcgatggcctggcctgggctcagaggcctgacagtttttaactgagcttattggcgtgttgtgctcgccacagatttgcctgagacacagcccctttcctgagggatggtaaaggaaccgtcacagcgcagtcttgtcagtctgtaatgtgtatactgcaggggtttcttgcgaagcggcggttaacttgagcagaccaggggcagtctagtgagtaggtgacgaataaattgagtcctagaaagacaagtaggagtgtgaatagccaccattccaagctgaggagttaggaaacatgagcatttactgcgtggagggaggatcttgtaggctgagagttctggggctcgaggagtaagagagcccaggagatgatggaatgagggtgagcaggtactagcactttagtgggggtgttgtgccaaggaattgagcctgtgtttggcatgtggcattctttggagtagtgaaatgccagtgttgggaatatgcctagagtccctgtccctggagatggatgcagggcagagaagagagaccagttaagctattaagagagtttgaacatttggagggagtagggaacctgtcctttttcatccttatattctcactgctagctcactgcctgccacattgctccgtaaaatgattgtggcatgacctagtcgggcgggagattataaaggcctgcattagacagtggtagaaactgaaagaggaagacagattccagaggagggggaacgtagacaattcttgatgactaactggatggaggggggtggggtgtggggtgaagcattgtggaaggaaggaagccgggctgaatgctgggaaacctttcagtacagtggaaagagtagggactgtagagttagtagctatgggctttgggaagaatagccttgggatatttctggggatattgcacaatcagtgaacagtgttttactgataaaatatagttatctgtaggtgaaaacttgagagatatcccacttcagggttcctgcaagaaaagtccccagggcaagggttcttctctgggaaagcccagaattaagaactggaagggtgagttgtcatcaaagaaaatgggggtaggggaagtgttaagagggctgggagggtgattgaagagtttatgggtgttgagtgactggatacttcataactcagctttattttgcttccgggagaattgagttctttatttttttcgatattgctgtttgtgtgtttttctgttgccgctctaacaaattaccacaagtttagcatcttaaaacaacacacctttagccaggtgtggtggctcacgcctgtaatcccagcactttgggagactgaggcaggcggatcacgaggtcaagagactgagacccatcctggccaacacggtgaaaccctatctctactaaaaatccaaaaattagctgggtgtgatggcgcacacctgtagtcccagctactcaagagtctgaggcaggagaattgcttgaacccgggaggcggaggttgcagtgagccgagatcgcaccactgctatcccgcctagtgacagagcgagactccatctcaaaaacaaacaaacaaaaaacacacatttatcatttggtagtttctgtaggtcagaggtccaagtaggttccactaggtctcctgctatcaaggcctatcaaggctgaaatcaagacgttggcagggtgcatttcttactgaatgccttggggtggaacttgcttgcaagcccatttatgctgttggccatattcagttccttgagcttgtaggactgaggtgccctctttccttactggctgttagccaggagtcagtctttgttcccagaagctgcccgaattccttctcatgctttttatgtgtctccctccagcgagggccagttcttctgccacatctctctgatttcagctagagaaaatatcctgcttttcagggctcagattagatttagtgcacacagagaagccaggataatctctttattttaaagtttgtaattttaattacatctgcagaattccttttgacatgtaatgtagcatattcacaagttctagggattaggcacgagatgggcattctcctaccacagccgggaagagcagtttcagaggttgccttccctaggtgatgtgggtgttctcagttctcaaatttgtctgttttctctctagggttcactttctctctagggttcacgttgaaagtcgtgattcttggtgccttgatttattgtgctcatagggttaaaaaaagatttgcattagaattctagacatacctttaactcttaacttcctcccatgtttttacactgttgtttaaatttggccattttgggaaatgctttatacccaagtaatttatagttgatgaagggatagagaaagtgtcttgcttgtggcaccgtgactcacacctgtaatcccagcaccctgggaggctgagatctgggactacttgagtccaggagtttgagaccagcctaggtaacataaacaaatacaacaatcagctgggtgtggtggcgtgcactcgtagtcccagctactctggaggctgaggtggggggatcgcttgagcctgggaggtcgaggctgcagtgagctacgttcacaccactgcactccaacctgggccacagagcaagacccttctcaaaaaaagaaaaaaaaaaagcattctgagttttgacagagaagaaaacatttgatggttacttatctgtctctaccaagagcctagggaacaatgccccagagcatgagctggtatatagtctagtctcctggctcccactgagaaaaagggattttgagttgaggctggctatgactagacagccattgcagggactctccagttcagcctcttagccctccactgcctccacctcatctgggcccattctgggctgtggtctcctgctctcttcccagtcccatccttcttcccccaacagcacaagtgagggtgaggcctaaagtgtagccactgccctgctgcagaacaatcagtgacttttcttagcattagaataaaactccagatgtcccaccctcccagcccctcaccctgacctggtatagtcatctcttctcctacccccaccgtgttctgacctctctggtctttcagcttcttgaacattctaagctttttttttttttttttggagacaagatcttgctctgtggcccaggttagagtgcagtggtacgatgatagctcactgcagccttgacctcccagggtcaaacgatcctcccactgtagccttctgagtagctgggactacaggcacacaccaccacgcctgactgatttttatattttttgtagagatgaggtttcaccatgttgcccagactggtcttgaactcctgggttcagatgatcctccctactagccttccaaagcactgggattacagatgtgagctactatgcctggcccctgagctctttctttttaaccaatttattatcaagtgtttaaggtattgaaaaatgagtagactcctccccaccactgtattcatgactagctccttcttttaggtgtctgctcagtatcagatactcagaggatccttccctgcttgatctaaagttggtcaccgcctctgatatgttttatctcagccctttttagtttcccataggacctcatacctatgaagcttggtacctggtatacaaaacacttgttgaggagtggaatagtattttcttgggggctgtgtgagtcacctcttttttttttttttttttttttgaggtggagtctcgctctgttgcccaggctggagtgcagtgtcacaatctcagctcactgcaagctccgcctcccaggttcacgccattctcctgcctcagcctcctgagtagctgggactacaggcgcccgccaccacgcccagctaattttttttttttttgagacagagtctcactctggagtgcaatggtgtgatctcggttccttcaacctctgcctcccgggttcaagcgattctcctgcctcagcctcccgaatagctggggttacaggcatgcgccaccaggcccagctaatttttgtatttttagtagagacggggtttcaccatgttggtcaggctggtctcgaactcctgacctcgtgatccacccgcctcggcctcccaaagtgctgagattacagacatgagccaccacgcccggccgggtcacctcttgtattacagtggtattctttatttttttatttttttaagagacagggtcttgctttgtcacttgggctggagtgcagttggtatgatcatagctcactgcagcctcaaactcctggactcaagtgattctccagtgcagtggtattctttacctgaaccagtgtacattgtgaagctctggagcccctgctttctccacttgttacacttgttagcctttctttttctttctttttttttttttttgagacggagtctcgccctgtggcccaggctggagtgcattggtgcgatctcagctcactgcaacctctgcctcccgggttcaagcagttctctgcctcagcctccagagtagctgggattacaggcacccgccaccactcctggctaatttttgtatttttagtagagacggggtttcaccatcttggtcaggctggtcttgaactcccaacctcatgacccacctgcctcggcctcccaaagtgttgggattacaggcgtgagccactgcacctggcctagcctttcttaatcgtgtccctcatcaatgaaatggtagaaagccaatctgttttacaggtgtggtagaagggaaaaatgaagagacctctgtacaagcctttgcagaggtcttgggactcagtggtgagctccctgccaccacctcctgtgcccttgcaggagtaggagatctatagtcttggagaataagggtgataccccaataccccaagcctggttagggaaattgatgacccttattggagcctgtggggaggtagttgggaaattgttagtagcttcatgttggcattttcttttttgaaacagaatcttgctctctcctccaggttggagtgcagtggcatgatcttggcccactgcaacctctggctcccaggcttaagcgatcctcccacctcagcattcccaagtagctggtactacagacgcatgccaccaggcccagctaatttttgtattttgtgtaagagacagggtttcaccatgtctcccaggctggtcttgatctcctgggctcaagtgatccacctgcctcagcctcccaaagggctaggattacaggtgtgagccaccgtgcttgcctttgttgactctttattgaacatctactctccctgcagaaactgcaggataagccacccttagaaccaatttaactggcctttttggggcttggaccttcctcatgggattgctgggttaatgttgagcctgtctctgggctataggctctcagagaacaagagtgcatctgcaatgactagtgctgcacctgtcatacaggtttgtagaaaatatttaagctgtgaatgaacaaaaggaccttatcagctattttctttcaattctttttggtttttctgtgatcctattcttgagacttttatccctcccacccctctgtacagcagattgcacatataaagatgaaataaatagatgtccattgggcaaaacaatacagagaggaggtgacacagctggggaaggacagtccagtatctgatgaagtgccagaaggggcttagggggagcatggaatggagctggaactgccaggtcagccacctcttctagtgaagcctccagagagacgtgagctccaagtaagacaacacaaggaacaaaacatacaactgaacagcaacttccaagggtctggagaggtcttcagaaggatagggagtgcccttaaacttgcaagcccagattctgcctgtgggtcatggtcgtgccataggcagaagccagtgagtcagccttggcggagctttttctgtggcttttcccactcacagctctgtgcccttctggtgcagctccagcccttgttttccagcttcatagcctggttgtcacataaatggctgcactggcttacaggtgtctgtgtataacctattgctagaatgtccattccttgaggctaggggccctgtctgtccctctcttcactttcatagccccagtgccccatagggctgctcctgatgggcaaataggaagtggttgttgagcctctaggccagtcgtgacagtgacctgaggggacttgagccctcagtcatctgctcaggagttcagggctttctcaacagcagctgacgtgcggcaggcatgctatgccaagccctgttgcaggagttgacagatgttgactcatcccctcttcatgctttctttgtcagtagatgtacatgttactcacatttataagatgaggaaaatgagacctagaggagaggccactgctgcttagagttactctacatgttgtaaatcaggggtgtccagtcttttggcttccctgggccatgtaggaagaagaattgttttgggccacacataagatacactaacactaatgatagctgacgagctaaaaaaaaaaaattgccaaaaaatctcataataaagtttacgaaggctgggcgtagtggctcacgcctataatcctagcactttgggaggctaaggtgggtggattgcttgaggtcaggagtttgagaccagtctgggcaacatggtgaaaccccatttctactaaaaatacaaaaattagctgggcatggtggcgggcacctgtagtcccggtggggaggctgaggcaggagaatcgcttaaacccgggaggcagaggttgcaatgagccaaggtcgcgccactgcactccagcctggcgacagagtgagactcagtctcaaaaaaaaaaaatatatagaccaacctggccaagataataaaacctcgtctctactaaaaatacaaaaattagccaggcatagtggtgcacacctgtagtcccagctacttgggaggctgaggtaggagaatcgcttgaacctgagaggcggaggttgcagtgagtcaagatcacgccacttcactctagccggtgacagagcaagactctgtctcaaaacaaacaaaaaaaattaaaaataaataagtaggttgggcgcggtggctcacacctgtaatcccagcactttgggaggctgaggcgggcggatcacctgaggtcaggagttctagaccagcctcaacatggagaaaccctgtctctactaaaaatacaaaattagctgggcatggtggtacatgcctgtaatcccagctactcaggaggctgaggcaggagaattgcttgaacctgggaggcggaggttgcagtgagccgagatcacgccattgcactccagcctgggcaacaagagcgaaactccgtctcaataaataataataataataataataataaataagtaaataaatgaatggttgctgaaccacagcaggacaagacagacaaaccccttttatttgtttttgttttttggaccctaacagcagaggaagagccagccagcaagccccttttgatctttggcctctgccaaccagtaccccccagaccttaacccccagccctaccaggtcccttttgtaagtgaccccacatgcctaccacagttgcaggccctgacatccaccctgaccagaggtcttccagctattactggtgtttgtgatgctgtggctgtggccagtcaaggacccatgctgggcatcccgaggtaggaaggaccatgaccacgtgattatctccctgccactatcatggcagggctgtggggtactagcctcctttaaagcattccttaggacagtaatttctgttaaatatctggagggcaaacattttaaggaattttaatgaatttttaaaaattcaaaatgaaaaatttaaatcataaaaccaaatagaagaaagacccctatgtccatatacgcaccactctgcttcagtgattatcaactcttgtctcatgtacttgacctccacacaattattattactattttttgagaaagggtcttgttatgttgcccaggctggagtgcagcagtacaatcatagctcactgcagccaactcctgggcttaagtgatcttcctgccttagcttcccaagtagctgggactaagggtaggcgccaccatgctggctaattttcttattttttttttttttggtagagaccaggtcttggtttgttgcccaggctggtcttgaactcttggcctcaagtgagcctcctgcctttgcctcccaaagtgttggattacaggcatgagccactacgcctggccatccccagttattttgatgcccagactgttttagtggctgcccactgtctgtggattctgttcttagtcttgatccttcgtgcagtgtctgcacctgcctgccagttccttgacctgtgctccatcataccaagctggcagtggatcctcagacaatctcagttcttactccctgctctgtgtccagtttgtttgcctacctaaaagatccttccttttcgtggctgagcagtgcagccgttctccaaggagactgggccttctgctgcccccaccaccctgctcttttcactgcccccaccccgctgctcttttcacaggcttggtgaggagtttccaggttgcacttggtttgtttgaaggcttatctcctcctagtctgaactcgtcagggcaggagcttgaatcaatcatttcctgcctctcaggactgctgtagcagggggattcctagatctgtccagtgccagtttcctgagtactgctgcaggcccatttcagctgctatggtgatgggggctgtcctgaggggacattcacctcaggtagagatggcagaaacaccacaggaagatgcaaccagtcagctcagctgggggcacttaaattagatccattttttttctggaaggccttttggcaatactgtttatcccagtaccttaaaaatgtcgatttcctccaagggcgcaatcaggaaagtattcaaagcctgatggtgatgagggtgctcattgccgcatcattgtctcaggagtgggatttgtgaaacagaccaacagtgggagcttggttagagttgtagctgcaggtgatgggctctgtgctgctgttgacattgacgtgagggactgccataatgcgtcaacatcgacaagcgcttgttaccaagcaggatgcgtggtacaggctgagttttattaaacagatgtctttaactggtatgaatgattttaattttttctttgtttgagatggagtctcgccctgtcgcccaggcttgcgtgcctggtgacttctctcacctgggccctcaatgccagaccagccttcccaggatgattccatcctttccatccctgcaagggagcttgaggccctttccctttcagtttgatactgtccttccaagttacctttcttcatgttggcacgagagctttgtgccacaccatgccctttctggatgctgtagtgtctggctcttcctctgtctctgtgaccctcttccctggtgaagctttgaccttggcttcatcccctccagatgacccctgatggttagctcagcctgtggtggctccagagccctcattgagtgcatcctgacacgaactgaacagattaactattttttgccttgccaacagcattggaaattccttgagtgtgggacctggactcatagctctatgtctcttatagttcttagcacaatatcttggcctagatgaagtacataataattatatgtagggttgtggaaagcagtgctggctttaattaaagcctgccatggttttgtccatcagtgctgcctaaaccgttctgaacttctcattttgaacttttttccctcacagcttgtgatggttgattttctttttgagacattcatttatttgtttgtttatttggcagggtctcactctgtcactcaggctgaagtgcagtggcgtgattgtggctcactgcaacctccacctcctgggctcaagcgatcctcccacgtcagcctcccaagtagctgggaccacaggtgtgtgcctccatgcccggctaatttgtgtaattttttgtagagtaagggttttgccatgttgtccaggctggtctccaactcctgggctcaagcgatctgctgcctccgcctcccaaagtgctgggattacaggtgtgagccactgtgcctggccctgagacatttatttaaagacaaaggggagtacaggctagagaacagaggggaatagaatagcagccaaggcataattacctctaaaccatcaccccataagggagatgttcgcctcaactttagtaatgactctctttctagtctaggtgcagggctgttaatagaggccctgtgattgggttaagggcttgaggtacaataactctgttatttagggcagtgagtccttggagaagatgctttaccttctttccaagccccatgtctccttattttgagggtgtttttttttttttttcttgagacagtcttgctctgttgcccaggctggagtgcagtggcctgacctcggctcactggcctgaccttggctcactgcaacctccgccttccgagttcaagtgattcttgtgcctcagccttctgagtggctgggattacaggcctgcaccaccacacctggctaatttttgtatttttattagagatggggcttcaccatattggccaagctggtctcaaacttctgacctcaggtgatctgcctgccgcatcctcccacagtgctgggattacaggcgtgagccattgcatccggcctgaggtttttattttgagaatatttcaaatgtacagagagttgcaaggacagtaaaagcactcaggcatcctcttccctgggattcaccagctcattctcacttttaccatcttcccatactccctgggggcctcctccttctgggcttcgtttccttttatttgtttctgtctttttaattttaatttttttttaactagcccttctctttggcaggatttgttcacttttaatccttggccccagcagcttctctgagctctgcctatgaatctgggggagagataggggctcacacaagagtgaagtgtgagctggagggctgaaggggaatgagggacatctgggccaaaggcaggggaccagcaaggcccccacccctggaacttctgttcttcccagcctacgtaccccttgcttcttcttatgttggtgggctctgggggctgggtgaaagcagtgcttgtaggttaagaagtgactcatcccacgtgcccgctgcccttctcttctgttctttgctctttccaagcttcctttcagtcctcctcatcagacatgacctttgaggaagtgatgagtctgctatgtgtgagacagagcccctgttgtgaagtagaactcagggttcgtcctcagaagcctcggtgggtcaccatacgtcctgcaagtgctgtcagtctgctttgattcgtgtgagggagaagtccctgccaagtgctctgtagtaggcattcaggccaaccaaagaacagggcagggtcctgaggcacaggctcagagctcttgcttatttcatggggtgtttaaattgaggtataatccctatcacagtgaacgacacgcatacttccaatcttgagtgtgccaccagagaactgttgatactccccagatctgcacccagccagggcaaactgtgcaccactcttctgacttccatggccagccgagacatttggaatctctgtgcaatcacactctgtgccatctttttttcgagacagggtctcgccctgttgcccagggtagagtgcagtggtacaatctcggctaactgcagtctcgacctcctgtgggctcaagcaatcttcccacctcagcctcccaagtagctggtactacaggtgctcaccaccatgccctgctaatttttgtgttttttgtagagatggggttttgccatgtttcccaggctggtctcgaactcctgggctcaagcaatccacctgcttcagcctcccagagtgctgggattacagtcctctgtgcaattgtgtgcatcatgtgtgaaatttatcctcatttatcctcacaggcagcagttgttctattttttttttttttttttttttttttgagatggagtctcactctgttacccaggctggagtgcagtagcacaatcttggctccctgcaacctctgcctcctaggttccggcagttctcctgcctcagcctcccgattagctgggattacaggcacgtaccaccatgcctagctaatttttatatttttagtagagactgggttttgccatgttggccaggctggtctcgaactcctgacctcaggggatccacccacctcggcctcccaaagtgctgggattacaggcatgagccaccatgcccagcctgtgtttttgttttttttgagactgagtctcactctgtcgcctaggctggagtacagtggcgtgatcttggctcactgcaagctctgcctcccgggttcacaccattctcctgagtagctgggactacaggcgcccatcaccacacccggctaattttttttttttttttgtattttttttagtagagatggggtttcaccatgttagccaggatggtctccatctcctgaccccgtgatccccctacctcggcctcccaaaatgctgggattacaggcgtgagccactgcgcctggccttatttatttatttatttatttatttatttatttatttatgtatttctgagacagagtctttctctgttgcctaggctggagtgtggtggctcaatctcacctcactgcagcctctgcctccagggttcacatgattctcccacctcggcctccagagtagctgggactacaggcgtgcaccaccatgcctggctaatttttgtatttttagtagagatggggtttcgccatgttgggcaggctggtgttgaactcctgacctgacctcaggtgatccacccgccttggcctcccaaaatactgggattataggcgtgagccaccgtgaccagcctgttcttgtttatgacgtgttattccatggaggactctgttccagataactcttttattttgtgcctaatgaactttggtgttagttccagatgttggctacatgaaggcaaccccaggaatggctttggtcatgtcttctggtaaatatatgcacttaattctctgggctgtgcacctagaagttaaataaaggactgggtcagaggatgtgtctcttagcatgttctgctgaacagtgttcccaagtggtaccagtttacgttcccaccagcaaaatgtgagggagttccacttgctggacatccttgccaacacctggtattgtcaaggaacctgtctgtaacaggcactctcgttgattttgaatgcacgctgaaatttactgggtgcagtgacagtaggaagggaaaggatgattaaaaaaagaaaaaaggaatggaaaggctgatctaggagggaggaagctcataaggaaataagtggtaggatttggtgattccatgtgtgaatgctcgtattccgtgtgcatgcgtatatgagcttgcaggagaaagggaggagggaggcactggtatgcactccaccagttctcctgccacagcctctctactgatctgagggctgggtgtaaggtgatgatgtggggagtgggtgtgggtgaaatttccaacagtcagtgggagatgggggaagcaaacctgggaagagcagcctgctgcaggagcaagtgggtgggccgtcctggaggctggatgaaacctgtctgcctaggtggggatggcagaagtggcagagcagagaactccagagcagggctgtggtgggcagagcagatgtgaaggaagactgtgggatgagaggatggggcacggtggagccccatcagcctccagtcacagcagccccggtcccgtctctccctcctgttttggtcagtaccttcaggacttgtgggtgtagtacttcgttccattccggataacattgtagaagactgaaaaacaggaaggtgttttccatactctctccagagctggctgttactgacatattgatatatttccaccagtcttgtgtgtgcttatagcttgatatgtatgcattttaaatatgtaaatatatatacacatgtatttttaaagtgaaactaggctgagactgtgagttcagttttgagttataggtttcccatggcttaggttgtgttctctccctggatggagtctggctgggacctgcatgctcacagcccaggttcacatgaggtgtggatcatgcacaatcatcccacgggcttgagataagcatttgacttcctttttttttaaaaaaaaagttcattatggactttttcaagtgttcccagaagtagagataatagaaaagtggtctcccaactactttgagagttagcaacatatggccagtgttgcttcacccacccttcctcatcacctcctggactattttaaatcacatcccagacaccagatgatttcaactgtgagtacttgagtgcagatctctaaaagatcgagcttccccacccccaccaaataccacagagccatgtgagatcagcatttgggttggcagatctcctccttgccacatgcttgcctggtggtgaatgggacactttcaggcgagacctaggggagccccaggccagcaccaggacagagatctcgaggcctttccaactctgctggttcttcagaagtcaaaccaacagattggagtatgtgaaggaagctcgtgtattcttctgaactagcttagacaacagtacacagtttgaagggcagcagccttttctgcaggttagttctttcaatgatcttgtttactgggagttgagagaccttgaggatagaggcaagaaagcgtcatcaagcagcccagaggggtgtacagtgtttgaagtctcctgtattggtatgattcgagattttcattctgcaggaccaaaatacccattcctacatgtgggtggagagttaaattctgaagtatatatttttatcttgttaaaaaaacacttttatgtttctttaaaaagtaaaagaaccagaatgtagaagtttcagtaaaggaaaaagttacagtttgtttgggatacagtttgacaaatgtgctcccagctgcctgagagatagagaggccagatgtttgctttggttacattgatgactgaacaatcggtatctcatcatttcctgccttagagatgaaagcacctgggcactggggcagtaaattggttgcaggattggaagaagtccaaggacagtgtgggatgccaccctgtagctgtctagagacctagtgaaggtcagaaggctgggtgagaacaagccctgcactgatggaggacagggaaggggcttttctggctgggagtgtggtgaggcatttgagctgcagccagaaggcacctctcagattggtggggcttggggtgggggtgggaggaactgctttgcctgtgccgttggcctcactcatcctgaggtcccttcaaactccatccatactctgactgtggggccacttgcagaaggaatatgtggcaggttttttttgttttgttttgttttttgttttgagacggagtctagctctgtcacccaggctggagtgcagtggcacgatctcggctgactgcaacctccgcctcccgggttcaggcgattctcctgcctcagcttttggagtcgctgggcttacaggcgcctgccaccatgcccagctaacttttgtaattttagtagagacgggatttagtagagacgggatttcgaactcctgacctcgtgatccgcctgccttggcctcccaaagtcctgggattataagtgtgagccactgttccctggcctgtggcaattttttgagacgctcctgggggtccaaattgctaatagaggagaaacttactgtccctgtgttgactgagacaggaaggtttagataggtgaaagtggtctgggcgcagttgctcacacctataatccagcactttgggaggccaaggtgggagaatcgcttgatgccaggagttcaagactagcttgggcaacatagtgagatcctgtctctataaaaaataattttaaaaaattagctaggcctgtagtcccagctactcgggagactgaggagggaggattgcttgagcctaggagtcggaggctgcagtgagctgattgcgccaccatactccaccctgggcaacacagagagcctgtctcaaaaacaaaagaaaggtgaacatgagtttttttgttttttttttgacatagttttgccctgtcccacaggcgtgggccaccacgcccagctaatttttgtatttttagtggagatggggtttcgccatgttggccaggctggtcttgaactcctggcctctcaagtgatccacccacctcggtctcccaaagttttgggattacagacatgagccattgagcctggccaaacatgacctttctctttttttttttttttttttttttgagacggagtttcactcttgttgcccaggctggagtacagtggcacgatctcagctcactgcaaactccacctcccgggttcaagtgattctcctgcctcagcctcctgagtagcagagattacaggcatgcaccaccacgcctggctaattttgtatttttagtagagacggggtttctccatgttggtcagggtggtctcaaactccccacctcaggtgatccacctatctcagcctcccgaagtgttgggattacaggtgtgagcccctgcacccggccacgtgacccttcttaatagctattgttcgctgagtatttctctacgacactctttatgtgcattttgtcatttaattttaattttaattttctttttttttttgagacagggtcttactctttcacccaggctgtagtgtagtggcacgattttggctcgctgcagcttccgcctcctgggctcaagaaatcctcccacctcagcccccgagtttctgggactacaggcatgcaccactatgactggctaagtttttgtattttttgtagagatggggtttcactatattgcccaggccaatcttgaatcttgaattcctgggctcaagcatgagccaccacactcggcctcatttaatttttaattactttaaattttatcaacataatatatcacataaactgtaaaaagacaagaaactactgtggttcccattctgccagttctccccagaggtagcaactgcctttacatctgagctttcttccggcatatacctctgattctaggtaataggcacatgctgcttttgcaacttggcgttttacaaattatgttggcttgctctgtagctcccttccatcgccattatctctgcttctcctccctcattcttccagtattctactttctgcataaatcggtaatgaatgtttacattttctgcctacacaaatgatattcacagctgagcatagtggtgtactgcaattgcttgttatttttttcctaggaaagaattgccttttcaacactatgcccagttttctgtgtatctattcttattcttcctttattttccggttgcctctcagtacagttatcttcaggctcagtgctagtgagctgtcagtttcagttcaaacccctggcctcaagtgatccatccacctcggcctcccaaaggaggtgggcggtgaccctcttggacctcccttctggaaccctctaggcagtggccgcaggtgtggtgtgacagccctcagcgtgcttgtctgcccagactgggactgttgtcttcctttgttgggtcccttgttttctatatcctgtgtctcatcctttgtgatttattccctcattctgccagcttcctgagaagggactcctgggaattaactttctggagaccatgccagtttgagtgcatctaggccccctggtgggacatgctaactggggaatttaaaatgatgttacactgcgctgcccttgtgctggcttgtgcttctgtctcctgaggtgctagctctcagcctcatatgacttgtcttgatccctaaacccaagtcctgctctacttgggaagttcctttgagtcatttcaggggaatctcactccctacacttcctgtgctggagtgtttaatgttcactctttgggcctctagttttatcttttatctcctgttttctatctcttttacttttagctctcctctctaagtgatttcctcaattttttctttgacctttcactgctaacatgcttttatttccaagaactccttctttttccttttttgtaatctgacttttccctttttatagcacccattcctgttaaatggatacaatgtagtataatatttatatatattataataaattctaccgttttttttgataaattttcactttattgcccaggctggaatgcagtgatgtgttcatggctcactatggcctcgaactcctgggctcaagtgatcctcccacctcagcctcccaagtagctgggactgcaggcatgcaccaccactcctggcaaatatttttgtttttcgtagagatgggatcttgtgatgttgcccaggctggtctcaaactcctgacttcagctggacgcagtggctcacacctgtaatcctagcacttttgggaggccgagggcaggcggatcacaaggtcaggagttcgagactagcctggtcaatatggtgaaaccccatctctactaaaaatcaaaaattagctgggcatggtggcgcgcgcctgtagtcccagctactcgggaggctgaggcagaagaatcacttgaacgtgggaggcagaggttgcagtgagccgagatcgtgccactggactccagcctgggcgacagagctagactccgtctcaaaaaaaaaaaaaaaaaaaatcaaactcctgacctcaagtcatcctctcgcctcagcctctgaaagtactgagattacaggtgcgaaccactgcacctggcctaataaattctacatttccttcttcttgctgaatttctgttaccgctaaattactcttttcttgtggggtctttattggccatgttatggcgtctggctgcccttggctggttgctcactctgagagggaccctccaaagcctaggagtctcttccagcacgtggagcttgtcgactgggaacttcattgaaggctcatctggctgcagattctgagtccttcctccagaacaatggtccccaacctttttagcaccagggaccggtttcacagaagacaatttttctacagaccggcagatgaggatggtttcaggatgaaattgttccacctcagatcatcaggcattagattctcataaggagcatgcgacctggatccctcacatgcacagtttacagtggggttcgtgctcctatgagaatctgatgccaccacttatctgacaggaggcagagctcaggcagtaatgcttgcacaccctctgctcacctactgctgtgaggcctggttcctaacagcccacagacctgtactggtctgtggcccagggcttggggaccctgccctagagcatggtcttccagacactgggctgtgggtgaagacctggctgccagcatgctgctcactgcgatggaggaggctgatgggccagtgggtctcggcagttagcgtgcatcgatctagtcacttagaccagagcacagatgaccacacaacccacctctctcagtgtcctacctgtgccttttcaactgggtgggttggccccctagtccagtgactatccgtttcatgcttttccagagagtaaacctcctgtggtcacctggtgctggagtagctacccacagtgtaaagttggggagtgagggatgcagggatatctttcaccctctgtcccagagcacttggtgcagcctggcctcaacctggcaaagacctagggctgtcactgggtgggcgcaccccctcctcactgttacttaggactctggtttcttggtcctcttgctgtgtacgttaccactgggccatcagctttccagcttctaaaaggctgttgaggccaccatttccattcttcctggtttttttttctgtggttttagtcaggttttaagatggaagggaattaaatgtgcaggctttgttcctcatttcaacttggaggttcatatctgttatttatttatttatttagagacagagtctcactctgttacccaggctggagtgcagtggtgctaccttggctcactgcaacctccacctccctggttcaagcgattctcttgcctcagcttcccaagtagctgggattatggccgcacaccaccatgcccagctaatttttatatttacgtatatatttttttgagacagagttttactcttgtcacccaggctggagtgcaatggcttgatcttggctcactgcaaccttcacctcccaggttcaagtgattctcctgcctcggcctcccgagtaactgggattataatgcacgccaccatgcctggctaatttttgtatttttattttttatttttgagacagagtttcactcttgttgctcaggctggagtgcagtggtgggatcttggctcattgcaacctttgcctcccgggttcaagccatcctcctacctcagcctcccgagtagctgggattgcagcgcccaccaccttgcccttttgtatttttagtagggatggggtttcaccatgttggccagtctggtctcgaactccggacctcaggtgatccacctgccttggcctcccaaagtgctgggattacaggcgtgagccactgtgctcagctaatttttgtatttttagtagagacgtttcaccatgttggccaggctggtctcgaactcctgacctcaagtgatccacctacctccgcctcccagagtgctgggattacaggcgtgaaccaccacacctagtccaaatcttttttttaatatgggaaaatcttttttcctttatagtgtctgcttctggtgacatgcttaggaaaccatcatcctgatattgtataactctccttctgttgtcttgtggtcctctgtgatttaggtttttaaacacatagggtaaagggtcccacatacaagctgtgggctcctgtcccaggtgggcaagcaggctgcacacacaggcagcaatttactgggaggcttcttgggtggggtgaagtggagctgccaaaaatttattctgccctatgagagttcacttgattgatagatgttgtgtttctcaaaattagaaaattagaagaaactcacagaagtttccttcgagcagaacataaatcggctgagaggaatcatcctgcccccctgaggtcaggagggtgaatctgtgccccagggaggaacgcaccttcctgctttagacaccagcagaggacagagaagctggctgtcctgggaattcatgccctcattcagcaatgggaaagcagttggaccagggaagggggcctggcagtgtggcagggggagcagtggtaaagagggtggggtcaggggagaggcctcactgagaggggagagggtccttggtgggaaccagggcggttgtggaaggaagagtcagggcgtggagcagagcagagcgggagttggggtggggaggccagttcatgcctcatcaacatgcctgtgtgagtgtccttcttgcgggcggtggagctggcctcagggtacactgcaggtgactcagagctccaatgggagggtggctctgcctgagggagctgcacatgctcattgggccatcgtctgctgaggagggggcaacaataacctcaacacatggcggaggtgttttgggatgcatcctattgcacatttgggcaggttgttgcctgacttatttctttaacgcatacctagcacttcctgtatgtccagtgccttataatattaactactatcatcctcagggctacccgtgaggtcggcactgtccccaccctttgtgcaaaggaaggatagggaggcgctgccagatgggttgagggcagaccggggcagcttgcctcaggcctccctggccttagcaggctttaagtttgatgccctgtgctccttccctaggaagctcagtttgccagttttttgctttatcttagtctcattcagattacaaggactgggactggactcctgttgccagtttctcaatttggaataggaaggaggtgaggaacaacaggcccatgctgggcagaagccctgcagaccaggccaacagtgggcctctcctcactgcctggccctgtctgtgcaccttcgtcctggccacagcctctcagagcccctcctttatgaagaggttacgctttaggggagggagtgcctctcccaagacccagagctggtgagtggctaggttggaatttgagcccaggtccctcctcccctgtctgcttcctgccaggcccagctgcctgccccagcacacgccttctcccaggcaccctggcctccactgccaggacgtgcctgtttgaggcctggattcccccatggctgccacgctgattctccgttctgcacgtcgtgtcccatcaaaatgcatgacagtaccactccttgtgttaaaaagagccagttattgtgcctggcagtgatgactgcccactgcacacaaaagtggacgccgttgtctctgctctcagggtgttcttagtatagtggggctggcacacagaaaccagagattcctccaggaagtgccacagacatgggtgaggtggctacagggtttctgtgcagccgacagcaggggtgcctgggtggaagcagggtgggaggccctaacaggcctgatgggatagtcaggcaatgtgccaggtagtaggtcatcatccctggggccctggggagagtgtgtggggcaggcgcaggagcaggctcctcagtgggctcctggacaggctgcctgctctgctggtgaggagcgaggctcaaagcaagcaggggcctgggttgcttcccacactcagtggcagttgctcactggcagtcatgtgacctggggagctggcgagggcgtgggggtaggaatgggaacgggagacagaggccctttgggaggaattgccacagatgcagtgggagttggggcaaagatttgaactttggagaattaaaggtggcagtcagaaagtgaagggagttcccaagtttctgggatgggcacttggtgctgggagatgaagacacgaagagcttttcttgatgtatccctgctggctgctcaggcagggtcgggcaatgccattaagacacactgtgttctgggaacagttctggacagtaaggacatcctcagaccccttagtgggggagctccaagggcctgtaatgatgaatcggtcccctgggaggcttcagtctaagctagataccagttgaaccctgactgagtacacagacatagctatggcaaccagctagaccatggccaaaggcagagcattggagcccagttcacagcaagggactgtgtgctctgagccggtaacagtccttgtgttcagaggtctggctggtcgcaaccagggagtggcccccagcccccttcctcagctagagcgagcaccacccaggcagccttgggttctttggtggccgcctcataggcctgtactgtttgtgaacctgttgcttatgttggacaggactgtggcaggacagccatcaagggtcttcccttgtgagctgacaccagtctgctctttgtcctcctctggctggacaggccctcgtcttcccggcttgcttgtgtgggggaagagctcactgtgacatgtgggttctctgttctttgtctcaggctgtgctccttactccatgttgggggctgtctccttgtgtgatagtttcctttcatttcgtgacagtggctcgaagggttttgttttcaggagacagagactgaggagtagccattcgggtctggctgctcaggaaggcatgctggggatggcagcagagcccagctcagggagatcagaagggggctttgggagcagccagtgctgttctgaaggtgggcctgggtcctgcctgcagcctcccgcagcgggtgtgttaggtctaagggaggaaggaaggggacttgacctcagcaggagtgtgaaatgggtaccctcctggagtcaatgtccaggcaggggatgcctctgaaaagcgccaggccagctggagaggaaagggcaggcatctgcagggaagtgtgggggattagctgcagagttcctgggttctttttcgctttgtctctattttgtgacacttgatcttcaaactagaaacaggagcaaagacattttcaaaaatacagttgtcagaactgcaaaaccacacagggtctgttactggccaccaaacctgctgggcctccctgggtggatgctgtgggagagatgtgggagtgacatggcacagtgctgctgttctgagcggtagccttgctggaggagcgccttgccggaggagcaccttgctccttggccccactctgaccctccgaagctcatgtggaactggacatttaccccaactcggtttcctggtgttggcctgtcaagacttgcctgtttctggcctccagcttggtccatgctcctcaggctctgagtagctgacggtgcccacagtgtccatgtcatctgtgacattacccaggacaggacagggcccgtctgccagtacatcccctggtgtatggtgccaccttgccttcagctcaccaagcatatttcttcaacctggtcatcccaccacctcagagctattgcactaagctgtgtttctagatcttgtctctctgactgtgccaggtgtctctgctgcaccaagacagtgtctgtctggggcctgccagtctgctgacactctcaaaaacggccagtagcagctcaaaaggactgcttttgtatcaaagcctggctttgctctctgatcgctgctggtgggcacagagcccatctgtgtaactggttgtcactccccagactcttctgcacccttcttcctctctgactcctggccacatctgccacccacagcctccccactccttacacagccagcctccaggccgtcctgcttggcctgcaaatgctcccctgctgtttctactgctcttccctgagtctccctattggtcccagtgctttgggaggccaaggtggaggatcacttaaggccaggagtttgagaccagcctgggcaacaaagcaagaccctgtctctacaaaaaaagtaaaaaataaaaaaattagccaggcgtggtggcgcatgcctgtagtcccagctatttgggaggctgaggtgagaggatacttgagcccaggagtttgaagctgcagtgagctgtgtttgccccactgcgctgcacctgtgagagagtgagacattgtctcaaaaaacaaaagaagaaaaagaaaaaaggaaggtgggaagaacaagtatgcctttgaagggcatacctgccttgaggggcacagatgaggcaaccttcagaaaacaggcctgtgcagccacttctatcagaaatgctcactgacttcttggggcctagcagctatcgtctcagcctctgggtgtggagaccctgccccatgctaacctgagagcatgagtacagggtcctcccagcccacccatgcctcgcttccccaggactctgacccagtgccgcgcgtgagttggttgtcattatcctcctggattgttaactctctcatcttttgtggccctggtgacctttcttacttgtctgttccacacctggatgccttgtgagcagaaaccccttgctgcctcctcgcctcccttcaggcttcaggaagcagacagggaggtaggaactccaagagtgcaggagtctcattctgtcgcccaggctggagtgcagtagtgccatcttggctcactgcaacctctgcctccagggttcaagcgattctcctgcctcagcctcccgagtagctgggaccacaggtgcctgccaccacacccgactaatttttgtatttttagtggagacagggtttcaccacgttagccaggctggtctcaaactcctgacctcaggtgatccacctgcctcggcctcccaaagtgctgggattacagacctgagccatcgtgcccagcccaagagtgctttttgaatctagcagggtggtaggtcaatgtcattttgtttttctttttacattaagacagatgtatgcacctctcagcattaaacctcctttctgtgatgtctttaagaatcacagtcatattgctgtagccccgtctgtacattccttcagtttcctgaggttggctggttgctgtttggagtggtcagaatgctttctagcacgagctggactgggcctattcaattcactcagaggcaaggccccagagccctgacatgtttgcttgtttcttttttcttttgctttctttcttttttttttttttgagacggagtctcgcactgttgcccaggctgaagtgcagtggcgcaatctccgctcactgccagctccgcctcccgggttcatgccattctcctgcctcagcctcccgagtagctgggactacaggcgcctgccaccatgcccagctaattttttgtatttttagtagagacagggtttcactgtgttagccaggatggtcgtgctcgcctgacctcgtgatctgcccgccttggcctcccaaagtgctgggactacaggcgtgagccaccgtgctcagcctgcttctttctttctttttttttttttttttttttttgagatggagtttcgctctgtcacccaggctggagtgcagtggcgcaatctcggctcactgcaacctccacctcccggttcaagcgattctcctgcctcagcctcctttgtagctgagattacaggcatgcgcaaccacaccctgctaattttgtatttttagtagagacagggtttcaccatgttggtcaggttggtcttgaactcctgacctcagatgatccacccgcctcggcctcccaaagtgttgggattacaggcgtgtggcactgcacctggccacttgtttctttatcagcaagcccagggtgggaggccaggcaaggaagagacccatcccactggcaagaaggcaggcagtgagcacaccagagcagtccacccctgggagccacaggccaggcctttctaacagattcacacttgtttttgtctttctgtgtgtgagtgtgggaggtgggggtgggggtgggtggggcagcatgtgctgcattcgaggggtctccaccttaactgatgtacatggctctttatccccgtggagcagcagtgtgatgaaaaactcttcataggattctatctcttagtacaaaattgttggtaaatgggtttttaaagatatttttcacatttatgtggtctttctcttcttgtctctagctagaagtgaagttggagcttgtctctttgatcccacatataggacctgcattgtcccacatagggacagacccttgccttgggagggactgagagatgacttcatgtggccccttcattttataggagtaatcgagtctagaaccagggtgctaccatctggcagagttcatggggaacgcaggccactcagagagcaggaaatagaggccagctggccacccagtagtctaatgcgtacttccttgatcctgaactggttgtgagccatccctaggggcaacccctcccccgccccgtcccttcatgccagggctctctctttgcttcatggcgaccacctttcctgtcccttttttctgatcaccctgctcagtggcctgtcattgctctctgttgagtgccccttcccatatgcctctcctggacctcagccaggctggtgtgctggcgatagcaccttgtcaccaggggcagctgctatgcagggcctgttggccagggccctgcagcggtggagtcactggtgtgtgcaaacgtctcttctccttttgtgtttcagcgaggatgccatgaggaaagctggtgtggcacacagtaaatccagcaaggatatggagagccatgttttcctgaaggccaagacccgggtaaggccctagtaagtggagccactctggcagagagacttggagaggagagcatcacagactctggaacccctctgttgggtgtcctagggtgtaggggtggggtggttgctcatcgattgatcacaggcacagttggttttgcctgcagcagtctgggtcctcctgtgtgtccatggtacagggagggcacttgggttgcaggcccagcctctggccccagacctcactgccgtcaccttccatctgtggtcagcccctgtgaatcctacaggaagcttgctcaggcccctagctggtcctgtggaagggatcaatgccgtgagcaagaacctggtttgtcctcagcccctcctaggggtccttacctaagccctacagggccctgaggcatgggcccagaagcattcctgtccccttttgctaagtgaagaaggtgatgcttatctagaactcgccacaggtggagtggagaagaaggatttccactatatgtgggctttctccctgggtggggcaccacactgagggctttatgtgaccacctcctttaatctgtgtgtgctccctgggacagaaccgttttactagaaatgaacaaaacacatattcacttgtgtgcacgtgtgtgtgcaaggcagagctgcaagagcacagggactgaggtggggtagagtgggctctgtactatggacacgtgtgactgaagtgggatagagtgggctctgtattatggatacgtgtcactgaggtggggtagagtgggctctgtactacggatacgtttgataagctttttctttttctttaagagctttatacggttcaccctttaaagtttacatttcagtggtctttaggatattcacagagttgtgtggccatcaccaaaatctaattttggaacattcattaataaataaaaagaggtgcagcttccctgtgttgcccaggctggtttcaaacttttggccctacgccatcctcttgcctaggcctcccaaagtgctggggtcacaggtgcgagccaccaagcctggcctaattttagaacttttttttttgagacagggtctcactctgtacccaggctggagtgcagtggcgtgatctcagcctgctgcagcctcaatctcccgggcttaggcgatcctcctttctcagtcttctgagtagctgggactacaggcatgtgccaccacacccggctaagttttttattttttgtggagacgaggtcccactatgttgcccaggctagtcttgaactcctgatctcaagctatccccacgccttgccctccctaaatgctgggattacaagtgtgagccaccatgcccagccttcaacattttttaaagaaactttatacctgttagcagtcacactcccttttccttcaaccctcagctaccacttatactttctactgctgtagatttgcctattcggaattttccatataaatataattgtacaacatatgggttttttttgtttgtgcgtgtgtgtgtgtgacagttttcctcttgtgcccaggttggagtgcagtggcacaatctcagctcactgcaacctccgcctaccaggttcaagcgattcttccgcctcagcctcccaagtagccaggattacaggtgcgcaccaccacacccgactaattttttgtatttttagtagagactgggtttcatcatgttggccaggctggtctcaaactcctgagctcaggtgatccgcccgcctcagcctcccaaagtgcagggattacaggcatgagccaccgcacccagccacgtacaatatatgtttttattttgcagctggcttatttcacttagcataatattttcaaggttcaaggtccatgaaccatgtttggtatatactttattcctcttttgttttttttagatggagtctcgctctgtcacccaggctggagtgcaatggcacgatctcggctcactgcaacctccacccactgggttcaagcaagtctcctgtctcagcctccttagtagctgggattacaggtgtgtgccaccatgcctggctaattttcgtatttttagtagagatgggttttgcattggtctggggctatgttggccaggctggtctcaaactcctgacctcaggtgatccacctgccttggcctcccaaagtactgggattacagacgtgagccaccgtgcctggccaactttattcctttttattgtcaaatattccatttctggatggccatatcacatattttatagccattcgttagttggtggacatttacatagtttctactttttggttattatgagtaagcagaacaatagttaatgtataaatttttgtgtgggctgtgttttcatttctcttgggtatatacctaggggtagagttgctgggtcataccctacctctgtatttgaccttttgaggaattgccagatgtttcccaaagcaactgtactattttaaattctcaccagcagcttaaatgaggtttcaatttctcctcatcctctccaatacttgttattgtctattttaattgtagccattataatgggtgtgatttgcattgttttgatctgcatttgcctagtgactaatgatgttgagcatctttttcatgtgctttttggccatttgtatattttctttggagtaatgtctattcagatcctctgtccatttttaaattgggttgttagtctttttattgttgggttgtaatagttctttatgcatttggatataagtctgttattaaatatataatttgcaaatatataggggggattttatttatttatttttatttttgtttttttgagacagtctcgctctgtcggccaggctggagtgcagtggaagtggagggatgcagggggtgttagtgatgcattgtaatcatcccggagagcaggacacctctcataagaggtttacccaaggggggctgtggaaagggctagaaattgctcctggaggacgtggaaagccacataaggtttttgacagattagggaaaaggctgtgccactctttctgaagatgacagtgtaggcagcctttccattttgtgccaaaaataaaattttaaatacataaatcacagtagtttctaggacaactgggtaactacatacaaaatattgaggttgagccccaacttcataccctatacaaaacttaactcaaaataaaaaacaccagccaggcatggtggcgcgtgcctgtagtcctgcctaatcgacaggctgaggctggagggtcacttgatcccaggagtttgagattacagtaagctatgattgtaccaacatgttccagcctgggtgacagagtgagactctgtctctaaaaaactttttaaaaaattaactcaaaatgggtcaaaaacctaaatttacaagctaaaactataaatatcttagaagaaagcagaggcgtacatcttcatgaccttggattaggcagtagtttcttagatatgatgccaaaaaagcacaagctacaaaaaacgtagataaatttgacttcatcaaaattaaaaacttgtacatcataggacactgtcataagagggaaaaacaacccatgggatgggagaaaatatttgcaaatcacatatcaggtaagggtttaatatccagaatacataaagaactcctacaactcaacaacaacaacaacaacaacaacaaaaagcaactaaaaaataggcaaaatacagccaggcgcggtggctcacacctgtaatcccagcactttgggaggccgaggtgggcagatcacgaggtcaggagattgagaccatcctggctaacatggtgaaaccctgtctctacttaaaatacaaaaaaaggaaaaaaaattagccaggcgtggtggtgggcgcctgtagtcccagctactcaggaggctgaggcaggagaatggcgtgaacccgggaggtggagcttgcagtgagccaagatcatgccactgcactccagactgggtgacagagtgagactccgtctcaaaaaataaatacataaataaaataaataaaaataaatgaaataaaaaataggcaaaatacttgaataaacctatctccaaagaagagatacaaatggccaacaaccatgtgaaaagatgctcaacatcactagtcattaggggattgcaaataaaaaccacaatgagatgccacttcatttccattataatggctatgatttttaaaaaagacaataataagcgttggcaaagatgtagagaaattggaattctctttctttttgagacagtctcgctctgtcgcccaggctagagtgcagtggcacaatctcgtctcactacagccttcgcctcccaaattccggtgattttcctgcctcagcctcctgggtagctgggactataggcacacaccatcacacccagctaattttttttttttttttttgagatggagtctcgctctgtcgccaggctagagtgcagtggcgggatctcggctcaacgcaacctccgcctcccaggttcaaacaattaccctgcctcagcctcccaagtagctgggactacaggcatgtgccaccatgcccagctaatttttgtatttttagtagagacagggtttcaccatgttggccaggatggtctcgatctcttgactttgtgatccacccacctaggcctcccaaagtgctgggattacaggtgtgagccgctgcacccagccaatgcccggctaacttttgtatttttagtagagacagggtctcatcatgttggccatgctggtcttgaactcctgacctcaggtggtctacccatcttggcctccccaaagtgctgggattacaggggtgagccaccgtgcctggcagagaaattagaattctcatacattgctggagagaatgtgaaatggtgctgtggaaaacagtatgacagttcatcaaaaaattgaatgtagagttaccatacgacccagaagtttcactcccaggtatatatccaagagaaaagaaaacatgtccacacaaaaatatatacacaaatgtttatagcatcattataacatcataaatagccaaaaatggaaacaacccaaatgtctaccagctgatgaatggataaacagaatgtagaatatccatacaatgaatatcatgtggccacacgaagcaatgaagggctgatacatgctacaacatggatgaagctaaaaacattacataaatgaagcagtcacaaaggatgacatgttgcatttttataaaatgtccagagaatacgaagatctatagagatagtgtattagtttcccatggctgccataacaagttaccataaagttggaggctcctatctctgggtccatggctctgacttctgagcccatgtctctgccctcactttcttaaagggtagcacatgtttgaggctgcgtagttttatcagcctattcctgcttctaaaattttgggagttcttctttgattttgcctagtctataaactttctactccaagctggcagtgtttctgctggtagaacattctcaaaatccttgtggaacttctacatatatgatggaattcatagtattagatgaggtttctccacagatctttcctagataatttcatctctcttcctcacttctgtgagatgattgaggggattcatgagtcccatgtttaatctctttggcactagaaaaatttggaagatatgccacacccttggcattctctacagaacacactttcctaacagtaaatctcctagttttagcattttggttttttccaatctaaatagcctgagaatttcccaaatcattaagtctagattcctttctgcttaacagttcttccctcaatttctctctcttctttgtgtgtgtgtgtgtgtgtgtgtgtgtgtgtgtgtgtgtgtatttttaaaattctttttattgtacccttaatttatctctttcatgttgcttttttttttttttttttttttttttggagacggagtctcactctctcgcccaggctggagtgcagtggcgtgatctcaggtcattgcaacctccgcctcctgggttcaggtgattatcctgcctcagcctcccaagtggctgggattataggtgcccaccaccacacccagctaatttttgtatttttagtagagacagggtttcaccatgttggccaggctggtcttgagctcctgacctcaagtgatctgcctgccttggcctcccaaagtgctgggattatagacgtgagccaccatgcccggcctcctcttgcattttactacaagcagaaagaagaaaccaagctgagtccttttttttatttttttgagactgagtctcactctgtcgcccaggctggagtgcagtagcgcgatctcggctcattgcaacccccacctcccaggttcaagtgattctcctgcctcagcctcccaagtagctgggattacaggtgcccaccaccacgcccggctaatttttgtatttttagtaaagatgggatttcaccatgttggccaggctggtcttgaactcctgacctcaggtgatctgcctgcctcagcctcccaaagtgctgggattataggcatgagtcactgtgcccggcccaagctgagtcttgaatgctttgattggaagtctgctcagctaaatgtgcaaacttattgcttatgattctgccttccacacagctacaggacacaatccagctaaactttttgccattatattacaaagatcacctttgctctagtttccagtaacatgttccttgtttcctttgtttctttagaatcacctttaattttcatgtttctaacaacattctgtttttgatagtatatgtattcttgaagataatacagactttctgtatcaagttcgtcatttcctttaaggcagagtctgggtgacagtctttaacatccgcatttctacccacagcctgttcaaggaaacctaggccttttctatcatgcttctcacaattctactagccctcctttgttattgagttacaaagccactgccatatttttaggcaccctactcctggtaacaaaattcgtatgtttcctgtggctgctataacacgttactacaagcttggtggcttaaaagaacagaaatttaggccgggtgcggtggctcacgcctgtaatcccagcactttgggaggctgaggcgggcagatcacaagatcaggagatcgcaaccatcctggctaacatggtgaaacccccgtctctactaaaaatacaaaacaactagccaggcgtggtggcgggcgcctggagtcccagctactcgggaggctgaggcaggagaatggctgaacccgggaggtggagcttgcagtgagccgagatcgcggcactgcacaccagcctgggtgacagagtgagactctgtctcaaaaaaacaaacaaacaaacaaatttaatctcacagttttcaaggccagatgttcaaagtcagtaccatgggtaaaaatcgcagtggcagcagggaggctataggagaggaacctgtttcttgcatcttttagcttttggtcactgctggtactccttggcttgtggctgtatcactccagtcttcaagtccagcatcacgaggtaaatacattctctgtattccatcttcacgtcgccttctctgtgtgtgtgaactttccttctgcctccctcttaggaggatacatgcaattgcacttggggtccacccgcataacccaggatagccctccatctcaagatgtttaacttcatcatatctgcaaagacctttttctcaaataaggtaacatttacaggttccagggaataggacctgatttaaggactgttatttagcctgccacagacagaaagttgattattgattgccaagggtgctgtagggaaatggagttttcatttggagtgaagatgatgttctaaaattaggccaggcacggtggcccatgcctgtaatcccaacactttggaggccaaggccagtggatcacttgaggccaagagtttgagaccagcctggccaacatggtgaaatcctgcctctactaaaaatacaaaaatcagtagggggtgacagcgcatacctgtagtcccagctacttgggagggtgaggcaggagaatcacttgaacccaggaagtggaggttgcagtgagctgagatggtgccacttcagcctgtgtgacagagcgagactccacctcaaaaaaaaaaaaaaaaaaaagaaacaaaatgctttaaaattgattttggtaatgctgcagaactctgaatgtagtaccaaaaaccattgaatggcatgttttaaatgggtgaattgtatctcagccagcctattacatatatttttaatggaacgagtgaaaatgatgaataacaggtctgttttcccttggtggccaggtcagggccgtgtggtttccttgggtggggggcactgctggggctgccttgtccctacttggtttctgatggtgtgtcctgtgggctggggccaaggtcccatggggctatggatactatcatggaaccactctttctggaatttgatggtatttcaaaatctattaggaaaactctgagacatgaaagcacagaggcgtcatattcctctaatctggagtcagcagttgctgtggtttggtgacttttcccttggctgtctctgtgtccctcctgaagtgtcgagggcacatccccaccctcagggttgtatctctgctgagcatctccacactggcctgtgctagggccccacctgacaatcacatggagtcactattgtcatcaatgggaaggcctctttcaagtttcaacgcttttttcctaatagttggcttctttgaatcaggatccaaacgagggtcttttctcccctctggcccctcccagcctggtgaaggagcagcccagctgtcctgcagccctccccatgggctctgatgtctcccaagctgctgattcatcctgcctgccccctccttcttatgaactgggtgctaaatcggagagcagagagggtgccgtggtcttttagcaaaaatatatccgaagtattgccttaatttgtatttctgggcatcttgatattcccataagaccacaatttggaggtttggagagcaacaacagcctgacccttgtaaagctcctattatctttccgatggtttcatcatttaattagggcttgtagactaattctggcttttctcccacattcgttacatggagttttttttgtttttttttttttgtcaagaaaggttttctttcgtcagccagggctagatgattgtttgaaaccctgtgtgttcaggacctccaggaatgctgtttttctgatctttccagtctaaggagtccccccaagggccacagatgggttctctttgagtgacattttgagctcagggctgtgtatctggggtgttctggtccattgctgtcattcattttgatgcttagatggtcccatcctcatctagcaggagctcctgtgtctcttggggccctcacacaacctctttagtttttcttagtctgctggcatttagacccagattggctgctcctctagggagtgaaccctggggacttctgccggtaaagtggcatttggagcatgctacgtgggcgctggtctgttcattgctttgggcctttcagtgaacagaactaagaaaaaacatgtttttgaaataacagcaacaacaaaaacccataattttacactaatatttctaattcaaatttaaacttatatatagggtttttacttctttcattttaaacatgtgtcttttctgttactatgaatatcttggtttctaatattattagcatacttggttgctttactttaaaatcatttcagaataaacagtttatattaccactgataacaaaaggtagactaaacatttaagattaccttgaagttctaattgtccttaaaatgtatcccttttattgagaacattttgctttttgtttcatttttttaaaaagcctctcaaaagatttcttttctctatatgattctgccaccaacttaatattcagctcatttgttttagtttatttggaatgtttaggaattggacctttttctttagatttgctatacttttcattttagaaaaatattttaggctggctacagtgactcacacctgtaatcccaacacttttggaggttggggactgagcaaaagacaagccggccaacatggcaaaaccgtgtctctccaaaaaatacaaaaaattggccaggcgtggtggctcacgcttgtaatgtcagcactttgggaggctgaggtgggcggatcagaaggtcaggagatcgagaccatcctggctaacacagtgaaaccccgtctccactaaaaaatacaaaaaattagccagacgtggtggcaggcgcctgtagtgccagctacttgggaggctgaggcaggagaatagcttgcaccacccgggaggcggagcttgcagtgaactgagattgcaccactgcactccagcttgggccacagagtgagactccatctaaaaaataaaaataaataaataaataaattagctggacatggtactgcatgcatgtagtcccagctgctcaggaggctgaggtggggaggctcacttgagcccaggaagttgaaactgcagtgagcgatgatcgcgtcactgcactccagccagggcgacagagtgagaccccatctcaaaaaatatatatattttttagagaaataaaattcactgagttgcccctgagttgcccaggctgaactcctgggtgtaagcaatactcctactttatccttccaagtagctgggattacaagactgtgccactgtgcctagctttgatttgttttttttgttttttgttttttgttttgagacagagttttcactcttgttgcccaggctggagtgcagtggcgtgatcgcggctcactgcaacctctgcctcctgggttcaagcaattctcctgcctcagcctcccaagtagctgggattaccggcatgcgccaccaggcctggctaattttttttgtatttttagtagagatggagtttcaccatgttggccaggctggtcttgaattcctgtcctcaggtgatcctcctgtcttggcctcccaaagtgctgggattacaggtgtgagccaaggtgcccgacttgatttggctttatcttctcaatagtaaaagatttatgtgcttctgaagtgaaaacccataacactgtggatttagagagggcacatttccagcccagttcctgatacttgctgggttgtcgattttcaattttggtgtatctttccagtgtttctcatggcagatttaagcaaatatgtgtgtttacgttccacaggtcttatataaaaggtgtatgtcatgcagtgtatgtggcacggagcacgtgtttctatcctttctccttccttgtgttcactccacaatatgttgtgaggcacttgtgcaagatttccacatgtcaagcaagtgtggaaattctatgaagcttttaactttttgaggtggggtctcactctgtcgcccaagctggagtgcagtggagtggtcacagctcattgcagcattgatctcccaggctcaagcctcagcctcccactttgaggccactggcgtgtgctaccacaccagggtaatgtttgtttgtttgtttgttttgtagagatggtgtcttactatgttgcccaggctggtcttaaactcctggcctcaagggaccctcctgccttggcttcccaaaatgttggaataatagatgtgagcctccacgattggcctctatggagttttttaaggtttctgttttcttatctgtaaactggatgtgttagtagtacctgcctctgggtggttgggagaaatcaaggcgataatgcatgtgaattgatgactcctgtgtctggcactgtaaagtgccaagtgctagctgttactgtcatgatgttcattgtttatggtttgtaatactcagcctcaggtacagctggacacttatattttgatagccagcaggggagctggagcagaccaagtgaagatagggagtttcctgactctttagcccttttttctgcagcagttctaggggagttggtgtgctttggagcagaaaggggcataataatctgtccatctggatgggggtgggggtggatggtgaggagtcaggagtgaaagagcccagccagggggatcagaggcgcagtttcagatccagggctttctcccctggaaaggagttgttgtggttgacccattgcgttcagcccctagatgttcctagataaacctgcctttgggggaatgtaggaagtatcatcgcccacaagaaagctccttggctggcagcatgacagcttcctgtgcttgtttctcacatcaggcgtcccctccctccccgctccccactaagcctcctcacgctggtctggtagcagagctggagcagatggcagtggctgcgcctactgtgggtcaggagtggtgctgggcactgcaggatgatgatgcctgcccactgcattccaggtgctgggctggcagtgggtcttgctcagccctggtgttatgcagaagggctttggtgacatggtcctgagccttgtttgagtgtcttatgtctaagtaaaagtatcttgttgcttttgaaacctacttccccttgttttaccttttatggatgtggagaaaacaaattcatttaaagtatcgcagacctaaaaaatggtccagggccttaggagctgtgaggtgttgacctggctggcccccaggcccttctcccctcatacatggccaccttgcttctgttcctgagtgtcctcaggttcccacacctccattgcccccattctcataccactgtccttcagggacaggctgcctgtgggcccccttcacacgcacatcagctttcctatcagtaattgatggggatagccggaagctgggcgtgttgacagaactgccttggtgtccccttgttctggccaggcctcgctgcttatcccagcttttcctctcccctgggcctttcttcttcatgttgtcctgtgctaattccccgagctgaaaaaaagaagtggggtagagtttggagatagatgtgggatgataaagatttcaaaagtgtctttgtatttttacactcatctgagaccacttttcatcatccttccctctgccctgccatcttatgagtgtagtggatggactctgagtgtcacagtgactcaggaggaaggttgggtgagcagggcacggagccggggctttgccccttccaggctgccctgccagaaggatgggcacttcagcagaagacaaggatgcttctctgaaataagactttacctcagacatccgtgtattgaccacaagaccaactcacagtagtgatttccctgaaacacttgggagtgagtgtccttggggccaaagaggacaatgggtgggaggcagcccctgccagacaatctcagaaacacagcagcttgcatatagcgggccttggcagccagtggccttcacctcacctgagagtgggcttcaccctctgccttgcctgtgcgtaaatggagatgaacacagattctcccggaaagcgcagccaggggagggccgcccagattttcagcagatactgcgtcatcagtgaaaaggcagcaacaggctgggctgagaaatgaaagcccttctttacagatagtgcaaagacacagcggcccacccacggctgcctctgacaggccttgtgccctcaggccagcgcctcatcacccccaacctgcctgtcccctttgtgatgaagagagggcactcaagatggctcccagctctctcagctgagtgcctttccatcaggggagaggagtggccgttggaggctctctgtccccttcttgtttctttgtgcctgttattggccagcctagctgagcactgacggctctcttccgagaggcggattccagaggaggccgagcaagcgtctgaatctgccttgcaggatgggcttcagctcggtgccagcaggcgagggggcgggaagggggagtccgatgactgcgcttcttcatctggtattaaactgcttcctgtttttacttttaggacgaatacctttctctcgtggccaggctcattatccattttcgagacattcgtaagtaagattttgcatttctgggttgttgagatctctgtgagaggccagccctgacgctgcctcggcagagctttctgggcaggccgtggtgcctgagtcagaaggtctgtgtcacctcacttgcttctgggaagttcttcactgccttgcatttgactccagatccctccatcctcccagagccttggcctcaaaaatgctgattctagcatcatggaaatgctgtcctcaaagtggtctaaacgggttgctgcttcacttgctcacttaatctcccttttcatagggctgttgtttttacttctgggaagttctgtttaccctggaacagaaactctcttccctaaaagttgattttattgacccatggaggccagagacacttaggcatattttccctccagactagaagcttctgaggaggacctcctgagtctgcaccctggctccctgctgtgctgagggcccccgtgttaacctcacgttgtgcctcctctgattcagagggcccagtgtggttctgtcagccaggcagtggccccagctctacagaaatgagttgtcattgcatcctagggccagggtcttcgtgcttgtgtgtgttacgtggaagtatgtggacaccaagtgttcctggatggccacagcctgcgaaggaaactggggccagcagctgctctgtgttttcagccaacaatggctcctgcccactgccgctgcataaccaccagaggcaggcttctcttgacacaggcctgtcgttggagcatgtgcctggcgagtcctatttctattcccctgtgggttagggacaggcagctgtaccttcagtgtgttgctgggtcaaagggagacattgagcactccagagcctggtaggttttgcttctttccacactaacttttcaccagaatggccagcaaagtgaacttcactgatctcactctctgtggtgttggaaagtcactgggatgtgtaagaggagaaggagcagcccagatgatctggcccagatgcgctggcagactccgcatgttctgctttcagggacagtggcctggctggtgcacacagtcctgtggggctcatgaggtcatgggaagcagccgagcaggaggctcagggccccatgactgctacagaagttctccgctgggcactggggtcagctggactggcttccagctggccgtggacagcctcagtttcctcatctaggtaacagagacactgcctcaccagagtgggctgcaaagggaggcagtgtcaagtcttggcaccactccagccccgccgtgggttcctgtagtgttctattatttgtttgctcagggctgagctgagactctggacctgggaaaaaggaaagccagagtaggcccagggtccccaaccccagagtgcttcagccttgggggcagctccctaaggccccaggttgaccctggagctactctgcaccctctgcccccaggtctcttgtggggtcagcgctgccaagagtagaaacacttcccccagtagtggggagtactaggagctccgtggggattaaggcttgggcaaatgcctacagaactgacctacccatggaaatatgtggttatataaaactatgtttactttcgtttttttgtttgtgttttcatatagataacaagaaatctcaagcttccgtcagtggtaagagttttcccttttgagttaaagtttctcccaactttggatttgaggtggcaagaatgacatagtgcatgcctcatgtgcctgggttaacctgtcactagaggagaatgcttgcggagagaactctggagggaggaggctgaccagctgtgccctgacctctccagccttcgtcttcctgcagactgtgaagtcgcatgatcctccccatcccgtttcacacaaatgctgcctttgcccagcaaaaagataaacactcacaaagctattaagacattatccaaaagtgttgagctctctggtagagaattattatgctgttttcagtgtaataatatgtagtagcatttctgagaaaatgctgtgaattcacttttttaagttacaaagtttctttgtaaatttagaaatctggctgggtgctgtggctcatgcctgtaatcccaacactgtgggaggctgaggcaggcagatcagttgaggtcaggagttcaagaccagcctggccaacatggtaaaaccccatctctactaaaaatacaaaaatagccgggtgtggtggcatgcgttgtagtcccaactactcaggaggctgaggcatgagaatcgcttgaacctgggaggctgaggttgcagtgagttgagatcgtgccactgcactccaacctggatgactgagtgagactccatctcaaaaaaaaagtttagaaatccatatttttaaatttcagcgtttatcacatgaggggaattctgtcaattcagccttggtctctgctgactaagctgcaagggaaggggtttaacagatccaggctggccaactgcattctgccattgggaagggagtgcactgacctcacaggctgcacgccactgtctgccctgccctagacagtagagctgtacatgccagctgtctctgcccatgtgggtctcacctctcagccaggacagggattcttggccaactggggctgagcggcagcaagggcatgtggccagaacatctgggccccttggcattggagcatggggtcctgggtaccacccagttgtgtggcatggcggtcctgccaggacatacctgtctgtgggtagctgtttgctgtgaagtccacactgttgtgacaatggcatccttgtccttggttgtggcattgctcactgagctgctgacctggtgggcttgggacatttctcctcagtgctctgtggagccctcctctgcacccctaagctgttctggcatggtggccctgcacacaggggcccaggctgagttggactctgcaacagcacgagtggagctgtgtgtgcctgtggacttgtgccctccctgggagagcgtcccctggccactgtgttaccgcttgctcagaagggcccatcgtgctttgtacgctcacccagcaggagggctggacagccaggagaggcaggggttgccacctgccctcaaggcctcagcccatctttagtgtatctgcaggcatcagagaggtcatttgtcccttaacattaggactctggtccaggccaggctagaggtatgggtcatgcagtgaccaacacacctggcgtcctagccattcatatttgggagtctccaggagcctagtctcttactgcttggggctgtgaggggattgagcctgtaggtaggcgagatctgtgctctgtgagccttacgccctttgagccatggtcagtctggtaggccctttcctgagaagctctgcccttgtgttcccacagatcctatgaatgcactccagagcctgactggcggacctgctgcgggagccgctggaattggcatgcctcctcggggcccgggacagtctctgggcgggatgggtagccttggtgccatgggacagccaatgtctctctcagggcagccgcctcctgggacctcggggatggcccctcacagcatggctgtcgtgtctacggcaactccacagagtgagtaccacacttcttggaggatttgccgctttccttgcaaacgacaacacattttattcctgtgcttatgatggtatcaagaaaagcatggagaagctccaaatcgctctggtttttttgttttttaaatctttgttgtatgtggagagaaaaggcttccaattttcgttgagctcccagaagggttaagtgatgctgggccctcctcctcctcctagccctgggcaggagggtggggatggcctgagactccatccaaaggtttgtgttttgtggctgaaatagatacagtgtgtttcagagggttctcagctacaaggcagggctgagtgccagcaaccacaactccactgtctgcccgagctctgggcaccatctcttctagtgctgcccttgccccttggtcaccatgggtgtggcttgcagccatattatcttctggcttcctttctgtgaaggagactctgtgtcctctccacacggctgctgtggtgggaaactgggctgtgatcaggtgttataggtgaaccaaagctgctctaaaggggaggcaaagaacctccctcttctttccaggacctgtcttttgagacggggtctcgctctgtgggccacattggagtgcagtggcacaatcacggctcactgcagcctggacatcctgggctcaggtgatcctcacaccacagcctccaaagtagctgggactataggctcacagcaccgcgcccggctaatattttgtattttttgtagagatgggacttcaccatgttgcccaggcttatcttgaactcctgggctcaagcgatctgctcacctcggcctcccaaagtgttgggattacaggcgtgagccaacgcgcctgcccttaggacctatcttgatgtatccttgagtcccatcaacatttcttagagtgtgctgtgcccactgcaaagtgctttagtgtttttttcccctttcatgtaactttttatttttaaaataggagtcacaggaagttgtggaatagcatagagagttcccacatgccctttacccagctctccccaataatagtatcttacatagaacattgtcaaaaccaagaaattaatgttgaggcagtgtaatcacctcagttagagacttagcttggacttcatcagttttttttttttttttgagacagagtttcactcttgttgcccaggctggagtgcagtggtgtgatctcagctcactgcaacttctgccttccgagttcaagcagttctcttgcctcagcctccgactacctgggactacaggcgcctgccaccatgcccagctaattttatatttttagtggagatggggtttcaccatgttggccaggctggtctcaaactcctgacctcaagtgatcttctctcctgagcctcccaaagtgctgggattacagacgtgagccatcacgcccagccgacttcatcagtttttttacactcattcttgggctacatatatgggtatgtgtaggtctgtgagattttaccacgtgtcaaatcaagtagccatcaccacaattggcatgcggagccgttccattaccaccaaccaactctcttgtgttacctctcagagatcgcgccctccctccagccttaagcagtgacaattgctgatctgttgtgtgtctctgtagttctgtccctttgtgaatgttgtataaatggaatcataccatatgtgactttttgagattggctttttaaattcaatctgatacccttgagacccagccaggttttatcagtaattcattccttttcatcactaagtagtgttccatggaacggattttccacagtttgcttattcattcacccatgaaggacatttgggttgtttcctgcttttgcttactattatgcaaacaaagctgctgtggatatctgtgtacaggcttcagtgcttcaatatatttttgtcacacatccctcatgataaccctatgaagagggcagcatcgccccctctgctttgtcagtgtagcagctgctaaggagaactggagtcacaccccaggccaagagctgggatcgaagctgctgcctgaccccatcctcacactcctaccctatcctgtgtcaggtttcctcttctttggggccataggcatcctcatttctacccactcctgctctggaatcttcctccatcccaagccaccttcccttctcataccttaattctcctcttacttcctgttgtctaactctcagcacgtgctggtttcctcatcctagaacaatctgcctggttcttcgtcccaagctctcattacctcactatttttagcacatcagataagtacaccagctgggtttagggaggacccacagaagtgccggctcaagttccttgtcacgttctactcttgtgtacttggtgcattttttttttaatcatgagcttatacttgataataaattgtttttaaatgtatgagtttagaatgctcacatgagttgccttgtcatcccacttcagagactttgtcttaaaccagttctttgtcagaagttcagtggtgaagcttgatatcctgcccacgccctccccagtctggccttggcccccacatcctgtttttagcttccaaggggactggtcttctgtgtggcactagttgaaagttacagtgggggctgggcacggtggctcacgcctgtaatcccagcactttgggaggctgaggcgggcggatcacgaggtcaggagatcgagaccatcctggctaacacggtgagaccccgtctctactaaaaatacaaaaaattagccgggcgtagtggtgggtgcctgtagtcccagctactcgggagactaaggcaggagaatggcatgaacctgggaggcggagcttgcagggggcgagatcgtgccactgcactccagcctgggcaacagagcgagactctgtctcaaaagaaaaaagaaaaagttacagtggattctctacttcaggatcttgttaccacctttgtcagaggccaactctccctgcccttcaccacttgcctccctggtctccctgaaactagtagtgttgtctgatgggcatttgataccccttcctgacacctttcccaaagactactgcatgattaaggccctttcagatcttcatctagtgccaccaagaggacagagcctgggtcagaggttttgccagggactctcaaagggtaggccaggggacattgtgatagttttcaggtgacccaggttagtcggaaaaggctgaaactgctggttgttcctatggctggggctgcagtacagagttggaagcaaagcttttcactctgcgcatttttgtttctcatgagttttatatgacgtgcatgtaaagccgactttaaaaataatttctactgccagttgtgtgatggactggggtgctgaggacatgttctcctcctggataactaggttctggttaggatgcactttggaatgctggcctgcagcagttggggaggctttgtcctcctgagcctcagctgctgcaaggtgggggaagaaagcttgggattcctgtagtcagccaggatttgtgctgggtcctgtgtcaccccccataccccccagaagcaggtgcagattggagcaggtgcggattggaggaacatgtccccagtgtaagacctgtgacagttgcacattaaggtcaagcaatcagcatacaaagatcaccagccttgaagggaaggagagacaccatgaaggtgaacagaaaaaatagacacatgtaggcatgcccagtgaccacacacacaggaactgttagttatgggccatggggtatataaagaaataaagtggagagccgggcacagtggctcacgactacactcctggctactcgggaggctaaggcagggggattgcttgaggccaggagtttgaggctatggtgaactatcattgcaccactgcactccagcctgggggatagaacgagacaccatctctgaaaaaatagaaaacaaaaaggaaaagaaagagcagaaattcaaatgaaaaagcatcatcaggagcaatgaagcagatttgaaacggaaccaaatgaaagctgtagaaatgagcaatataattattgaacgaagaaagtggatgaatgaacagcgcattagatacagctgaagaaagaatttgtgtaatagaagctacatttgaagaaattatctagaatgtagcacagagaagagcacatggaaaatgtgaaagcaagggtaagaaatgaggataagatcagaaattctaattggcatccaagcaaagccccggaaggatcaaatggagagaatggaagaaaacaatatgtgaggggataactactgagaaaagcccatctggccccaaccaagttagccatctcatctgctgtgagactgcagagcaccaaaggccagaggaatgtcttagaaataggcagttcctgcaaaggagcaatgagtacactcagcagtagagtcagaaaggtaatagaatattgttaaagcattgagaatagagctgccagtcacatttgtatgccagcaagactcaaggatgtggaaagcaagccatttttagataaacctagccttagagaccatcactaaaagattttctaaaggatatatctttttttatcctttttccaataagccttttgcactcttagatatattcttttgtttatcctttcctcttccctctcaggtgatacaaggtaaaatgggaaaagaaacgttgagcataggtgatagtaaatgtgtataaatctaaagcagtgattctcacccagggtgacattccaccacaggggatatttgacaatgtctggagacattttgggatgtcactactgtgggggtgctgctggtgcgtaatgggtggagaccagaggtgctgctaaccatcttacaaatacaggtcagtccccccaacaacatagaatcatctgggtcaagtgtcagtagtgaaaaggttgaaaatcgctggtgtaaataaaaatttacctctgtaaaataaaacagtcaggctaacctccatacagacttgccacattccaagcactatttcatttcttttctattattattattattattattaagatggaatctcgctctgtcaacaggctggagtgcagtggtgcaatgtcggcccactgcaacctcgacctcccaggttcaagcgattctcctgcctcagcctcccaagtagctgggactacaggcgcgcgccactacgcccagctaatttttgtatctttagtagagacggggtttcaccatgttggccaggatgttctcgatctccagaccttgtgatctgccctccttggcctcccaaagtgctgggattacaggcatgagcctccgcgcctggcctattattattatttatagagctagggtctccttatgttgcccaggctggtcttgaattgctgggctcaggcgatctgctctgccttggctatccaaagtgtgagattacgggcatgagccacagcacccaaccccagggactattttgagtgttttacttacataatagattatttaattcttagtccagtgtgtggagtaggtactattattgcattttctaacagggaaaactaaggcaatgagcagtgacagagttgaggttttgagtccaggcagcctagcttggaggctgtatccctagcctcaaatccatccagcctcttaatagaatgtctgctgtgaagagttaaaatagatcaacaaaatatgaaataaatgcaagtcagcagggagatagagcgtgaatatcggttctgtcgggtacatataaaacctactttaaaaagtagtaaatttgggaaatgctaaaatattgatgaggtttatactttaagttaaatatgcatgataaaattgaaaaattattgctaaaacaatggaaataattcataaaatttaagatcaatagaaaaaataggataaggcagaaatccagataatacaaagttcaatccaatcatccaacaaaaatgcaatcaaaaaagacaaagaagcttagaaaaggaaagacaaaggccgggcgcggtggctcaggcctgtaatcgcagcactttgggaggctcagtcaggcagatcacgaggtcaggagattgaggcgatcctggccaacatggtgaaacgccgtctctcctaaaaatacaaaaagttagctgggcatggtggcgcatgcctgtaatcccagctacttgggaggctgaggcaggagaatcgctagaacccgggaggcggaggttgcagtgaaccgagatcacgccactgcactccagtctggcgacagagtgagattccatctcaaaaaaaaaaaggaaaggaaagacaaatattaatagaaaataagtttaaaaatataagtaatcataataaatgtgagtggactaaacttttctgctgaaagataggaaatgtgagaacaaatggaaatgaaacagcacagttgttttattgttagaagaaacacacacctacaataaaacatgcggaaggatttaaaaataaaagatgaagaaaggccaagtgcagtggctcacgtctgtaatcccagcacttggagaagctgaggtgggaggatcacttgagcccaggagttcaagaccaacctcggcaaaataggagacccccatctctacataaaatttaaaaattacctgtaggtacacttgagatgctgaggtaagaggatcacttgagcccaggaggtcaaggctgcagtgagccatgattgcactattgcattccagcctgggctgcagtgagacccaatctcaatcaatcagtcaataaaattagctgagtgtggtggtacacacctgtagtcccatctacttgtgaggctgaggtgagaggatcgcttgcttgagcctggaacgctgagtctgcaatgagccacgatggagacactgcattccagcctgggtgacagagcaaaatcccgtctcaaaaaagaaacaaacaaaaaaaaggatgaagaaagatgtattgggcaattacttcaattacatctctttgttattgataaacagaccaaaaaattcatttacagaaaatttgaacaatgtaatgaacaacttaatttaagcatatgatggaacaatatgtttataaaaataaatcataaagcaagcttcaacaatttcagaaaatttaaaagtattgtcatactttttgttgttgttgttttgagacagagtctcactctgtcacccaggctggagtgcagtggcgcgatctcggctcactgcaacctctgcctcccgggttcaagcaattctcctgcctcagcctcctgagtagctgggattacaggcacgtgccaccatgcccgctaatttttgtatttttagtagagatgggtttttgccatgttggccaagctggtctcaaactcgacctcaagtgatcctcctgcctgagcctcccgaagtgctgggattagaggtgagaaccaccgcgacccgccggtcatacatgttttatgaatgtcaaataaagttagaaatctgtcacaaaataaattaaaaattttttacacttggccaggcacagtgacccacgcctataatctcaacactttgtgaggtcgaggcaggaggatcacttgaacccaggagtttgagatcagcctgggcaacaaagtgagactgtctctataaaaattttacaaattagttgggtgtggtggcatgcacctgtagttccagctactcgggaggctgaggcaggagggtcacttaagcccaggaggtcaagggtgcagtgagccacgatggtaccacttcagtccagactgggcaacagagtgagaccccacctcaaaaaaaaaaaatcttacacccatcagaattgctaaaatgaatagtgacagcctcaagtgttggtgacagagaaactgaatcactcatatattgctggtgagaatgtaaagtggttttaccttctttcaaaatgaaatatgcaactcagcagttacactcttgggtatttttcctagagaaatgaaaacctcgcataaaaacccatgcacgaattttaacagcagctttatttgtggtagcccaaatctacagttacccaaatgtccttcatgtagacggttaaacacactgtgaggtgcttgtaccatggaataccctggcagtactgttgctagaactacaacctgtatgctgaatgtaaaaagccgatcccaaaaaggttcatactgtatggttccatttttgaaatattatgtataattttgaaatgacaaaattttagaaatggaggatgctgcagtggttgccagagtttgcgggtcagggttgctgagagaggtggcaacacgagggatccttgtggtgtggggactgtgtagtgtattgactggtggtgactgaacccacccaggtggttaaattgtccagaacttagtacacacacccacacaagtgagcacacatcgtggttgtgataccttgtaagtttgtagaatgttaccattggaggaaactgggcaaagtatacaaaggatctctctatatttctttaatacagctttattgagacataattctcattagcatacaattcacccatctgaagtgctccactcggtaggttttagtgtaatccacagagttgtgcagccatcagcacaattttagaacatttttatgttcaccccaaaagaaacctcacctcagaaaatcttgtaattgactgttcatataagcagttttcataatagccacaaagtagaagcagcgcaaatgttcatcacaggaaatcggtgtagtagaatattatttggcgataaaaataacacagaaaaactgataacatgccacgacatgggcgaactcgtaaatattatgctaaagaagctagtcacaaaagagcacatgttcgatgccattcgtacaaagagtccggaagtggccaatccatagagacagagaggagattactgattgccagagtctaggcttcttatttatccaaaagacttagttgtcccttttcttttgtctttggttattatagagtaactcatgataggaaatcccaaaatcaacacaaatgctacttcgtattctatctttctgtctgtggtaaatggaacgttcagattccagcggcagccgtggcagtggggcttttgctggctgttttgtcccttgctgtgcagccctgcagcgtttctgggaatctgccctgtggactgactggcgactctggtcttttctcagcccagctgcagctccagcaggtggcgctgcagcagcagcagcaacagcagcagttccagcagcagcagcaggcggcgctacagcagcagcagcagcagcagcaacagcagcagttccaggctcagcagagtgccatgcagcagcagttccaagcagtagtgcagcagcagcagcagctccagcagcagcagcagcagcagcagcatctaattaaattgcatcatcaaaatcagcaacaggtaccaggtcccctgttcctgctcttggcctccctcctgcagcgtgagccctgggctggcatcagccacaatgctgggtgcagtgcccggagccagccgagggttctcttgacacgtgtgcctgcccttttccatgggcttctcaaaaagtctgggacaaggccgggcccagtggctcatgcctgtaatcccagcactttgggaggccaaggcaggcggatcatcaggagttcaagaccagcctggccagcatggtgaaaccccatctctactaaaaatacaaaaaattagctggacatggtggcgtacacctataatcccagctatttgagaggctgaggcaggagaatcgctagaacctgggaggcggaggttgcagtgagccgagatcgcgccgctgcgctccagcctgggcagcagtgagactccgtctcaaaaaaaataaaaataaaaaaggaaaacaaaagtctgggacaggcaggagaaacaggccctgactcactaggaaggttctgtgatcgagcccttccatttgggcttgggcatctggcggtgggcctcctgtgtagttcaggggctgcgagggattcaaacaagagtgagctgaagcaagaagtgagacgaacactctgaggcttgggactacttgagccattgtgggccattttggctgaggacacatgtgcctcctgtttacctctgtgtcttgggttctgggctcagtgttagtcgacctccagctggtgttgcatgaggtgatggtgatgtcatgttagcagcactgcttctcagaagttgttcagcttcccatggtttccatagagagtctagacgtgttaaacatctgccctcacagcaggtcttggttgggagaggaaagccccaaagggccccaccaccctcccaccccttcaggcctcagctagctgggcttctctggatcttggcacccctctcccagagctgacagtgcatctgcagccacacttttccttctcctgctgacaagcagaccttgaccgtcaccgtgaggctcatgccactgacctataggggcaaagcaagcatcgttgcagaggcttcagaaatctgcagttgccccagcttttatcctagcttccatggagctgtacctattccttgtcatcttttgctgaagtttctaggtatgccctttgaaccatcctagtggaatggtagaccagagcccaggcacacacttggtgcctccccggtgtcaggaaggcagctggtgttggcctcggggggcccagagcctttctgtgggagatgtgcccctccccgtgtgagtgagaggtcagcctgtcagcccaggaaggccttttttttttttttttttttgagacttttttttgcctcttactctgttgcccaggctggagtgcagtggtgtgatctcggctcactgcaacctctgccccaccagtttaagtgattctcctgcctcagcctcccaagtagctgggattacaggtgtgagccaccatgcctggctaatttttgtattattagtagagacggggtttcgccaggttgtccaggctggtctcgaactcctgacctcaggtgatctgcccgcctcggcctcccaaagtgctgggattacaggcgtgagccactgcacccagccaggaaggctttcttgatggctctgcagatggccacctgggcttcctgaggcccagactgtcacagggaggagctggtgccacagaggcagatgagtgataaccgagtgctgcttgttctgtctctagatacagcagcagcaacagcagctgcagcgaatagcacagctgcagctccaacaacagcaacagcagcagcagcagcagcagcagcagcagcagcaggctttgcaggcccagccaccaattcagcagccaccgatgcagcagccacagcctccgccctcccaggctctgccccagcagctgcagcagatgcatcacacacagcaccaccagccgccaccacagccccagcagcctccagttgctcagaaccaaccatcacaactcccgccacagtcgcagacccagcctttggtgtcacaggcgcaagctctccctggacaaatgttgtatacccaaccaccactgaaatttgtgagtacctgtggcccacagtggagcacatgcagcccgtggctctgtcagcagtagtttctaggctctttggctagagatagcatatcctattcttcaagtgctgagacttcaggcagcccccaccccttgccagccctgccgactctagcatggctcagcagggaagcatgtgttttgcattttgtgttctgagagctgcttctgcaccccgcacagggtactgctgctgctactggggcaccaagtcgcattccaagcagtgtggctgattgcagcagttctgtgggccctttcagggtgtgagcacttcgactgatgagcaccacatgaaaggatgtgccagctccgtcagtgtctggtggtttgccaactactcagagttaatgttctaagcaaatatctttttttttcctttacactctgccaagtctcaggagaacaaagttcattactatatttttgagaggagtattaatataaaatactgttattcctagtttcattttgtatctctgcacaaagccagtctactcagtgacaggcacagaggacagagtatgatcaccaggatgaaggtagctgcatcaaggggccatttggacaactctttggctcccttggtttttgtggccttttctgtttgtgattcatgagtggaatggggcctgaggcaagtgtgggggtgaacaagaggcctcataggcagactggaagtctaggagagttgtgaggagcagatatgctcactcatctgtcacctgggagtcgacacactgcctgaccccggggactgtgcagactgaaacccttgtgtgctgcatggtggaatgtgccctggcagggtttgccctagtggcttggagatgtctaaggaagagcccgctgcatgttggaatgtgccctggcagggtttgccctggtgacttggagatgtctaaggaagagccccctgcatggtggcgcgggcctgtctcgtccttctggaggcccctccatgcagtggctccacagttgccccttttgcccaagtttgccccccacccccacttttttcttttgaagacagggtctctgttttccaggctggagtgcactgatgtgatcagacctccctgctcaagcgattctcccacctcagcctcccaagtagctggggctgcaggtgtgcatccccacacctagccaaatttttgtatattttgtagatatggggtttggccgtgttgcccaggctagtcttgatctcctgggcttaagcgatccactggccttggcctcccagaatgctgagaatacagacaggagctactacgccctgccctctgctggccggctaacccagctttccttcaaggaatcaggctgagtgaagctcttgtggaccatcagcatgcttggcccagaggatgagcaggctaggctgtaagctctgcattggaagtcgtcagtgcttgtgatagctggtgctgagggatgtgtggagacatcccagtgggagggccacattgccacttgccagaattggatttgagctaatgggatcctagatggccagtaaggtgacatcacagcacatgaggtcatgaaagtcccattcctcacctcaagaaaggctccatttcctaagcttccacaggaagactaggctctgctctctgacccaggtggttccaaatcacattctctctttctccctcaaggtccgagctccgatggtggtgcagcagcccccagtgcagccccaggtgcagcagcagcagacagcagtacagacagctcaggctgcccagatggtggctcccggagtccaggtgagggcctgggggtggagggctccatagtcatcagcaggtgcatgttcacctgcgcatgtagtgctacagtgagggttctggttggattaggggctgggggctaagttggtaaagcaggggcttctctcccccttgcactctgcaagacacccctggagtccttggggtgggcagctgtgcttggtcatgtctaggacccaccagccgcatagtgcgtgtcgtttccagctttgctcgggcatccttcattatccctcttccttgccactctgagtgactctgggaacatgtatcagagagtagaaggctgcagttttctcctcacctctcatcttccatttgagagtctgagtacagagctgaccagggtggagggcagctttctagacactcggaagcagatgggagccacatgcagcaggagcgtgggagaaggcatcctggtgctcgcctgcactcagggactccggcgctgtgtggtgagaagcgtgccactcccacattgctgagcttgctggtgtgtcacatgtgtggaatgtgtgtgtgtctctgtgtgtcacgtgttagtggaatgcagatggccttgtctggcctcctagtgtcctgggattggaggcccagggtttctgtaccttttcctataacccctcctctccttcttgtggggagacgtacagtctggggcttcagtttttcctcttttcacatgatggtggaaacactgttggtcctgactcggaaggggcgttggctttagaaagagtcagaatgtgctagttgatgtggtaagactgtggctgggtcccagcccacagctggcagtgcgcctgcactttgctgtcgtcttaagggtacctggccttgtggttttctgcaggcctgctgggcgcagcgcctgggtgcacagtgcctcgtggcaggcttcatctcacgcttggggggtgctcagtaatgtccttcatggtgcctgctacctcttttaagtccctgggaagctgcctgaggagggaatctgaggtatttggctgcagctgaggttagcatcctaccttggcagggcaccaaatgacttggggccagggtccccatgtcacattcttacttagatggagccctgtatgaaacacaccacagaactcacatttacttacagctgggggaggctgaccacttcgtgtgatgaggttggaggtctctgccacctccctgtgtgtctcggcatgtcctcaggcctcgtgggggggctcccttgtcctggtctcatgcagaggaaggacgtggtgtgttcagagtcagcttagtggtggcacatagtgactgcccacccagtggaagctgctacctttgcctctttggaccatcgatcctctgttcaggacctcacttcctggaaactttttttattttttgagatggagtcttgctctgttgccaggctggagtacagtggcacgatcttggctcactgcaacctctgcctcctgggttcaagtgattctcctgcctcaggttcccgagtagctggaactacaggcgcgtgccatcacacctggctaatttttgtatttttagtagagacatggtttcatcatgttggccaggatggtctccatctcttgacctcgtgatctgccggccttggcctcccaaagtgctgagattacaggcatgagccaatgcgcccggctggaaacttctgtaccgcaggtcaagcccagcaggaaagtgagaactgctcttttctttatttctttctgtcttttttttttttttttgagacagagtctgactctgtcatccaggctggattgcagttttgcgatctcggctcactgcaacttctgcctcctgggttcaggcgattcttgtgcctcagcctcccaagtagctgggactacagttgcacaccaccacacctggctaatttttgtatttttagtagagatagggtttcaccatgttggccaggctggttcgaactcctgacctcaagtgattcacccgcctcagcctcccaaagtgctgggattataggcatgagccatcgcacccagcctagaacttctcttctcttctcttttttctcttttcttttctttctttctttctttcttttttttttttttttttttttttttttttgacagagtcttgctctctcacctaggctagagtggctggagtgcagtggtgcaatcttggctcactgcaacctctgtctcccaggttcaagtgattgtcctgcctttgctcccaagtagctgggactacaggcatgcgccactatatccagctaatttttttttcctcttgtatttttagtagagatgggccaggctggtcttaagctcctgacttcaagtgatccacctgcctcagcctccctaagtgttgggattacaggcgtgagccactgtgcccagccgaactttccttttctttccatttcttggtatttggaaagtgaatagccatggagcagccagtgttttcagctggtgcaggcccagctggtatgttcgttaggcttctagctcaaggaagtgtccactctgcagtctcactggcatcccatcaccgtccagaagcaggatgccagctgtgtgtgctcatggcccatgctgagcctgtccttgggccactggtcttcctgtcggtttctccaccccttgtttcaggtggaggtccccgcccgactggcacaggaaggaggatggagagtggttaccactgtggttcgttgctgagtgagtttgatgttttaaggatcattgcccacctgccctgtggcaccatgtgctgccatgcaggggattcccaagtgctagtggcagaggagccttgtagtttctcaaagtccagcagtgggtagggcgtatctatgaggtgcttctcagtccagatgtggcaccttgaaattctgtaacccgcattctgctggttttctctcagagcttggtcttgccttgttgcaagcagtgcagtttcttgggggctaattgggcaccctcactgccttgttccaccaatagcagcgccccctgctgggggatggggagggttgggcacagcaagccctctgaggggccatctggattcatgatcttcttttgaaacttgaattggcacagtgaccagctgaggctacggtactctgatctaaaaactttaaaagtatgtgtggtaactgtagaacccagaaagtggagaggaacagaagtaagagaaccattccatgagagagaaggtctggtgtcctttctggttgtttcccatagtcaaggtcatgctatcctggggttttttgtgcagcatcttccacatcaataggggatgaaatgttctcctttaattagaaagccctggtcggcacgaaggaactcttgtcatacccctctgtgaatgtctcttgccatcctcagttaccatcttgttcttggaccttgtaataatttccgattttttgctattaccagtgacacatatcttgatgtcttagattgttcctggagctgatggaggtgagtgaatggttcactttgagggccttcagatctgatcagccaccctctaaccaggaggtcagagatgcagattggagctccccttgtgttgttcacacagtggacatcaggacgtggtgaccacgtgttgcagctttgtatgtatgagctgccgcgtgctgcggaaacaggcctcttgagttcatgaatgaaattctgggattgggggcccccatgcaggcagccctccatgccctgtctctcaagcccatcttagagccgaagagaggcgccctgtcaggcccttgcagtactgtggtgttggatgtggtaaagggtagcctgggactgagtattctagaaaaattgctcagccttgtgctgtgcacacctggttctctttccagtgttatttatgtagctgagaagggcaatgtcacccacaaggggatttagcaggacacagcagacttctttttctcccctataaaaccaagacatgcaggcacagtggctcatgcctgtaatcccaacgttttgggaagccaaggtgagaggatcacttgagaccaggagttcaaaactatcctgggcaacacagcgagaccctgtctctacaaaaaaataaaaataaaaagttagctgggcggagtggtgcgtgtctgcagtccctgctactcgggaggccgagttgggaggatcgtgcaagcccaggggtttgaggctgcagtgagctgtgatgacagcattacactctagcctgggagacagagcaaaactcttgtctctttaaaaaagcaagaaacaggacagaatgcatctcattttctttttttttttttttttaaagacagagtctcttgctctgtcacccaggctggagtgcaatggtacagtctcagctcactgcagtctccacctcctgggttcaagggattctcctgcctcagcctcccaagtacctgggattacaggcatgtgccaccatgcctggctaattttgtatttttagtagagacggggttttgtcatgttggccaggctggtcttgaactcctcgccttaagagatgtgcccgctttggcctcccaaagtgctggaattacaggcgtaagccactgtgcctggccatgcatctcattttcaaacagtccctatacctttgtcatttaacgttctattcttttagtatgtgaaaaccaaactctaatttacaagtcacaaagaattatccaagacagactcccattgtggacatgtatgtggcattgctgattcacagctactgtactgaagccttggccaccctggaggaccctctctctttttgctggacccttctgcacagtgactgcagtagggagagtcagacctgggggtgggggagaggttttttggattcctctctgggtagatgtgtgttgggaagtagtgaaatgttgatagctgcctggctcatctgatccagtaaacataactggtgcgtttgggttgaaagaaattgggctttccttatcagttctcagttataagaacatcagtcagcagtacattagacttaagctttgcattccttgcgtttttttgtttgtttttctcttcctggaaaaaagtttgcttctctcataccatctgacttacttccaggcttttctcccttgtggaacgagtgccgttgagccctgctgcactctcagacgggctcctccgaagtgccgcaggtggtggtaaatcgactctcacccactggggtcgctccttcgtgtctccccccggtcggttcatctgttgctctggctgcaggaggaacgagtgagcttctggtcggcgtctgccatgccgtgtcaccccggcttctggcacctcctgtgcgtgcccaggattgtgaatgtgggccgtgtgtgtgaggccacgggtctccctgcagccactctcctgctggagctctgttactggcacctgtcgctgcctgcaccgaaggctggcagcacctcctggagcttgggacccagagcacagcctcccaccatgagatgtgttgtttttctgtggatcagtcctcctttctttctgagcctggcgtgttttgttctagtttgttaccgtcctaagtgcctgtaggccctgctctccagggacgagactcgggctctacccccaactcagaacccagagcaagagtggtcgggcccgggcccacaacagtgctcagctgtcctgctgcctttgtagttcaagaagtgtccattgatgaggggaatggtcctggctcatgctggagttcctgactcgcatccctgtggagatgaacttcctcgtcagggcggaggcctgccaagcagtccccccaggcttctcttgctcacctttgcccatttttattacgaaagaaaaccagttccttgatagataccaggaccatcagcctcaggcctggaggaggagaggaggatgatttgggttcgggctgtaagaggtgtgccactgagaaggagggatgctgtgagcaggcttaactgagctcatggttcagtgggagttgagtgttctcatcacaggctttggtggaatgtactcttgacatctgtccccaggagcctggtctccagaaacaccagctcaggccctcaaggtctggctctgatggttctgtgggctataggattctgatctgttagcgaggtgtgttcagaagtgtgttgaggacaccagtgcaggagagcaaccagtagaacagaaaggtctggaagcagcattcttggcaaatcttctagattcccaatgcccagacagacctggaggtgctgtgggcttgaacatgtgggtggcctcccctcccaggctgccccgagctgcccaagctttccttgccctggtgctccttcttgcagaggctacacgtgccctctccacctgcccaggcactgagtttctttgttgcgatcaccttgtctgttgtccctctgtcctcaaagatgatcacggaagccttggcccaaggtgggatgcacataagagcccggttcccgcctaccaccgctgtgtccgccatcccgtcaagctccatccctttgggcagacagcccatggcacaggtatttacggggcagcgcccagggcacggctgggagctcggggcgtcctctgagcgcctttgtaaagcgcacctgtcattatcatcgccggtgacttcttttatggtggctttcagagtgccaaacccacagtccctttttttttttttttaaatgaagccaagcccagcttgtgcttgttgagaggatatgaataaatatctgggtcttttcagcttaaaatagttatactgtacgcattttcatggtaaaaataaaacagcagctaagcaaaagttttgctttctagagctgtgctatctaatagtgtagccactaagcatgtgtggctgtttacatttaaattgactaaaattaggccgggcacaggggcttatggctataatctcaacacctcaggaggccgagatgggaggatcacttgaggccaggagtttgagaccagcctggttcacatagcgacatactatctccaattaattatatacattttttaatggaaaatatatatataaatgtatatatattttaaaaacaaaaaaaaaacctaaaagtcaactaaaattaaataaaatgaaaaaatgcagttcttcagtcgcaccaaataaattttaagccctcatttgcccacagggaagctagtggctgctgcagtggacagcacagactccagaacgtggccaatgtggccaaagtggtattgggccatgctgttgtagagtttgatgtgtagagtgtgtaatttgtaacacagatcccctttctaggtagaggtagacttctgtgtacattatgcttttcagagacaggaattcccggcttcttttattgtatgaaatttggaattactccatggcatagtcatttttttaacaaatagttaccacatgcattctgtgtgccaggcactatgctaagattctgagaataaaattatgctgaagttctctcatcatacaggctttccattttagtgggtttgtcgtgaaaacatcaaatttgccaaaagaactttacaattcagtttctgttttaggggaaatgcctctataatcctagcagacagtggtccctgtccatccctgaacgcccaggtgcaggcactgccaccaccctggcttgtgcagtggcgtctctgcagctctgttctacacaggaagaagtggaggctgagccaggatggcccttggtccatgtggccccaagcctggtgccacacaccacacactgccaagaaagtggcctgggcccccactggggcatgtttagcttttgccttccctgcatactaaccccctgggttaccccagatgtgccattcacatagttactgactggaacttagtttctttggcagggacttcctttttagtagttgttgaattacagcgggaggaagtgcctggaatctgctggtagaaaggctttggtgaaagagctctccagaggagcggaagttgggggtcaggaattaggttgtgtggctgtggtggaaaggaggccagtgtgggcagaagccagggtgcagttccccatggcctggaggctgtgagttccacgacctgctcacatgctgctggtgtctccttgactagacccctttgggttctgcactcttgtctgctaaaactgcttctcctcctttcccatagcctctggcacagtatccactgggttcacagaatcaggttgggttgctgtatgtggaggaatgactttagtagcagcatgtaggactgatttttataaacacaaaaagtccccaatgttttcagtgtgcgatatgtgccaggccttgagctaagctctttgtgtacagagcctcactgtttcttgttgtagcaggtcatagtttgagcatttagccccttttacagactaagagtgcccccagggagccaccaagtcaggatcgagggctcaagtgaaacccttatgccttggcctctcagcaggattcttctggaaactcctcactccccttcctgctgggctgatgacctggcttctccttcttgtttactgggcactcctgggtgggctccctccatgcccccacaagaccaggctctgtcctgggctttggcttgcccatactctgttgtgggctggccactccccacacccagctgctggtgtttccacctagacttctcacaggcagcccctccctccctccctccctccttcccaccagttcccaaacccactcagtctttccctccccagccttccctggcccttagattaagtctgccctgagttatgccagctaataggtctctctctctctagaagcttccaacccccaaaggcaaggaggtaaggtggagcagaggaaggatagagaaatatatgatgaagctgaaaaagttattgccttggaataaatgccatggagaattctggtttgtcctcattgcactgtgtggggtgagagcgctctcatgggaagatgctggctaactgcacacagatttaatcaccaggccccgcccattcgcactggcagtgagaggcacacccctgaacctttggggttgttcactgaggacaaacgcggcagcatttagaaagtattcctcgtcccggcagtagacaaaagccacaggatttatggaaagaggaaggaaggcacagaactggggcaaggttctggttttgttctgttattttgttgtcattgttactgtttgtttttctttttttgagacagagtctcgcacttgtcccccaggcaggagtgcaatggcgcactcctggctcactgcaacctccacctcccagcttcaagcgattctcctgcctcagcctctcgagtagctgggactacaggcgcctgccaccacatctggctaatttttgtatttttagtagagatggggtttcaccatgttggccaggctggtcttgaactcctaaccttaggtgatccgcccgcctcggtctccaaaactgttgagattacaggtgtgaaccactgcgcccagccttgtactgtgtttttaaagcaggtttgttcatgcttgttagctgcaagaaaggaaactggaaggagttgagggagggagaaaagcgaatagagggacaccctggagtggaagcctccctactgcccaggcagctgctctgcagccctctctggtcctggccttccccgcagagggccctccccagctcagccctctacgtccggctgcagtaccaggctcttggtacagtctcccacacctggctgtgggccagccttggggacgtgaggcatgctgggccccgtgtaccaagggcattcacctgaccacaccaggtggctccagaggtgtgcctctgcttttgtgtcagtatctttcaatccagtcccttccgagaaaaagagagcttatctcaggaacgtatctgttgatctcaccaggaattgccccactgtgtcccatctgagctctcaggggccagaacctgctgtctccagtgtgtccagatggccactctgtggccactgtccctccagccacttgccctcagcagtcagcaggacacagtctggagactacactgcccatttgctcttgctctttccttgtggcaacaaattaggtccaagaaaacaggtggagctgaaagagggaatgtacgtgccccatgggctcttctccagagggcagggcccaggctccctccctctgtcttgacggctcatggctgcatcttcctgttacggtgggcatgcctcacggactcaggctaccaggtcaagcaggattctgtgctgggtgcattctggacacagtgctcagcacgggggcccagggggtggcatggcccatgccacaatcctcccttggcagatgtaagcaggcagtgtctttctcactaggggcttgtcctttgactagagaggcactgttgcctccctgttccctgctccaatcccagacctgacatgagaccaaggactgggaggtttctttctcgcctctctggctgcctccccagagcctagagcctgtctttggatgagtctttgcaggggctgcttctcatcccaggtgctggacttggactgcccaccactgacacctgggcacagggcctggcttcctgctctcgtgctcttggaaatgaatgggtgcccttcatttgtttttcttcccactagaaatctccctgcctcccatcctctgggctctgctggctgccagctgccagggtgagacccgtgttccactgcaccctggggagtgcctccaggggacacactgagtgccggagccaggagcaaggaacggttcccagtatgtgggggcgggggtggggatcgcgcagtgccgccagccttgcctgagggttcctctgtgagatggagctccctggaccagcctttttgccctcccacctcctctctggcccactcggtgtccacctgccttcagctccaggctgctgtgtgggtccctttcccagaaatgcagttcaggccattgttgctggggtggtggtgttgctggggtgttgatgtttagcgtgcctgagctcccttcatcactaggatgaccttgagcaagtcacttccctctgagctccctgttcccaacctgtgacacacaggtgacaggtggtgtgcactcagaaactccttccctaggatgtgtgacattcttgtcctggggcctttgctagctgtgacacaccggcgcccgacctctctggctgcctccctaatgccagttgtgtcttcagatgagtctttggggggctgcttctcatcccaggtgctggacttggactgtccaccactgacacctgggcacagggcctggctttctgctcttgtgctcttggaaatgaaagggtgcccctcgtttgtttttcttcccactagaaatctccctgtctcccatcctgtaggctctgctggccaccagctgccctgacctggggcagctgaagaactgagatagacctaagttctgggtgggtgcttggaggccccacgggcgtggctggtgagattgccgcttcagggccaaagtgggtgccgggcttcctgaggttcgagagcagatgagaactcttgagtggcaatgagggctgtgtggtggccttctctgcttggcagcctctgcccagcctgcagctgccttgctcctcagagaagcgctgagctttaggccacagaaaagagctgaccatcttctagaagggacagctgctcaggcacaggcgcctctctggaagaggcagtcaggtagaggcaaggggaggggccctgaccttcaagcaggaagagaggtgagcttgtgagacagctttctggggtgcaggtagagagtagcagcaagtcaagcatgggtcagaaaaggcagagttgggctgagcatggggcccagagtctttgcttcccactcctcggtgccgtctgtggttctctgtatggaattttctggccttgggattttgttgacacctggataagtctagaacatgtgttccggtgtctgggacatgcccttactcctcttcagctagggctctgtgcaccccagcaccgtgaatgcacaggactttggtgggagaaatctctgtacttgttcaactcagcatttagcaaatgaagtcacatcagtccccgtttctgaccttgctaacctttgcgagaatcaccgcgagccattttgctccattaggtagagtgatgaggcccggcaggccgaggctggggctcctgcactctgtccctcctctcccaggcagaggtgtcttgaccacaaagcagtgggaacagtccattccatcggttgatgtcccactgggccagtggctttggatagggacctctgacccagctgtgctggaagtaccctgttgtggtcacgctctgtgccttagccccccaccccctggtctcccagcacacgtggttcaggaacggcctgcacccagcatcccttgcagcactgtcaggcacagcccatggaacaggcaggacagaaagagcatttcgctccaggagcttggtccacgtggtgctgaaagggcagtgccaccctgccctctgctgcctggtggggtggtgaggagggcagcattctgtttgtgggctctgggcctggtccccaatttaaggagcttagaaagcagctgtcctatcccagtactcacagcactgtggtggaagtgcttggggggtggtgtgagccgtggcccgagacaggcgttcatggccagagtgccccaggagaagcactgagttggtctacagaaatggatggtccaggggcctggctcctaggcagactgtgaggggatgcttggcatgcagggggttgactagggtgtgggaaatgtagcagggccttcagggttcccccagtgtgacaaggcatccctctttgctgagagtccctctaggggaggccagacgcccagggctggcaggcagctgttctccccatcaaagcagccatctgtgctccaccccaggaaggtgtgggtgttttacatatgcttatccctgatgcctgggtggtgtggtttcatccctagagtttacggatgaagacagtggtgtccctggtgcagacactggggtgattgatcttatttgtgtcgtggccagcaaggcctggggagcagagcaacagccttgctttgcatacacacagggcctcagaggactcaggtgcacacctgcatggcagaaccaggctctgggcccaggtgtctgacactgagtagctcgcctctcccaggggcgctggtgtgggccgatgcaagtgccaccatgggtgtgtgtgtggctccctgggccacctcactccaattaagcaggtccaggtgggacagcctgggaccagccctgcagcagcatgtgttaaccacaacagatggctgtagccaccaggcttgtccttggtgcagtcagcctgggggctgcgggggcttgtggaagcatgtgggaagacggtcccactggtcagcagagcagggtcctcaccgacccacagaggagcatgtcacaggacaggcaggcgtgtcagggaaggccaggctagtgccagccaagggcattgcctcccagactgcccttttcctcacactcccacgacacagccctcaaagcctgtgcccctgtgggtccctggccaaggagcaagggctgccctgcctgggccccccccgccagccccttggtcacctcatgctgtgtgccaggctgggggagtgtgcctgtgtgtatgtccaggtggcatttggatgaagacacaggtgtgtggtgaggctgtgcgggaggatgggcctatgcgtgcggtgggcaggtggtgtggaggcaggcgggcgggcgtgtggcagcgcgccggctgagcccctccacttccaggtcagccagagcagcctccccatgctgtcctcgccgtcaccgggccagcaggtgcagaccccgcagtcgatgccccctcccccccagccgtccccgcagcccggccagcccagctcacagcccaactccaacgtcaggtaggcctggcctggggtgcccctccccacctggccctcgaggctggccctgcctggaccccggctcacatgtttctctcacttggctgcagctctggccctgccccatctcccagtagcttcctgcccagcccctcaccgcagccctcccagagcccagtgacggcgcggaccccacagaacttcagtgtcccctcacctggacctttaaacacacctggtaagttgggcctgaggtgctaaggtcactcctcacctttatgaggcctcagctcatactgggtgtgcgagctctggggccctcagagctcaagttccccacccgagggtcgagggctgtggcctcacccgcctgtgtcctgcagtgaaccccagctctgtcatgagcccagctggctccagccaggctgaggagcagcagtacctggacaagctgaagcagctgtcgaagtacatcgagcccctgcgccgcatgatcaacaagatcgacaagaacgaaggtaggctgcagccagggcaggggcctgcaccctggggacaccaccaggcttgtgtcttagtgtgtaccctcttctgtcccagacagaaaaaaggacctgagtaagatgaagagccttctggacattctgacagacccctcgaagcggtgagctttgcccacagcccacggagggtccacaagggcacagatagcccagccatggatgggcacttggtgatgatgtgggtttaacaaaggcaccaggcagctctttggaccctggccagaggcctccaaggctccactctggtgtgtgctggggcttcaagcccaggcttcatcttggcccatgcccagcctttgccctattcctggctgctgctgtggccctcatgctgggccatcacagccagacctcatccagtcagcagccaggggcccagcttgcagtggcctgaccatcagctggcccagatgggcctgagcctgacctggagttctgcccctgacttgctggtgaccatgggcaggcgactgcatctcagttaccccatttgtagcccacgtgtgttgtcatgaaaatgaaacaaggtggcgctggtgagaagcaggtggaaggcagggctgctggccacaggctgctgtgaggatcagagctcgggcagtacctccaaactgcatgggcattggcatatacctccctttcacctcaactcaggctatcccccaacccctgtctagaagggtctctctgttctgcttgtctggatagaatgccagtcactattgggtggtcctccaggtcttcatgggttgatcctttgttagggttatagggatgagtggggcagggactggcctacatgacaatgaggcattcacagcctgatcaggggcctggccactgtcccttctcttgacccatcacctcactctgccaaccagggacaagcagctcctggggttgagggctgcctgccttcaactctgggtctgggaacagctggtcaactggtaggagctcctgcagaggtttctgatggctgaggcccagtggcagtagttgggatcctgagcctgagaactgccatgtcttccactctttcagcccaagtcctctctctctgcaggtgtcccctgaagaccttgcaaaagtgtgagatcgccctggagaaactcaagaatgacatggcggtggtgagtgggatgccagacacccctaggggaaccagggctctcctaagagctcctgggagtgctgctgagagggccttcaaggtcagggcatctgggcgggggccgggcctgaccttggaccctgcccacgaggcttcctggccaggtctgctgtgctgggtgggaacatgggagaagtcaccctctgtctacggcccccgtgggtgcctccttcacccatttcagaggaggcagggactgtagggaggataggctgtgggggtgggggattattcccaggatcagccaacattgtctgcacaagggtggaggctgtgagagaggcctcgggaatctgactgtgagtgaccatgggcctggggtgtgaaggccccctaaatggggaaccctcgggtcccgggctgctgaccgtgcccatcctgtctccagcccactcccccaccgcccccggtgccaccgaccaaacagcagtacctatgccagccgctcctggatgccgtcctggccaacatccgctcacctgtcttcaaccattccctgtaccgcacattcgttccagccatgaccgccattcacggcccacccatcacgtatgtccagctgggctgggctttgcggagggcggccagccctgggccgcgtgtgccaggtgtggtcaccatgccgcctccccagggccccagtggtgtgcacccggaagcgcaggcttgaggatgatgagcggcagagcatccccagtgtgctccagggtgaggtggccaggctggaccccaagttcctggtaaacctggacccttctcactgcagcaacaatggcactgtccacctgatctgcaagctgggtgagtgtccagagggccgggactggtgtgggaaagcaggccctgaccgcagccccaggactctgccatccaagccagatggcacagcgcccagaacccaccctgtgttcacgccccgccaggctgtctgctctatcctcacacacaccgggctccagacagcctggccatgcctcagtccccactgccagagcccgcacactctcacctccccaacacagatgtggctttgcttgcctgggccctagggaggtggtaggcaggacctctgggcacccatcaatgcagagcactccaggcttcacgtttggaaatctgagagtcagagagacctcctccaggctttgccacaagcttcaccagaacctccctgggtgtggagtcctgttccagagcagggctgtgaggcagggcaggccggggcttgtccaggtcacagatagagccttctgtgttgcagatgacaaggacctcccaagtgtgccaccactggagctcagtgtgcccgctgactatcctgcccaaagcccgctgtggatagaccggcagtggcagtacggtaggtagacccagaggagctgtctggggacccagggcaagcaggggtcattgtggaaaaccaggcttccactgcagcagggacagcctctgtgtgctcctgcccctccccagctcaggcccctccctcccctcttctggctcctcctgcacagacagcagcgggttttccagtggtcgcctgagagaaaagggtctctgctcccactgtgtcccttcgccccttcaacttgtgtcacgtcagctgtccagggtggttgtgttcagtgggtgaggggtgagtaagcccatggctcagggacagtccccgctcttcccagaggccactagcttcccagaggccactaccttggcagggctgccaggttccactggtagcttgggcacacagggcccaatctgggtgctgtggctccagagagaaccacggtggcagggggcagtctctgagcccagagctggcacacagcagagctggcacacagcagagctggcacacagtagagccaggctgggtccccaaggttgttagaggcagagccctagatcctgttcagatttggttctcactgacgatgaggctctgggaggagagcccaaaggccgggcagcgtgcaggacacatcacctcctggtgcttcggcccgcgcctggggctaccccttcccagagcactgccgggtgtgccaggagcgagcgcagcgccggccgccttaggttcacgcccactgctctgttgcagacgccaaccccttcctccagtcggtgcaccgctgcatgacctccaggctgctgcagctcccggacaagcactcggtcaccgccttgctcaacacctgggcccagagcgtccaccaggcctgcctctcagccgcctagccaagactgcagggatggcccgcagcctcatcggggccaaggacacacgcctcctgtcagacacttctaggtgttggcttccttagagagcctggggttaggttagctttcctgcttttatcttctgccttggggacctgccaaacgaaatcccacacctgtacagaactgggataggcgcagtggagcgggttgcttggggggcgttggccgacttcttagagaaggccctccatgtgacttcctcccaggagccagatgcgatcctcaggctgctctcaccgtggcctgtccacggtccaggtccatctcagcagcgtgagggtgcactcagggtgttgttagagcgtctcgtgtgtgctagacgcacccctactcgttcctatagaacacagaggacataggaaacccttaaaacacacatgggattctctggtcacagttttgggttcaggctatgctgctttgggcaggtggagcaccccccgaggaagcctgcaagtccagggcacaggctgccttttggagggagggctggcccataggtgctgctggctccccgccaccagctgggcctcagccctcacggcattcctgctgagcaccgtggggcacccagggagcaggggcgtcagggatcctgctgccggcacccctgtgccgctggcatgagggccgtgtccccactgtgaaggatgaagagcaaggccctcaggacccgtgtcctcagagcaccacacactgagcacccagagacagcgggcctggcagcgggccgggccatgcagggagcgcctccctatgttgcctgccactctgggcaccggccagcaccctctggtgagaagaggtcccccctttttatgtgcactaccccaccatctgtgattataataaatttattattcctgtgtttgtcagttgttcatcactgtgtccccttctccatgaatctgggctcgctgtcctgtcaggatgctgtcagccttggggctgcctggggcctctgcctcccttccaggagggacttgaggtgctgcagctgaaaggcaggggcaggggtgtggtggggcctgcggtggcaccaggctgcccagggccatccccaccacccagggcctcacctcttgggcctgcagaaggttggtattccacagctggtggatgaccacttacactgctgaagtgtggtgggctttcgcaggtgtggggacaggatcatcggggagtgccatcatctgcctgtccctgtgctggctgcccacccaacagaaagccctggcgttagaggcctctgcttccctgtctctgaaagtcattacagtagccagaaatgacctgcccaggtgggtctgagcatccaggcagcatacttcccccaggcagtgcccaggccagtgtggggaacagggcctggctcccttctcccactgaccagagtgctctgggtgccagatgggggtctcggactggggtctgtcccttcctcccctctgaaggtgccctgagggtcagatgtgcttcagtgggtgaccagctagctgccaggctgcccttagtcaggaccctatacccagtggggcttcttgcttcagggctggtctcaggggacgtgcagagatgcaggagcctgtcctgctggttgcaccgctcaaaatgtgcactctgcaatgtctcagggcagcccggcaactcggggagtaccagagcctggtcctgctctcctagtcccctccaaaggcaggctgtggccaggggcagcaggcactgaccagctccattctaatcaggcccaggaacacaactcacttttcttggtaaaaagattactttgttttcttttctctgagaaagtggtttaggggctgttgctgccccctcttgtgggctcaggtcagcacaggtaatctgcaggactccaggggaggggaggaagacagcgcccacccaatggacagagtgtggacagagcgtggccattgtctgctttcatgagccctggagacaggatcctagagcaagggacacagcagtttgctgactgcagtgtgggagcctagtaaatgtggtcctggggcccttagggtgcaggcaaaccttacttggactgcccttgcaccccaggaactttgtccagcttgctgttgtgaagcagtggctcctcctcaaggtctgccttctggggtaccttagagtaccccagtgctttagagtcttgtttcttgaaggaaccggctggggcctgtcctttccttgagagttggctgcaggtcagacccgacagggccagtcactgcaggcaccaacagccgctgcccaagtctttcaggatcagctgtgtgtgcccaagaagcccctgcctcagttgcctcctctgtaaagggaagcctgccttggagggttctaggaggaataaatgaggttctgaggatgaagcccatgggtggtgcctgtgaacattctagaacagtcaatatagtggaagctggctctgttttgggtaaaataaaactgcatgcgaggcctgggactaagcctgcatgggtttcctctgcaaggacaacgcccatggcacgcctgggctcatcacaggaacaataggggccagggttggggccaaggaagatgcctggtctcgagccactccccgctcactctgcagaagatgccatgagcccagggctccgtgggcagtgccatccctcctgtatcctgtctgcttgtggagggggacgtgggccaagcagggcctctgccaggcagccagtgtacgtccttccccctagaaggccacccaaggaggccccttctgaccgcttgctgtgctggcttggggtgcctgccatgaggccttgctgccctgcgttgacagcccctgtgactggcccccagtcctgcccaccccaccctaggcccctcctggtggtttcagcttacagggctcccttcagctgcccgttcacccccaaatccttgaggttggcccagcagaggactttcagctccctggtcagcacctctagtgaccacccaggctggggtccctgtggggcacttgcccctgtgagcacatggaggacaccagcctgctcacctgacaccatttaattcgaggtggagttgacaggctggaagttgccacccgcacacctgcctgagggagaagccctccgtctgcctgcaggcctgtgtcctccctgctctacccacactccactgaggcagccccagacccaccgcgcgcccaagggagcagaggccccggaaaggttgtttcctgaggggccatccagaaagcgggagggcttgggacccatggagcagcaggtccggagggagagcatggcctcttcccgtgtcctgtcagggtccccagcactgcagggccacactttgcccagaacagctcactggagttgccaccgcagctagggaagggccttcactcaatcccattctctgtgtctccctagaagggagagccctggacaatgccccagctgggatgttcccaggctggtcccattcaccagtcagatgtcctcctgatgtcagccccggccccaaaggtaatagagtgagctcaagaactcaaccagaatcctgggctgggtgggggccaccattgggatggggaagtgccttggacaagtggcagggaagcaggactctggttactccccccacccccatccccacagttgttgctgagatggcaggaaggaatccctggatggggtgtgcccggagcccttctcccagcgtatcaggaatcagagccacaaggctggagatcctaggcccagccacagcagcaatctgaggcaaagacccagcagggtaggggctgtcccagagtcccctcccatttcaggagctctgcttggaggagggaaggtctgggaagcaccctgtgcccaccatcaccactgcactgaccacagcccttgggcttcctgagagcagcacgtgctgtgcttggctgtataacatcgtccagccatggctaggggcagcagcatctgtccaggtccctcagaacctgtcctcactgggttggcatacagaggccagtgcagccaggtgggcaaggacagtctggaggggctccccggggtggcaggagcttcccatcaggcacgaaagggcccaagtctcacctttctcctgtgactcattcattatgagcttgtaatggggatctgaaatcaagcgcatgctcttctcatcacttgtgaagccacagccattctaagagaagcagcttgggctgtccactaccccctgctgaaccccgagagtcctggctcgccactggctgactgggccctgccccacaggtcccgctttccaccacacctttgctgtgggcatgtgagggcaggaatgaccctgcctgttccctaggcagagcccacccagcacatcagcctcatcctcccatctgactacaagacgcccatggtgccaggcaggacctgggccccaggggtacaggggtgaactctgggagcccctggccatggatgagcatggtcagtgtcatgatcctgtgggcatcagggactggggagaggctcaagaagacatggggaagggggatcctgacataacagatgcctggtgatggaatacttagcacctaggtaaggcagcaccagggagcggggagggagatgaggctgcaggcactggtgccctcgctggagcctctgctgaagcagggagggaggagcggagccacatcctggcgggccctctttctgctctggtgggcagtgggggtgaggagctgctaagggtgcagttaggaaggcccagcccgaggacagtgtgggcacaggcgaagccgggggcatgcctgctcctgatccggcatgtttagttggagaaaattcactcagttgtgcaccggcactgggcatgttttccttctacgaagtttttaacagatgtgtacctgaccctgcctggagaggggagggctggcagggtcagcgtttgaaatgatgctgcccccggcgggacaggcagacaaggagggcaccgccccgggcctaggcgggtctccgtcctggggcaggggaagagctcagcatggcaggacctagcgtgggcttgctgccctgtgtcctccctgagcccaggcaggtgctggagttcatgtgctgcgtttctgctctgcgggccgccgccgtgttcaggcgcttggggaggcagggcaggcctagggccctgtggctgggctcacccttgttctcccacttcagatgctcgatcttctagtggagcttggccagcaactccaaggactgctgctgtaggaactgcaggcccaggtccaagtccaggatctgcctctgctggtcgatctggacacccacagaccggcggcactgcggggggtgcgacgtaacctgagatcccggggaccagctgggaggctagctcgcacggctcatgtcgccacccccaactacacagccgctgccactgcaccctggctcagtggccatgctgcccgtcacaatggaaaggggcgtggctgaggagcagggtgggcagctggggcagggcctgtggctggctcttcctgggtgagtacagtctgatttaaaaggcacccagggctgggcacggtggctcatgcctataatcccagcactttgggaggcccaggtgggcggattacttgaggtcaggagtttgagaccagcctggctaacatggtgaaaccccttctctactaaaaatacaaaaattagctgaacgtggtggcacgtgcctgtagtccaagctacttgggaggctgaggccggagaatggcttgaacccgggaggcggaggttgcagtgagcagagatcgcgccactgcactccagcctgggtgacagagggagactctgtctcaaaaaagaaaaaataaaataataaaacgcattcaggcattctctacagcctgggcaacatagtgagaccctgtctctataaaaagtaaaagaaaaaaaattagccgggcttggtgctgtgctcctgtagtcccagctacttgggaggctgaggcaggaggactgctggaatcccggaggtcaaggccgcagtgagctatgatggcaccactgaactccaggctaggtgacacagtgagatgctgcctaaaagaaaaaaaaaaaaagaaatatgtctttctttacaaggcctgccctaaaaaaaaaaaaaaaaaaaaatgttcgccagagccaggccaactgtgattttaccagatgccaacatacccaacccaagggaggaagggaacatacccaatcccagcctgttctagctcctcttccccacatcttcctgccacatcaatagggctcctgtataataacaggggatacaagtgaaagaacagcccatctcagaacttatttgagaaatgtctaggaaaccctaaagacaacagggagacaaaaactaagacaccagaggaagtttatgcctctgacacttacagttagaacaaacagcacacatggcccaacccctaaccagagcaaaataaaacctcacacaggccgggcgctgtggctcacccctgtaatcccagcactttgggaggccgaggcgggtggatcacgaggtcaggagttcaagaccaccctggccaagatggtgaaaccccatctactaaaaatacaaaaattagcgggcgtggtggcaggcacctgtaatcccagctacttgggagggtgaggcagagaattgcttgaagccaggaggtagagcttgcagtgagcggagattgcggcaccgcactccagcctgggtgacaaagtgagactctgtctcaaaaaacaaaaacaaacaaacaaaaacttcacacagaaagcccatttatcacgtaccccgtacagcatgtccagctccccacaaaaaatttcaaggcataataaaaaccaaaaaatgcagtttgaagagacagcaagcatcagagccagactcaaatatggcagagatgtcggaattatcagaccaagaaatggaatacaactatgattaatatgctaagggctctaatggaaaagtggacaacatgagattacagacagaaaatggaaacagggatagacactctgagaaagaatctaaagaatatgtgaaggccgggcacagtggcttatgcctgtaatcccagcactttgggaggctgaggcagcggatcacttgaagtcaggagttcgaagaccagcccagttcgagaccagatggcaaaaccccatctctactaaaaaatacaaaaattagccaggtgtggtggcatgaacctgtaattccagctattcaggaggctgaggtgggaggactgcttggacccaggaggtggaggttgcagtgagctgagattgtgccactgccctcaaatctgggtgacagagtgagacaccaccaaaaaaaagaaaagaaaagaaaggaaacaaggagaggaaagaaaggaaagaaagaaagaaagaaaagaaagaaagaaagagaaagagaaaataaagaaaaagaaagaaagaaggagaatatgtgagaagtcagccaggtagtgactcatgactgtaatcccaacactttgggaggctgaggtgggtggatcacttgaggtcagcagttcaagaccagcctgggcaacatggtgataacccatctctactaaaaataaaaaaattagctggatgtggtgtcatgcacctgtaatcccagctactcaggaggctgaggcaggagaattgcttgaacctgggaggtggaggttgcagtaagctgagattatgccactgcactccagcctgggcagtaagactccgtctcaaaaaacaaaaagaaaatataagaagtcaaaaacacaacagaatgaaagatcagggctggcagcagtggctcatgcctataatcccagcactttgggaggccaagttgggtggatcacctgaggttaggagttggagaccagcctggccaacatggagaaaccccgtctctactcaaaatacaaaaattagctgggtgtggtggcgcatgcctgtaatcccaactacacagaaggatgaggcaggagaattgcttgaacctgggaggtggaggatgtagtgagccgagatcatgccactgcactccagcctgggtgacagaaggagactctgtctcaaaaaagaaagaaagaaaggtcaggtgcatggctcatgcctgtaatcccagcactttgagaggccaaagtagaaggatcgtttgagcccaggagttggagaccagcctgggcaatatagccagaccctgtctctacaaaaaattaaaaaaattgccagcatggtggtgcacatctgcagtccctgctactcaggaggccaaggctgcagtgagctgtgattgtactactgcactctggcctgggtaacagagagagaccctgtctcaaaaatggggtaaaatggtataggaaatttggatctaaaaaaaaaaaaaaggaagtgcattagataagaaataaatgaagataaaatagaatcttttttttggtgggggtggggaacggagtttcactcttgttgcccaggctggagtgcaatggcacgatcttggctcaccacaacatccgcctactgggttcaggcgattctcctgcctcagcctcctgagtagctgggattacaggcatgtgccaccacgtccagctaattttgtatttttattagagtcgggggttactccacgttggtcaggctggtcttgaactcctaacctcaggcgatctgcctgcctcggcctcccaaagtgctggaattacaggcatgagccactgcacctggccagaatcttgtattgttcttatttttagttgaacagatggcaggttattcaaaataattatatcaacatgtattcagtaattatagcttatggatagctggaatgaatggcagcaatgttataagggatgggaaggaggatatcctgagtggaaagaaagtcacccaggctggagtgaagtggcacaattatagcccacttgcagcctgcaactcctgggctcaagccatccttctgcttcagcctccctggtaactgggattacagacacacaccaccatgcctggctaatttttaaattttttgtctcgctgtgttgcccaggctggtctcaaactcctgggctcaagaaatcctcctgccttagcctcccaaagtgttgagattacaggcgtgagccactgtgcctggtttatggttgcttttgaatgtcctagtcctacataagtggcttccaagaagggaaaaagaaaaatgcaggcaggaaaaggtgctgatccataaaaacctctggaaggtatgtctctagggagggggtgagtgttgaggagggatgttgcaaacatggtagtggagatggcaagagtggctgcctgcctcttcgtctgcacttccacaatctgaagcagccatcatcaatcggaacacagatccccagtatttggaggatggggctcttattgcctgctgtggctcctgcaagctatagggaagctaccccagaagtataggcatggctgcttgcaccaccaatttaaatgctaattacttctgaaaacaccctcacacacatgcccagaaataatgtgtaaccagatatgtgtgcatccagtggcccagacaagttgacatatagaattaaccatcacaagtccaccccttgtcaacctggtacctacacacatctccttaaaccatacttaacctccaaataaacacaataacaaagtcagtgttagcagtggaaggtgtctgagttagtggcagcgaatccgtatgggtctgcagcaacctcaattcttgcctcctcagaaaaaagaattcaactggccgggcatggtggctcacgcctgtaatcccagcactttgggaggccaaggcgggcagaccacgaggtcaggagatcgagaccatcctggctaacacggtgaaacctcgtctttactaaaaatacaaaaattagccgggcatggtggtgggtgcctgttgtcccagctacatgagagactgaggcaggagaatggcaggaacccaggaggcggagcttgcagtgagccgagatcgcgccactgcactccagcctgggcgacagagcaagactccgtctcaaaaaaaaaaagaattcaactgaggggcataaggcagaaaaagagaccgaggcaagttttggaggaggagtgaaagtttatttaaaaaagctttacaacaggaaagaaagtattcttggaagagacctaaacaggcacataaaggtcaagtgcggtgtttaaccttgattctaggactttatagactgacccctttcccaagattcttcccctagggtgggctgcctacatgcacagtgtcctccttacccttgggagatgagcacacgcagtgtgtttaggaaactgtacgcatgcccatctgaagatttcttccgtcccagaaggtcatactctgccattgtctcttaatgcacatggccggggaaattgcttctccctggtgcctgcattcaattaacactttaatgaaacaggtgtgacccatcaggaactggcctctccctgatgccagctgccaatttatcactttcatttttaatttattttttagaaggagtctcactctgtcacccagactggagagcagtggcatgatctcggctcactgtaacctctgcctcccaggttcaagtgattctcctgcctcagcctcccgagtggctgggattagaggcatgcaccaacatgcctggctaatttttgtatttttagtagagatgggctttcaccatgttggccaggctggtctcgaacccctgatgtcaagtgacccacccaccttgacctcacaaagtgctaggattacaggcatgagacaccatgcccagccctggctttttttttttttttttttttttttgagacggagtctcgctctgtggcccaggctgtagtgcagtggcatgatctcgcctcgctgcaagctccgcctcctgggttcacgccattctcctgcctcagcctccagagcagctgggaccacaggcgcccaccaccacgcccagctaattttttgtatttttagtagagacgggatttcactgtgttagccaggatggtctcgatctgacctcatgatccgcccgccttggcctcccaaagtgctgggattacaggcgtgagccactgtgcccagccgctaattttttattttttattgtttgtagagagggggtctccctatgttgcctaggctgttttgtttttttttttaaacagagacagggtcttgctatgttgcccaggctggtcttgaactcctgggctcaagcagtcctcccatcttggttttccaaagtgctaggattacaggcatgaaccaccaggcccggtctccactgtgaatcttttttttttttttttgagactgagtttcactcttgttgcccaggctggagtgcagtggcaccatctcggctcaccgcaacctccgcctcctgggttcaagcaattctgctgcctcagcctcctgagtagctcagattacaggcatgcaccactacgcccagctaattttttgtatttttaatagatacaggttttcaccatgctacccaggatagtcttgatctcctgacctcatgatccacctgcctcagcctcccaaagtgctgggattacagatgtgagccaccgcacccggccgctaatgttttattttttattgtttgtagagacagggtctccccatgttgcctaggctgttttttgttttgttttgttttgtttaacagagacaggatcttgctatgttgccaaggctggtcttgaactcctgggttcaagcagtcctcccatcttggtctcccacccaaaatgctaggataggcgtgaaccgccaggcccggtctccattgtgaatcttttttttttctttttttttttttgagactgtgttttgctcttgttgcccaggcgggagtacagtggtgcgatctcggctcaccgcaacctccgtccgcctcctgggttcaagcgattctcctgcctcagccttcctgagtagctgggattacaggcatgcgccaccatgcctggctaattttgtatttttagtagagatggggtttccccatgttggtcaagctgatcacgaactcccgacctcagatgatccacccgcctcggcctcccaaagtgctgggattacaggcatgagctaccgcgcccggtttaccattttgaatcttaagaggacaaagtctggttctctagaaggcccgagtagcttttcccctgagcatcttgagaaaaaagtgctctgagcactccttgggaagtccgagacagcacatgcagccaggtgctccctggctgctctcccagaggtcagcacagctggaggcagctggagggaggaggctgcagaggcgctgaagccaggaagacccaacagtggagagagaagttgcctggtgactgaccctcggcttgaccctgtgctcccctgggctgagctgggtgtcaaaaggcctccaccctccaaagtgccagcctcctgctgtggctggaaagcatttgctcctcctcctcttctcacttctttgcattcttctgatctcttaagggcgtacaaagattcacatggatattaaagtcaatggtgattttcatagctggaatactcgttgggagaaagtaggaattcttttttttttttttttctcccaagctcaagcgatcctcccacctcagccttctgagtagctgggaccacaggtgtgagcctccatgatggcctggctaattttttatatttttagtagagatggggtttcaccatgttgctcaggctggtctcaaactcctgagctcaggcgatccacctgcctcggcttcccaaagtgctgggattacaggcgtgagccactgtgcctggccaaaagtagaaattcttgattgggaaataattttatatatttcggccccttctcacttgggaaaattctgctaagaattctggttttgagagtcaagggaagctagcttaatttttaaagtgaaggctacataagagtcctctctccagtgtggtggctcacacctataaacccagcgcttcgggcaaatcacttgagcccaggagttcaagaccagcctggcaatgtagtgagacccctatctctacaaaaaaatttaaaaattagcagggtgtggtggtgcgtgcctgtagtcctggctacttgggtgggatgctgatgtgggaggattgcttgagcccaggatttggaggttgcagcgagccatgatggtgcattgcactccagcctgggcaacatggcaagacctcgtctcaaaaaaatacaaagagtcctctctatgttggaaatgtcagagttattggccatttaggggatctaacttgctctttgatgtccaagaggaaaggtatagagttctcctgattacacagggcctctgcttgtgggtcgcctgcatgaggcgatcagaatctgagtcacctgggatcatgtgggtgctggtacatcctagagataggatgtgttggtcatggaagagagtgggccacaaatgggttccaggggaatagcgttgcctggtgcaaggagggggatgtggaggtgcagggagcaggggtggtgtctggagagcctgaagctgtgctgccagaggctccaggccatgaggtctgagaagcatctagatttggcctgttcacagcagggaagtgtggtccagtggcaaaaagttgagggcatcctaggagttgaggaggtggtggcggttagagtaaaccactctggaggcgtccggggtggagagacgagaatgtgcaagaactcctgcctctagcctggcctcctcaggaccccggccaccagcctccctcctagaagtccccagagcttcctcctccttgtgccccagaactggttcctgggttgctccaaccccagaccttccctggaagtcccccccagtgcctcctggctgggaacccccaactgcattttgcttctgctctcgtgccagtagtccccttttctctccagtgtccaggccccaaccaccaagaccctgcctcctcacttggctttgctgttcttagttctctactcagtaggttgtgtctgcctccattcctggccagacgctgccctggggctgagtgcacagtccccagccactcccgagatcctcagagcttctggaagccacagacatggtggcatatgtttcaggtcgtcagcttgtttttttttggagacagagtctcgctctgtcgcccaggctggagtgcggtgacgtgatcattcactgcagccttgaccttctgagcccgggtgatcctcccacctcagcctgtcaagtagctgagaccacatgtgtgagccaccacacctagctttttgaatcttttttttttttttttttgagacggagtctcactctgtcacccaggctggagtgcagtggcacaatcttggcttactgcaacctccagctcccaggttcaagtgattctcctgcctctcccgagtagctgggattacaggtaggtggcaccacacctagctaatttttatgtctttagtagagacaaagtttcaccatgttggccaggctgatcttgaactcctgacctcaggtgatctgcctgtcttgacctcccaaagtgctgggattacaggcgtgggccacgcgcccagccaactttttgaatcttttgtagggatggggtcttgctgtgttgcccaggctgggcttaaactcctggactcaagtgatcctccctgccttggtttctcaaacttctgggattacaggccaatctactcaacgttgatattgagtagaaggcaaaattcacatggctccggcccagcccctttctgtctcaggcacttcagtgttaatatgcgccttggttttgctgctgccgagtctactgtgcccctgggcaaggaaagcaaaggaaaccagagggccaggcccgtggacactggggtgaggggccaacagggtgcccagcagttgtttccacagcccccacgtggtcagggaccctgtatgggtgaaccgcctggatactgagcctaggcggcggaaaactcaaaagcaagggcaggtttattcagatccctggtggagttacaagcttggtttggtttttggtcacaggccctaaaatacctgtattctgagtttacataaaaatacaaagcactggccgggcgcgctggctcacacctgtaagcccagcactttgggaggctgaggtgggtggctaacatgaggtcaggaatttgaaaccagcctgactaacatggtgaaaccccatctctactaaaaatacaaaaattagctgggcatggtggcgcatgcctgtaatcccagctattcgggaggctgaggcaggagaatcacttgaacctgggaggcggaggttgcagtgagccatgatcgcaccgccgcactgcagcctgggctacagagcaagactctgtctcaaaaaaaaaaaaaaaaaaatcaccaccgagacgctgttctccctggtgtgtcatctgtggggtgaatgaaggtgtgagataccccgtggtggtttctgtcagtgaatctgtagttgtcatatattttgaatacttcaatatcatcgaacagttgctgtgtctttaagcactagattttattgaagctaccttcttccctttttagtcccatttcccctagatgcatccacgactgcaggaacccccctgcccccaccaggagcccaaagataaccatgttcccacctggagtggcctcccacctccaatgccatcagggctggtgcagcttccccacctggtcagcaacatcatggccaaggagtagagggcgtagcccagggtgaacagcagtgcacaggtgaggggcctgatgcagaacagagaggccatgaagaaagccagcagtagccagggcagtgtcaggtagctgcctaggaagtgcaggttgagcctgtggccgctggccagcgtgggctctgtgaggtggtagcaacagaagctggcaaggaagtcatctcaggaacacagagccgccatctggtctgcaaactgaagcgcaggcagtggcacgggggcatggggtggtggcaccacaggcctcaggacagctgcaccccacccccacaggccaccctgagactgcaccccaggcaggagcacccagaaccctctctgaagaggccaggccagccctcctgcccactcactctgtgtttgatggcagatgacagccggaaggatgctcagaccaagctggtaatctcataactccagaggggctgcagctccgggtccccctggtactcaatttcaaacctttgcagcctgttgatgatctagaaacccaggctatagggttgggccagaaaacatggccctggccaggtgcagtggctcatgcctgtaatcccagcactccgggaggccgaggcgggcggatcacaaggtcgggagttagagaccagcctgatcgatatgatgaaaccccgtctctattaaaaatacaaaaattggccaggtgcagtggctcacacctgtaatcccagcactctgggaggctgaggcaggtggatcacgaggtcgggagatcaggaccatcctggctaacactgcgaaaccccgtctctactaaaaaaaatacaaaaaaaaattagctgggcttggtggcgggcacctgtagttccagctactcaggaggctgaggcaggagaatagcgtgaacccaggaggtggagcttgcagtgagccgagattgcgccactgcactccagcctgggctacagagcaagactccgtctcaaaaaaaaaaaaaagttagccaggcatggtggcatgtgcctgtaatcccagctattcaggaggctgaggtgggagaatcgcttgaacccaggaggtggaagtttcagtgagccaagatcatgccactgcactccagcctgggcaagagagggaaaccttgtttcaaaaaaaagaaagaagagaaaaggaaacatggcccctgcacacaactcagaagagccaagccatctctgctcacaggggaggagggagctggggacacgtcagggcccaacccatgcacctctgggacttgggcctctcacctggtactggcccaggggcgtggggatgagtctgtcctcacccgcgatgcagtccggagctgcttctttccattctcatcctggatggtgtccaaggcaagtgtgagagactctgcgtgagctgcacttcactgagctaccagagagagagaagctcctctgccctcagtgtcaaggcaaaggaacaccagtcttcaccccaccagcctctaacagtggcaacgagagcacccggacatgacactcggggtgtgggcctgcctcccacaacaccgggttcatctgcatggggcctgggacggatgcatgctgaccatgggcaaagggggagtggatccttcggggaaggggaccctaacggccgtggaacaggccccattgctcatactcggaatatctggcgcaggtacgccagggcctcctccaggcactcgtccatcttctggacgctgtcctgccccatctcgcccaggtcatggctgaataggagccgttggtgtctgtggggccaaagcccagccacaacaggaaggagtggccagctggagtctccacacactggtccgagatggacctggccgtgtgcttggcctgcgtgatgagctgagtaaggtgcaggacctgcaagggaggcgagggcaggtcaccggcaggatacgcctgtactgccacccaggcaggctggctgggggccctaagatgggtgcacagccagatcactgagtgacgggaggagcagcttctgctggaggacttttaaagactaaagaatgatcttctaaatgtgaaatttcccaacactgccttcgttatcagaaacaaatcagactttactgaaacggggaaaggagatgtgcgtcaactctccgcccaacctccctccctcccgccagaacacagcacttccctgcctctgctcagccttgtggctccaggggtcctgtgaaggggcaccgccaacccactcaccagggtgtaagcctcgggcccgaacatcgggtgtacttgcagtcctggccctccaggccatagatgtgactcttcacattgaaggaggcatcagtgaccactggtggccactatgacaggatgctgctggcgaatgtgcaggctgtgaagagtcggtgctggcggtagggggatgacgagctccggctccgggaacagctgctcgaactggaaggcaggagacgaacctagcgcccacttccgggggcacagagaacctggttgctgcccacaggttttcaggatgcctccgaggtatctggggagccatgacccaggggtgtcctcctgaggtcctgcccagcagtgtctcccatgtagcaggtggccgacatggggagggcaaatgagggagctggtggctcacagagcccccgacagtgtctgcaggagggcaaacaccaggaggagtgacagaagccaatgtccaacccagccaagacaaacgcatgccagagaccaagaccgcctcccaaggatgctgccacgagttgccagggagaaactgtggtgccatgggcccgcagcttggtctgtgcagaccccctctgtgggtatacctgcggtcttccacccagtgcctggtgcctggtggctgcagggcaggcagggtccagccggtctcagccttaactgtgcagtgttatggatgacagctcaggagactgttggcaggcagggagggcaggacacaggcaggtgagacccaggccctctgaggttgctgcatccttagcaggcctgaggcccctttccaagaggactgaagccaccatggcagaggccagcccagagcctgagggggctgagggaggatcccccagagggtccaaaggggaaggcctcgggcaaggaaaggagaggtcagtggccacgccaggtgccatggaagcctgggggggtctgctgtgaggatcaagcaggagatgaggggaaggtggccactggtctgctctgtgctggtaaggaagggttaaggaacagtttgggggtcaccatgaaaatttgtctgggccagaagggagaggggacaggtcacccactgcttccatgagaaacccattctagggcctggcgaagttgagcctaggaagggctggtctgtgctccactcagcagcagctgggagagggccagggccaggctgaccccagcacaggccgctgtcttggcctccacccactggagcaacatttgcccaggggagccagtggcatgtgaggagagggggccagggctcaccatttctcagacacactggggctgggagttgctgctggcagcctgcttgtcagctgcataccaccatggctgcaggtagctcagccacacctccaggacctgtgggggaggtgtgtgctgaaggcccagtggctggggccaaatcctctgatggcctggaacccaggtacccaggtggcagctaagttggctcttcccacgtcccccagagggcgcaggagagacgcgcacagccctgtgagatttggttctctcactgctcttcagaagccagggtcatgggcgggctcttcccggcccacgggacccagtgctacctggttgcgtaagagtagaaacctgtctggcaccagacaggtgggatggggcagggctttgctgtgcctgagggttgcctttggaaactgaaacagaaagaacaacgtggccctccaaggccccctcctctccaaggtctctgtgacaacacttgttctccttcatccaccccaggggacctccctcattggggcacacagaagacacaggcacacatgtgatggggccgacactcctagctctgaacaatgcgtccaagggccagtggccaaagcaatgccgcaggaagaggtagagtttctgctggactaacctcgggacagcggcctgcagaggaggggagggtcaccagccgcttgcacagtaaggtggccctgctcacagatgagcccggggttcccattagtgagggttggctctgctgggagagagcactaggcacttctgagtggtaagagctggtttcagccccattcttcagaggaagaaaccgaggttagggagcatcccgaggacacagcatgcaggcggccaagccattgcatctcctgcacacacctcacctcagccccacacaaaacagcccactctgccagccccgatgggcctgggagtcaggacccgccccaacccttctcctgacgggtggggaggagcaagagacggcaccgtgatggggcctttttggccagtctggagagagaggctctgggagccagagatcagccggcagccccaccaggctagctgagaaggcacttgcgtagccctccagaggcctcacgtgctctgtgagcaggaagggattcccctcaccctgccccccatgccccggggagaggtcgccgtgggcaacaccggaggaggggaacgaggaggagacagcagcggctggaagccgcaagggccacccactgtttgaactcccccagcgggctggtggtgtgggagtggacgaaaggtgagacctgctctggcttcaggctgtcggcaaaggcgtgcaggtgcttcagtggcaggcgcaccaccagcatgtgccccttggtgggcatgaacgactcctaggtggaggaagaggagtcagggcctgggaagggctgcagcacgtggcctccaggtctgaccacagcccgccctgggacagctgatctgcctccacacaggaggcacgagccaggcaaagagtggggccaccactgtgcctcacacccagcgggtgtgccttgcactgcttggtctgaactgcgaccagctcgtggtagggaagtgcttggcccagcgcccacacagcctacctggggagaactcgctgagacagacgcatctgcttctgcaccgctgcacacccgcggtgggtggcacagggctatggcccgccagactgtgcccttggccattgctgcctatcttgatcctcatggcaggaggaggccgatgtcacccccaagctctggatccagggtctcccagggaagatggctaaggccaggaattcgagattcgcttgggcaacatagggaggccctgtctctacaaaaattttaaaaagttagctgggcatggtggtgtgcacctgtagtcctagtgactcaggaggctagggtgggaagatcgcttgagcccaggtgttcttggtgcagtgagctaggatcgtgccactgcactccagcctgggtgacagagtaagaccctgttcaaaaaataagaaccttcacttttctccccaattccttccatctgctcctcattctggacacagctggatgagggctcaccctgggagaagcgctgggcatcaattcctctgttgcccacagacctgtggtcaggaaaaccccaagacaagagcacagtcaagctaacaggccaagcttttgatttacaatgtacaagcaggatcctggagacctacacccaagaggaaagcctttttgctggctgtgggctttctctggttgctcagcattgagagggcaggggggagcatcaagagtggatgagggcaggagaagggggcactgagggtgggcccctgagtccgagtggacatgctcgcctctccatgcttacccccagccctttgggcctcaacacatctgtgatgctgagactggtgcagggcccggcctctgggtatatcctgggatgctgcagaacccacatggaccactgctcacatcactgcccactcaagtctgcccgtcaggaaaatgtccccacaggtccaggagacacaccccacagatcagtggctgaggctgggaatggaggtattttcttcttcttctttttctttttttttttttttttgagacagggtctcactctgtcacccaggctggagtgcagcagcacaatgtcggttcactgtaacctctgcctcctgggctcaagggatcctcccaccaaagcctcccgagtagcggagaccagaggcacataccaacatacccagataatttttctatttttttgtagaggcaggggtctcatcatgtttcccaggctggtctcaaactcctgagctcaagcaatctgccttccttggcctcccaaagttctgggattccaagtttgagccaccgtacctggctattttcttctatctctatctttaagtatttaggcaatgaatttgcattgctttggaaggaaggagaaaaccagtacctatacggcccgactagaatggtactagtggggtgggaagttagaccagggtccttctcctccagtctcacccctggccctccctctgatcctggcctgggatcctgagccatgacatcctccctgcagctcacgggaggggacagcatccacataggaactgggaacctgccttcccctgcaggttcacttacccaacatcacctggtccttccagagggtctggaggggccagtgtctgcccctgcccccagcagtcacatgaaagcctctcaggctattttcccacagatttgctgagccaaacttttccctcagctctgtacccctcctgggccacattcccatgtgtagtccctggccacagtcacacctgcttgcttctcaaagatgtgtacccaaagccccgcatttcccactgggcccagcctcacagcacctcagctcactcctccagggtctccctggtcacctgtcctgccatgggggttgctagatgcttcctggacactgccctggcccaagccctcatgtccctcttctccagtggctcctgcggaacagggacgccatcacatgcagtggttgccatcccaacccaccggcacttggggcccacatgtttttttcatcttgcgctcaaattcccattcaatcacgtgtgctccttcgcagggtgaacgggacagacccctggctgtgggcacagctcgtctccccgggctctcacagactcactaactctgtcgtccccgaaatcccccatgggcctgaactctgcttcactgacctcaaatccatccatacgcttgtcatttgtgcctaggcagaccacaacctctatgaggtcactacctattctcatccacctccacaggtgtctacgagtggccagggctccctaggtgaaggactgacagcctctgtgagctatagggccaagccccaggtcctccccaacccccttgcctcacacacagtctgggtcatggaacctccaagctggatgacagttctgaacagggcagcacccacattaccgtaagtcccaggcctctgtgtcttcagctccttccttagcactgggccctgcagagtgggggtgaaccgggccactgcagaggcctcacgactccagctcttcaaaccagggccgagcacagagcctccaacaccagagaacttgtgacacctccaccactggtggggagtctggccagcccaggccacatgcctcattctgacacacagccacaccccactcccacaagccaggctagtctgcaaagccaggggccaggccaggctggaggctgatctctgcctccctcaacacaggggcttcactctgcctgaaactagcctctgagtcacctgcagctgggcccagccagccccttgctttgccaggcgcagacacgcactccgggcaggggaagggaatgaacgagcacagccagtacttggtaggtgtggagggcctggaggttgggctgccgggggctgtggtgggcactggagacacagagtcggtagtgcagcacctccagctgagagagtgaacagagagaagccggaagaggcagaagagaaaagcatgagaggacagggtggtgaaggagagacatggtaccggacatgggagggggaagtggagaaagaaagcaatgagaacgagcccagaagtgaggagaaaaaaacaacaaaagcatggtcagtgaccatccaaacaactgcagtcccagcagctgtgaccagcgcagcaccctcctcggcagccaggccagagctgtgacagcactctcctcagccttggaggctgggggcggatagaccctccaggtcacctgggtggcctctcaatgtcgctggggcctaaaggcctctccagctcattggaagggcccaactcactgcccttccagatgggacccgctctccccagtgactctgaggccacaccgtgtgtgccatgtgcacaccacagcccttcaagtacccagggccttctctctgggacatgctgtcagccaccaaggcctcaagatcctgaggcccagaaaataaactggcaaagcatgttctaggaggaggactctgcctagagaagacacatatgtaattgactggatttccctgggttgttttgagaaatttatcaaatttgtatatgacatgatcaattcctatgtctaaaacccaatcaatgtcccctccatgagtggatctctctgagagctgaggatgaggacaggtccccaagggtagcacaggctcaggcccccaggccctgccctccgcactcccccagcctggaggtcagccgaggtggtgtgtgcatcagctctgactccaggaggcaacctctcctaccgcatcaggaactcccaccctccagatatggagggctcccaagggcaggagcccccgaggacctggccacagccacacacacccagaggcaacaggaaactgaggctaagctggcccccagccaggaccctccaatctaccaccctgcagcgctgcagcctccgaagcaccccttcggcccagcatagccagagctggcctggtgcatatcctgccccgtgagcgccatgcctcctgcccaagtagcacgaccactgggctccacacaggagacatcagaacacacctgctagatgtcacaacacgcagagcagggcgggaaggagcagggcagagagatgttgcccttcacagccttcctctgtgccagacctagggctcaggcaggaaacagacacacagttctccagtgcgtctctgcccttgcctaaggaacacggtggcttgtggggccattggccatctttatggcccacggggccaccagggagcaagcatgcacctcggattcaaccagggtgtggagggcaaccctgggagcctcacttcctgcatctgaaaataagagctagcagagacaggcagggatttctgtatggcaggagcagcataggcctgggcaagcggcaaagggccaggggccttgggggccccgacctccacagctgcctttctctgacccccacccacccagttttctcacgttttgttttttgcctcaactggaagaggcaaaaagtggagcatctctgggcacttcgtcccaccactgcaagtcattctgagcaggactcacgcaacccaaggtctggccaagaggaagcgaacattgagaagaggggaaaggcacctcctgccctctgcagggacgacgccttgccagttcccctgacccatgaggacacagaatcctcacaggtgacagcccagaagagcctttctggcttgcccttgaaagtaggtgtgtttccactcactcagtaggcagaaccagcagataggaaggtgacacagtgcagcggcccctgcccctgccaggtcaagccacatgcaagagcgctgagcaagtgttctagggcgccagggagaagcggggccctaggaaccaaccagccccccaggcaccagccaggcatatgcagtaagtctgctctggaagcgggaagggcactgcaggctctttgtgactcaggaggcccaagatggggtccccaacttttccttgtgctccttccaggtgatgctgagggtgaggatttgggggaacctatgctctgagagagccttcacatggcaaagcatggggccacagaactggctgcagaggctgtggcagaaacagacccacagctcttctccagaaccggaggaaaagtgacaggaggctcttctgaagtttaactccatcacccacagatccttcattctggatgaagccttctggaactttgtcagcaataaaggcaaagtctcccatgcatagacgccacgggcaccggactacaggatgtgtgcccagggcatgctgcctagagagagagtggggagaggcgaggcggagggggaggaagcaggccaggctgcttgtaggagggcgccaggccccacacaccatgagtatggcggcttgctcatgctctggaggaggtgggggagtggggggcagacaaaggaggctaactatggtgccactatggtgggcatgggtctgccctgggccatcacttcatgggaaagcacaaaggcactgctgatggtggaggagacagacgagaacgcggctcccagaggcattgcagctcccccacccccacagcaaaagtgccacaacctcatctgttcctgttgccagggagggggctccggaagctgcacaggaaaggccctggagaggccagacctccaggcctcagtgtccacatatcagggtgcaatgccacctgctcctcatcgggaactagagaactatgcccacttcttattcagcttctgaatgaagggtgggtggtggatttctgcttcccaccatccggtctgtgaaaactcactcaaatgcaggataagaagcagcaggctgagcatggtcagaagcaggaggtgggaagaaaaactatggaaacctaccttggcatgaggggaactgcattttttggtacatctccagagaatagtgttgaagccacatttcgacaaaaacctgcaaaagagcattacgtagtcaaatcattctcgataactgccaagaccattcagtggggaaaggacagtgtctcccataagcagagctgggaacacagaacaccctcatgcagaacagtgaagctgggccctgccctcacaccatcgacaaaaactaactcaaagtgggtaagcggcctgaggataagaactaagaccataaacttacagaagaaaacatgggagaaagcttcataacactggatttggcaatgatttattagatatgatgcccaaatcacaagcaacaagcaaaaaaatacagcatcaaaagatactactgatagagtgaaaagaaccagcgggcatgatggctcaggcctgtcatcccagtgctttgggaggccgaggcaggtggatggcttgaggccgggagttcaagaccagcctgggcaacatagcaaaaagttgtctccacaaaaagcacaaaaatttgctgggtgtggtggggcacagccatagtcccagctactgggagtctgaggtgggaggatcgcctgagcccaggaatttgagctgtagtgagccaagatcatgccactgcactccagcctgggaaacagagcgagaccctgtctcaaaataaataaataaataaataataaaataaaaatagaagcaactccagtgttcactgagagatgaatagataaacacaacatggtacatccgcacaagggaacactatgcagccttaaaaaggaagcaaattctgacacatgctgtaacatggattaatctcgaatccattatgctaagtgaagcatgccagtcacacacaaagaagtactgtgtgctacagaaaaatgctttagatatgagatctaggagtcaaacatatagaaacagaaagcagaatagtggttgctaggggctgcgtggggaattaattgttcagtttctttttttttattaaaagagatggggagccaggcatggtggctcatgcctgtaatcccagcactttgggaggccgaggcgggtgcatcatgaagtcagaaattcaagaccagcctggccaagatggtgaaaccccgtctttactaaaaatataaaaattagctaggcaccgtggcaggtgcctgtaatcccagctactcaagaggctgaggcaggagaatcacttgaacccgggaggcagggattgcagtgagctgagatcgcaccactgcactccagcctaagcgacagagtgagactctgtctcaaaaaaaaaaaaaaaaaaaaaaaaaaaagagagagagagacggggtgtcactatgttggcgaggctggtctcaaactcctggcctcaagcaatctttcccaccttggtctcccaaagtgctaggattacaggagtgagctctcatgcctggtcggttcagtttcagttttgcaagattctggagattggaaaggaagcaaattctgacacatgctgtaacacggattaatcttgaatccattatgctaactgaagcatgccagtcacacacaaagaagtactgtgtgctacagataacaacaacgtgaatgtatttaatactactggctgtacacttggaaatggttaagacagtaaattttatgttatgtatattttacaattacagtttttttcttaattaaaaaaacgaaaagcattaatgctttggtccaggaaacagcagaaccttccagttctgtcctgttgtaagcttgtgtcatggtctcctgccctcttcacagccagcacatcccatggtccacacagccaagagccatctgggtatcatggtcccctctggggaccatgcccctcccagggacaatggtccctatcattctagcacccgaggttgttgtgaaatggtgtggaggcttcaaaaagcacggcaccccacatattaggagttatgtacaaggtcggagacagaatcctatcttatctacttcccaggtgtcaacggcgaggctgtggctaccaagtcagtcctaggatccagtgtcaggagcagcacctgccaaatctctccaagttatgctcagaagacacagccaggacctggtggatagcactcagggagtgagccagtccacaccatcgtgagaggctggagccccccaggacagacaagggactctgtcacctactatttggatcccctgaatcaacagaaggcctgtggaggctgcacaaacccctcaccattccgtgtcacaaaagtgctactggggcaacgcttaatatccacatgatggtaatcataggaagcatctccagcaacacgagagacggacaccaagagaccgcaacaattatatcacaatgggcaaatgaaacgactccgatggacaggggatcctgggatgaaaaacaccatgaatgacaagtaagttaggtgggtgggcagacttatattcatgttttctaaatgtcataccaggaaaatgccaacaatttagaatcagccctgggctaagcggccgcctctgggactctgacccatatagtggaagatggctgaccagtttcttttgaaacagacgttgagaccagctcagctctcacccggagcagagtttctgacctccagatctcctgggaggcggggtctgcattcacagacatctgatgagagaagtgtcgcttcagggggctagtgtgctggaggctacaggaagcaaagggcatggctggtgtcctgagggagacacggaaacaggcccaaggtaggagctcctgctggccaggccaggggcgatctggacatcaaaatcaatgacagcagggacgtattacaacttgttcaattgcacaatgcacaaacctcacccctgccccaaatccacactgatacacctgaataaacaaatagcaaagagaaaagtcttccttcccgcagagcgaccactgacccaatacaggaagaatgaagttagggaaccaccacttggcaactgccctattaatagcttatttggtcaagaatcaagtgaggccaggcatgggacctgcgtgagacgcctgaaatctcagcactttgggaaaccaaggcaggaggatctcttgaggccaggcacttgagaccagcctgggcaacacagtgagaccccgtctctacaaaaacattaaaacatgaaatagctgggcacggtggggtgtgcctgtagtcctaactacttagaaggctgagaagggaaaatggctccctccttgggcctaggagttgaggctgcagtgacctatgatggcaccaactgcactccagcctggggtgacagagcgagactctgtttctaaaaaaaataagatgtccagcttgggcaacatgggcaaaacccatctctattaaaaaaaaaaaaaagcattcagatgtggtgatgcatgcctgtagtcccagatacttgggaggctgaggcaggaggatcacttgagcctaagagattgaggctgccgtgagcctagatcatgccactgtacttcagcctggggtgagagaacaagatcctgtcttaaagtaaaataaaatcaatttgaaaaaaggaaagaatcgacttctctgtgtatggagtagcccttcttctattcctttactttcttaataaacttgctttcacttaaaaaaaaagagaaaagaatcaacagttgatgttaatactagtgataatacatagtctctatacatcttcccggtaaatcatcattaccaatttttcttttttttgagacagggtctcattctgttgcctgggctggagtgcagtgctgtgatcacagctcactgcaacctcaacctcctagacccgggcctcccaagtagctgggaccacagtgcacaccaccatgcctgcatgcctggctaatgtttttctttctttgttttttgtttttgttttttttttgagacagactctcactctgttaccaggctggagtgcagtggctccatctcggcttactgcaatctctgcctcccaagttcaagcgattctcctgcctcagcctcgttagtagctgggactacaggcatgcaccaccacgcctggctaattttttgtatttttagtagagacggggtgtcaccatgtttctcagcctggtcttgaactcctgacctcatgatctgcccgcctctgcctcctaaagtgctgggattacaggcgtgcaccaccacacccagctaatttttgtatttttagtagagatggggtttcaccgtgttgaccaggatggtctcgatctcctgacatcgtgatatgcctgccttggcctcccaaagtgctgggattacaggcatgagccattgtgcctggccaatatttttctttttagtacaaacaaggtcttgctatgttgtccaggcactcattactaatttttttttttttgagatgggctctcactctgtagcccaggctggagtgcaacagcatgatcttggctcaatgcaacctctgcctcctgggcttgagtgatccccccacctcagcctctaagtagctgggattacaggcgcatgccaccacgccaggctaattttaaaatttttggtagagataggattttgctatgttgcccaggctggtctcaaactcctgagctcaggtgatccacccaccttggcctccctaagtgctgggattccaggcgtgaaccactgcactcagcctcattactatttaatctgggcacgaagtacttattttacagtggacaaacctggccgacaccctttccacccagtgataaagctagcatcaccagtgatggggcaaaggggcactgcaggcctcctgatgagacacctggcaaggaccaggtgtccccgctgcagtgctcctgccaacaaagcccaagctatgcctaatcaccagcaaatacaagacagcccaaggggtggccacatgctttggaggggtcaaggtcaggaaagacagacaggctgcagaaccattccggactgaaggggactagaaacatcactgcatgcagtgggtgagcctgtgctgaaacccagccaggtaacgggcatgagtggggtagctggtggtgaaccccgaggtctgatgactaggtgtagcctggtggcaatactaacttcctggtgtggtggcatgtgctggcttgcacatgccagcagatctggggtgggccagcatctgcagaaacgggcctgtatgcagcctcctggggaaggcaatggggcagcaagattaaggagggtcagaggagcacacgcactgtgactatataagataatgcattcacttttaggaaatacactgacatattaagaggccaaggggtgtcctacctgtagtttattcttattggcttaggggagaaaaaacatatcatagaaaggggataaagcagatgcagcaaagtgttaatttggaaatctggatgaagggtctatgaactttttttttttttctgaaacagggtcttcttgtgtcaccccaggctagagtgcagtggcgcaatcatagctaactatagccttgaagagtgcacaagagatcctcccacctcagtctcctgagtagcttggtccacagttgcacgtcaccatactcagctgattttattttttgtagaaatgaggtctccctatgttgcccacactggtctcaaattcctggcctcaagtgatctttctgccttggcctccctaagtgttgggattacaggagtaagccaccatgcccagtctgcaagttctttttattatgcgtggaaacttttctgtaagtctgaagttatttcaaaataaaaagttagctaggtgtggtggcctgcgcctgtaatcccagctacttgggaagctgaggcaggttcaccctcccaatccgtgcagtatggcatcaggctcagcctgtttggtctggcacaacaggctctttggcccagggcctccccctctcaagacctgctcctggggccaataaaggattgtggaagctaggagttcaagacccaccagggcaacacagcaagcctcccctgtcatatctctacaaaaaaaaaatgttttaaaattatctggctgtggtgatgcgtgcctgtagtcactgaggtgagaggatgacttgagcccaggaatttaaggctgcagtgagtgacgactgtgccgctgcactccagcctgtgtgacagagtaagaccctgtctttaaaaagacataatgactgaatgtggtggctcatgcctgcaatccctgcaccttgggaggctgaggcaggaggatcatttgagcccaggagttctagaccagcctgggcaacatagcgagacccatcttacaaaaaatacaagctggatgtggtgttgcacacctgtaatcccagctactcaggagactgagacaggaacatcacttgaacctgggaggtggaggttgcagtgagctgtgatcacaatactgccctccagcctgggcaattgagcaagactctgtttccaatatatatatgtgtgtgtatatatacacatatatatattatacacacacatatatataacataaatgtgtatatatacacacattatatatatataatttctaaaagaaaaaattaaattacaaaaaaactcaaaagctgggcataaaaaccacttggcaactgaattgtacatctgagagggtgtgaatccacctcacctccaagtcctccacagcatcagcaacatttcagggtcactgaccactgccgccacccaggcagcctctcctccttgctgctccctttctcccctccaccctctggggcatctgtccacacatgtgaattgtaggtagaggcctgtcctggcttgcacatgccagcagatctggggtgggccagcatctgcaggaaggggcctgcacgcagcctcccagggaaggcgatggggcagcaagattaaggagggtcagaggagcacaggcagctgctgcctgtgcagagggtctcctgggaggtccccagagggtctcctgggaagtcagccaagaggccctgggttagggcccactgagaccccagcacagctaggcacaagagcccctggttcacacttcccacctgtgcagtcaccaacaggctcagcttgtttggactgacacacaggctctttggcccagggcctccccttcaagacctggtcctggggcccagagagatttccatttttttttcccccatagaacaagccttctgccatgctcaccacctcagacactgcatgtggggagggctgcttcatgcagaacacagcccattcccatgcaggccgtggaggcctccagagacctgatagcttcagtgatggccacagacatcgaaaactaaaggacagatcaccctcctcacccccaccctccagtctgtgctaagaaagctggaggtggggaatgaggcataagacaaatttgggaaccctggacaaagggtggcaccattgtcctggtgggtgattcaactgaccaggccactcccttatggaagggccaggtcttcacaatcagggtagccttacctgggagcaggtgagggactggcccatcctgggctggaggacagtgagggtggtggcaggctgcctttggtgggcaggaaccatgacaggtacctgtccaccaggaggaaataggtacagtctgaaatatggacatggagagacacagggagtggctggaaaaccaagctagttcttagcatggggtctgggcactgcctggccccagagcactggcaagtgcagggaagccccgggccatgcccccacccctcccagcaagaggcatcccttccctacctttagtgtgttgaggctcaaggcaaagaagcatatgtaatactcgaacggatctgatggcagcgtcaagggcaaatacacagggttgctgggaaacccccagtgttgagagctgagccacccacaaccttcctacctcaaggccaccaaaggatactcaaggccaggttcaggccaaggcccttagttgggcggaactggatcttgtgttacagaggactgtcaaggacgcactcctggatggatgccttcacgagaccctgcagagagaggcagcaaggcttgtgggcaggcactggcgtgtagtgcccggtacgcagtgccccacatgcacagcagccctttgggaaagctgctggggaagagacccgcacacagaactcacctgtggggacagtgccctgctcctgagcagtgcctcaacaagagtctttgctcagaacttccaccatctcataaaaagctgcagacaggccaggtatggtggctcacgcctgtaatcccagcactttgggaggccgaggtgggcagatcacaaggtcaggagttccagaccaacttggccaatatagtgaaaccccatctctactaaaaaaaaaatacaaaaattagccgggcatggtggcatgcatctgtagtcccagttacttgggaggctgaggctgaagaattgcttgaacccaggaggcggaggttgtggtgagccgagatcgtgccactgcactccagcctggcaacagagtgagactttgcctaaaaaaaaaaaaaagctgcagatggcaagggtagcagccatgcaatacccatctcctttgcctctcatacccccggagcaaatcactccttaatttgccctcagaggaccggaggagactgcccgtcaccactgggctgtgcaaggtccactgcccgagcaccactctcaccactgtggtttacttatgggcaggtaggagatgggaaagtcaaacttaagtcttcagcttgaagcttataaaccaacttcatcattgggccgctgaacatgaaattgaacaaacaaaaacagggtatatgaactgcaaattatcttgctttgattgtatcttaaccttaagaaattgagagtgacttaaaagtggaatcaccatgaggaagcaccctgcctctctcgggtgtcaaacctaccttcccagggtcgagaaattccatcaccatgctgtacttcacaggattcacgcgcctctgtaagcagcgcaggttccagcccacaaggacaccatccaggctgccgaaaatgctaccagccatggggagatggcgtgcagctcctgaaacagtgtgcggtgaggctgcaggcaggaccagcacccactcctgccccagctccaggcctgcaccacctgctgcccagctccctctgaggaggccactccctggctgagacccatgggatcagccctgcgctcaaaggaaccctggtgcggtgatgccaatgagaagagcagctttgggttctttcactggggtacgtggcttaccaagcagtgctgctttagacgtgggccagttaagtaagtcagcctctgatcaaaatacattttttgtgtgtgataaaagcctaaattaagggaaaaaaaaaacaaaaaaatgaaaaaatgaaaaataaaataaaataaacaaaatacctattcttttgagacagggtctcattctgttgccctgtctggagtacactggcgcaatgcacagctcactgcagccttggcctcctggcctcaagcaatcctcctgccttagcctcctgagtagctgggactgtgggcacacaccaccacgctcagctaatttttagatttcttgtagagatagggtcccagtatgttgcccagactggtctcaaactcctggccttaagtgatcctcccacctcagcctcccaaagtgttgagattacaggcatgagccaccacaccaaaagattttttttttaatgtcagaaacttctgatggatgcgaaggatgctctattagaaaggaaagcaacacccttcccagagtgaagcccttaaaatctaactgacctgttgtcatttggtattaactccttgtctaggccagcttcctgggcttgacaattccaggtgtgatttaaatacatatttttagcatttacatcagggttcctcaacgttgatgctattgacattttgggctggattcttctttgttgcagggagctgtcctgtgctttgcaggatgtttccagcatccctggcccctacttactagatgccagtagcacacactccccatcacccccagttgtgataatcaaaaatgtctctgatattgccaagtgtcccctgagggacagagcacctgtggttaagaactcctgatctgcaagttcacatatttaaatgtgtccataaacatgacggtcatgataatgggccaggactctgtgccaggcagtgcttggagtgggggtggtggggggaattaggaattataataaagtttttaaaggaatgtgtaagacatgctccaaagagagatgtcagcagagctatacctctgctggaaaatcctcaatgactttaaccaagtcttggcatcactgtgcaaagggcttatttacagagtcagctttcagggtagcctagaaggtagaacaaagtgaaaaaatcatgaggacattcactgcagcttttagtgatactctggcttgagtcaaacagaaatccaagtgataggttatgagtcagacacataaccactggcgtgattccccagcccctcatgtgtgtcagtggcccaaaggatgctactaggagaggctgtggttctatgcactctggaccaggaactctcaggcttgcttcccagtaccaactcagcgtgctgctcatcatcagaacaggactgacttccaccaatccataagtaggggttggccccagggtcagccccagagccagaagaggatctcgattgtgtaagggcacctctcacagaccacagagtactactgagttcgtacgcatcaaatggaaatttcccacctgatggaccatcatgattacacagttgtgatcatcagtaagaatgcccaacaaaatcagggctacagcatcctctcttaactgagctgtcttttattcagcagacagtgaacctactaaaccaatgaccttaaaacacagggcagggccgggcgtggtggctcacgcctgtaatcccagcactttgggaggccaaagtgggcaaatcacaaggtcaggagttcaagactagcctggccaaaatggtgaaaccttgtctctattaaaaaaacacaaaaaaattagccgggcttggtggtgcatgcctgtaattccagctactctggaggctgaggcaggagaatcgcttgaacctgagaggcagaggttgcagtgaactgagatcgcaccactgcactccagcctgggcgacagagagaaactccgtctcaaaaaaaaaaaaaataaaacaaagcaaaacaacaacaacaaaacacacacacacacacacaaggcaggtaaaaattatagatggcttgcaccaagtaaacactaaacataaaggcaatggagaggccagaaaagactcaggacaaggactaataaaatctacccacagtcgtgggatatacggaaagcatcctgactacaaggataaaaatagcgtctgtgcaaatggactcacatcaggagaaactgctagaatctgtctacctccaaatgccttgtctacctccaaatgagggtggatttcacaggatttgagacaagagatggagacctgagttgtctggccatgtggcagacctggtggctctagtggggtgccctggggaggaacgtccttccacatacatatttacaaaaatacctcctaagaactaaaattaggaactttcatcaccaatacttgctcatacctaacttctcgcttctcagtatcattttttcttttttttttttttgagtcttactgtgttgctcaggctggtcttaaaactcctgggctcaagtaatcctccttcctcggtgtccttagtagttagaactacagatacggaccattacacccagttctcagcaccatgtttaatagttaaagtgctaacctagcaccccctcagaacataagagtgtctccatttttcactaatgacaattatgattatcagaatgtttcatgtctgtttaagaacttacagatcatgaacactctgatgtacatcattctcatttgctcctccccctcctcctcctcatacccccttgggaagtagagaaaatagaacttgaatgaatttgtcttgtatgggaaaacccagagcccagagcccagcggttgagtaaccccaaggccctgtagtaataagggggcacagtcaagcttaaggagtctggcattgcttccatcacacgctcctaaaagacaaccactagagaattcttcaagtcaatgggaagaacattcaagtcccacagctacagagctgtggccacactgacactcatccagacagctgatatttaccagtagaaagctgggccgctgcaggtgagggaacgccataaaagcctccagtggagagttgaaaatggccttcttagcaaaccactgtggaaaaacagagacaaaatctcaacatctgcagcacagcagaatctttttatttttctagagacagggtctcattctgttgcccaggagagaatgcaatagcacgatcatagctcactgcaacctcaaactcctgggttcaagcaatccttccccctgagcctcctgagtagctggaactacaggcacacaccaccatgcctggctaattttcttcttattttcttttttgtagagacagggtctcgctatgttgcccaggctagtttcaaattcctggcctccactggccctcctgccttggcctcttaagtgctgggattacaggtgtaaaccactgcacctggccctaacaaaatattacatagtttcacaatgcccaggagaacatttgtgtaactcaacatgcattacattatcgattctcatgtcttctttatttatttgtagagacagggtcttgctttcccactcaggctggagtgcagtggtatgatcatagctcactgcaacctcagactcctaagctcaagcgatcctcctgcttcagcctcccaaatagctgggactacaggcacacaccaccaggccctgctaatttttatatttgttgtagagatgtggttacatcatgttgcccaggctggtcttcagctccagggctcaagtgatctacttgcctcagcctcccaaagtactgggattacaggcgtgagccaccacgcccggccagcaattcccacattttacagaaacaccattcgcatgcagcccacagtggccagcttcagagccaagtctgtggtactgaatccttggtaatgcttgtacagcacttgctgtatgccaggacttgctctatacaccacacacactgtcagtccccaggaggggaatgtggtatgtgatgcttcataaacacattgaactctttctgccaaggaacagccattaacaccttggggttacttgcaactcacctgtggactgttggtctgagctattgtccatcacttgcaactcagtgtacacaggttcatcagagctggtcccaaaagcaagtccaagcgctggagagcatgagtgggaaatctcacttccacctcggatggagaaaaacttcagcaagattgtcattttatctttccgacccagatggactccatcttgactcaaagacaaccagaacatcaccaagcatctcctacagggcaggcttggtactaggtggttttatttagattatttcatggaatgttcaggagaattgctccctcttcactcctgaattcttgatgcagttcttccactttcgccctttcttctcgtctctgtctcattcagctccctcattacaaaccttccaactggctggatggcgcagttgctcaaccagcagagagcactggggtagccccaaataaatgttcatgtcatctccaaattaccagcactattcccaggtcccaattcaagacaaaaccttatcagcctcatcagtgagagcacgttttcaccgagctgagtaaaaacttaggtacaagaccattcagtggggaaaacactcatttctttgaagaatggtgctgggagaactggatatccacatgcaaaaggatgaagctggacccctacatcacaccatatacaaaaattaagtcacaataggtcaaagccctaagtataaacactaaaactgttaaactctaaacaaaaaacatggaattacattttcaagatcttggatttggcaatggattcattcttatttggtttttaacttcattgtgagccaatttagcatccaaaattccagtaggtttggtaaaaattgacaagctgattctaaaattatagcaaaaatgtaaagggcaggccgggtgcagtggctcacacctgtaatcccagcactttgggaggctgaagcaggtggatcacttgaggtcagtagtttgagaccagcctggctaacatggtgaaaccccatctctgctaaaaaaaaaaagaaaacaccaaaaattatccgggcatggtggagtgtgctgtacctgtaatctcaactacttgggagactcaggcaggagaatcacttgaagccgggaggcggaagttgcagtgggccaagatcatgatactgcactccagcctgggtgatagagtgactctgtcgaaagaaagaaagaaggaaagaaaaaaaagaaaaagaagaaagagagagagagagagagacagacagacagacagaaagaaagaaagaaagaaagaaagaaaagaaagaaagagaaagagaaagagagaaagaaagagagagggagggagggaggaaggaaggagaaaaaaatgtaaaggacaaagaaaatctagactcttcttaaaggacaactcacctcatcctggtcatcttggcgtcttcatgattatgagcatgaggacttctagaattctctctctctgtcccctgtcctctctaggattccacagtcttcccaggtgaccaatacttgggatccacctttcaggcaaggtcctcttcttacccatggggcttacatatctaatccagtggttcttacccagagctgtgcactggcaccaggacaccccaggcacacttggggcagcccctagagattcggttggtctagtttggagtcttcttccacaaacgcgactgtgattgatttacatctgtgactgaatccctagtgaagatgcctaattgcagcacagtgacctcagtgacgctagccctaagcatagccacccagaagaacagggcatttggccaagcgagagtggtgttctgaggagggtcctggtcacacacctccatctgtctccacacctgtctggccatctgggcccagctaatcggagtccagtacctcttttcttggtctcaggcccacacagcttcactcttcgcatgtaagccatgcccctctgaatttctgatgccactatcttatctccagtgctggagttactacttctttcagggaacatcacaattctttccgcatttgaaacttcccactttcaaaagttttgtctttctcagtgtcacctcctctgtctaagggtagggcccaggtgtgagaagcagggaactaagagaaccatcctgactctcggggagctgttctgccttggcccgttgctgtgaggacacacgtccatggtactgagacagccaacagccctgggaaccagaaacctcaccctcctatgagcaggtcatggcaggtagacacaagccttgttctgggggccaggctaagaatgtcccatggattgaacagtagagacattgaccctgtttgaggtgtgaattctagatttgagctccagcagtgcagttagaagcagccgacctgcctctagttcctaagccctcgtacccatcacactgttctacagaagtggccacttgatcccctaaagctgtgccctcaatggacactttgttcacatttaagtgaatatgatccttttaaaaattaaaaatacatattttaaagatagtcttaccctgtcacccaagacggagtgaagtgggatgaacacaggtcactgcagcctcaattcctgaagttgaggagtcaactgcctctgtctccaaagtagctgagactacaggcgtacaccacacctggtttcattcaggtgaatataatctttgctgccagcatctcaccctttgatagtaatcacatcctcttaagagggctttggaaacaattggccttggctagccaatcccaggttttcgcttccatgagggtctccagcttcacacaatattgtgcccatatctgtagcggccttggtttttaattgcaaacaacagcatccacccacatcagtgttggtaaaaaataaattgcttttttttttttttttgagacagactctcgctgtcgcccaggctggagtgcagtggtgtgatctcggctcactgcaagctctgcctcccaggttcacgacattctcctgcctcagcctcccaagtagctgggactacaggtgcccaccaccatgcccggctaattttttgtatttttagtagagacggggcttcaccgtgttagccaggatggtctcgatctcctgaccttgtgatccacccgcctcagcctcccaaagtgctgggattacaggtgtgagccaccacgcccggccaaggtattgcttctttaagaatggagctgttaatactgctggtaccagaaacattaaaaaagaaaaatcctgcatgagggccagaggaggagtacaggagagtgagatggagtggaatcctccagtgggtgatagatggatggacagacagatgaatagacagacgaacagatgaacagacggacagacatgaataaacaggtggacagacagatgaatagatgaacagacagatggacaactggatagatggacagatgaaactaataatctgagaaatcagaaaagcttcatgaaaaaagtgggactgagctgtgtctccacggatagatataaaagcagaggactctccacttgagtcgagaatgacccagtgtcctgatccagagaggaagccagcctggcttgactgggaaatttgtgggaggactcagaggcccttaaaatgaggccaggtgaggttgggctgatccgagccagctcaggactcctctgccacacagcacagctgccttaggggacacattactcagggagttgctgggacctactgggcccagcattgccaccagcaccaacagcttcagagaggggggacacacacttggggtgactccaagactgtgggtggcacctgcctcaaacaggggacaggcacagggacacctctcggggtctggcacccccacgcactgtgcctaggtcccaacaacgcccactgcagccctgtgcccatcatgcccagaaggtttccgcttcagcctggcccctgtactggccccaggaatttggacccaagcctcagtcactgggtaaacagcagtgggaaccagctcattactctaggtaagtggctcttacaaccttccccagccagttccaccctctgttgtctctggaaaatatgttttctctccctggggtggcttctcctctgccctcccagccttaatcactgacccctacctttctctatgggtcctgggggaggtgggttagtcttgaggtaaccagcagaagggccccaggttccaacagccagacgcagcctggtcccggggcctgggctgggtttaggcaaggtcagagttccttcacctctttcagggcaggcacccgaggtgcggggcaaaggccagttctgactggcacactgcagtagcatcagagacaccccccggaccccagggtctaggctgatggctggatgcccatccagcctgggaaggccacacgggggcctggggacaaaggggtcaccatgaggtgacatcaatgcaggtgcagagagggctctgggtctaggctgcagctctctggcctctgctgggtcatgaggacacagggacaaaaaaagaagatgggtcagatggggcaagatggccagagcccagccctcccagaatagtcatcagagaggagcagatcccttagggcagagacatatttgtccctggagccccttcacccctggggcctggcgtctcactgtccatgggtcagtctcccaccttcctcaaagggcacgttagactcaggaggtgacaagaggggagcgaatggggggtgcagaggactctacggcagccagctgaagtctagagttgtcagagtccgtggaggcaggcatggggggctgctgtgtcccgtggtccaggggagcagccccaacaccacagtggaggtgaagggtcctatggttggggtggtggggacaagggaggtgaagagcggtggaggagccccggggcttgtctgggtgcagcccacccttcatcaggaaagctgaatgggatgggctggggcaaagcctggtgccccaggggacaggaagctccaggccccaccaggcttgggcctttccacactctgccaggatagtcctgtgggctgggcggggacgtgcaaattccaaactcagactccagagaccagagaggagggagcacagcctgccctgggtacacacagggaaacagaggctgcagaggagggctgggccagggctcctagaaaaggtgacttgggaagagctcctaggaaggtgcgggctggctgctctgcagaggtcttgagtgaaaaggaggggaatgaggagggaagaggcagccccgggtggactggacagccatgccgtgaacctcacagagactttagacagagagggggctctacaacaccccagtactccctctgcctctcttgccccctcctctgtccacacaggtctgcccaaggccgcccctttggacactctgaggaactccaagccaacaagatgcctctcattagtgacttctaccctgatgccgtgatggtggcctggaaggcagagggcaccaccatcaccctgggcatgaagactgccacaccctccaaacagagaaacacaagtacacggttagcagctacctgaacctgacgtctgaccagtggaggtcccccagcagctatgttcttaggcccctcaccccacccacagcagccaggagctgcaggatcccagggcaggggtctcccctcccaccccaaggcatccagcccttctccttgcacccaataaaccctcagtaaatatcctcattgttaatcagaaattctgctccctgtcttcatttcttacctttcatataatttgacacttcccccaggttctcagtgggggatgggggaatcctgacactcagtgggaaaatagcttgtgggagaggctcccaggctcccaggggcatctgctggagaaacaggccaggcaaggagcaatctgatcactgaagaccagtccctctgccctctccctcctccaattccccgctgcagcactccctcccccaaccccccgccactccctgcctcctttctggatggagctgtccctggctgggccttcagatatgccctctgtccttgccctagtaaagacactcttcccacctacgacctctttttcctcagcctggaagtaacactctgggcctggagttcctctgcccgtggccctggcccctggaatcccctcctccctctctgcccaactccccacccctgagagctggactgtccagaatactccagcaccttcaaattcatgagctgttaaatttggggcccacctcgattcttcacctgccagcaggttcacaggtgtaagaaaaatcggaggaaggcaagaaggaaacacacacaaaaggcttgcaggaggctcaggacacttgccaaagataggctctaagctccccaggaaccagagcaagaagggtaacaggagctccatcatttctatgagatttaacaaagcctttgcttgagggaagttggtgttttcaatgctgaggccaggcatctcctcagaactaacagtggggatgtgttttttgtctgtttgttttgtttcgttttgttttgagacggagtctcactctgtcgcccaggctggagtgcactggtgcaatctcggctcactgcaagctccgcctcccaggttcacgccattctcctgcctcagcctcccgagtagctgggaccacaggcgcccaccaccatgtccggctaattttttgtatttttttttagtagaggtggggtttcaccgtgttagccaggatggtcttgatctcttgacctcgtgatctgcccaccttggcctcccaaagtgctgggattacaggtgtgaaccaccactccaggcagtggggatgtgttttacccaatcccttagtattgattggatttgggctccgacacctgcacaggtgactgcctggcagccccagaacacggagatgttctcaagtgtgtggcacagaaagtcactggctgcctttggggggcattctttttgggaaacacctctccattggatcctgggcctcaggtggaaaaccaggtcctgcctcgggactttctctgtgaggctccctgggtctggggctccagccattctccgagaggaaggtgccaggagagagagcaaggcccagccccacctagtctttcctgcatggtccctgctctggtagagacagggtttggcctggctgggttccacacctgctgaaggatgcacagatggtagatgcccagtctgaccctgggtctacccagggctaacccccttccctgaggccagactgaggaggctgagcctgcccaggtcctgcaggtgttcagggcagcacagacagtgggtgcccaggcccctgacccaaggtcacccttccctcttgaggctgtgctaggcagggccaggagacagtactgaacacaccaatccccttgtggctctgtggggttggggacctacactcctcagtctacatcgagccggtgtaggagacaggcagaagcaggagggtcctcggagtccacaaagcagagcaggggcaggtgctcgtgtgcccatttcaccgaagagagaactgaggctccacgggaagggaagtgacctgcccgggtcaacatggtgagctgctgcctgacccacccccagcctctttccacagctcctcagtccttcattcattcactcacacactcattcagcaaaccctcagtgagcacagctgtgggccaggtgctggtgcaagaccaggaccacctgccctggagaagctcatgagctggaggacaacagggagacaccactgcacccccctgtcctcaagtccccaaggttggagcttggcccagggagcgcctggggcagcaggggcatctccccctacttagcagaagatttaactgaaagaaccatctgacggagccccagctgtcatccctgggccacagtgggaacatcacagtccctcatcaaccctcacagtgaccctgaggcccagggcagccatggtccacctcacatagggcaggccgaccatgaggaatgcaccacggttgcctcatagcgaccctgagctctagagctgccattgcccaccttatagaggggatgctgaccaggagggaggcaccaaccagggccacccaggctccggccagcctgagagtggcccagctggccctgtgcctgcactgccctgcacctgctgccctgcccagctcagaccctggtcatatcctcaggagtgatggccccacagcaccagggcagggtaggtccacactgggagagcccctaaaggtacagagaagagcactggagtccagggaggagggattgtcccggccctggtcctgcctcgctgtgaccagggctgaggcatttgctctaaatcagatgggggaggggcatctgtggcttcctctacagccaaaaccagagccccaaatagccccggtgggtatggaggggccttgggggaggggaggaaatgggaggggaggtggctgcttggggctctgggtgagggctaggagctcctactgagctaagcggatgactctcctatctgacctggccccccatggggcctgcaaaagcaccaagagagcatccccagccaggcctgtggaggggcccttgacccctcatactcactgagcccagtggtgggaagagggggctggtccccggccagtattctcctgaggacaccgacactcactggtaacaagcaaaccagacccagatgctccaaaaagaggccactggatcccagcaagcacccactccccccaacacgaaggtccaaaaccaagcttcagccaactagaatgtgggaacttcccgggaggtagaggaaacaagtcactgtccacttgcaatgcccaccggttagtgacgcagcacaatgacagtcacacctctcagagggggctctccctcgactctccttcctgacacatcaacaaggacagccttaccaagggccacacctgggcagtcaccatggggttcgtggtctcacgtgggccctgcttaaagcccctggggataagctcactccagctcatgagaggccgggggtgaccctgaccccattttccgatcagcgatagcacagcacatgtggggaccaatgagaaatgagtctggggagaccacgggcttcagggagaatgtttcgatgaggcaagtacaagagccagtgagggactgggtgacttctgtggcctgtgtcacagagctggggccatcagatgccccatgtccactctgaggacagagtagcccatggttaggatgacccaccagccaggcctggccagggcacccacaggagacaggaaggctgtgagggcccgggggcacggagcagctctgaaaggaaggggtgctgggtcccggggctcctgggcagagtggttgaagaaggtgagaccccagaccagccagatgggcccacttctcaggggaccctggtcagacaagggagcacctcctgctcatggaacacagcaaggggcaaggtaggcacagccaggctcggagaactcgtatttgggggagatgtaaatcaacccaatagacaagggagcgatgtggtgtaggagatggggtttgtgctggggagaaataaggcagagagtggggagtagagagcacctgtctggggtctcaggaggagcgatgtcccaagactggaggcggccaggggctgaggagccctgactgggccaggcctgtggctggagctggaggctcgggttcagcctcagtttcccctctgtgaagctaggttcataataatggaaattgactttctgggtggctggagagacattcagatggaaaatggatattctattttgtctctgtccttggttgttgtcatctcaggctgttccagccccagttagcctcgggtcagccccctgcccatgttggtctccccatgagctcaggcacctcatccccagcacagctggcctggagaaaccaagattccctgaggcttaaaatagctggaaagccagcccagctgcaggtgcctccctgtaggataaaatgtaggagaagatcttcaagagctaggactaggcaaaattttcttagacttgacaccaaaaacatagtctacaaaaggaaaaattgctaagctaagtttcatcaaaatttaaaaatttgttctgcaaaacaccttgttaaaaagatgacaagttacagactaggagaaaatattttcaaacaacatatatgaacaaagcactgttatcttgagtatataaggaacttgcaaactccacacaaaaaatcaaacaatccaattagaagatgggcaaaagacacgagcagacatttcaccagagatgatacacaatggacaaataagcccatgaaaagatcttcaacttcactagccatttgggaaatgcaaattaaaaccacaatgaaatataatttacacacatcagagtggctaaaataaaaaatagtgacaagacaaaactctgctgaagatataagtgtgaatcactcatatattgctggtgggcatataaaataccacagccactgcaaaagtgtggcagtctcttttttctctttagagacagggtctccctatattgcccaggctggactcaaattcctgggctaaagtgatcctctcgcctcagcctccagagtagctgggactaaaggcacatgctactgttgatgtttggcagtttcttatacgactgaacatggaactaccgtatgacctagcaattacattctgactcatctatcccagagaaatgacaacctgtgctcatacaaacaaccgtacgtgaatgttcattacagctttaatagcaatagccaaaaatctagaaataactcagccatccatcagcaggtgaacagttaaactgtgctacatccatcttatggaatagcactcagccatccaaaggaatcaactcttgatacactcaaccagctcaaccctccccagaacgcacctgggtgggaaggtgcacagcagattgggccactagatttacccagtgtggaggaaacaggtacctcctcctagattttgttcttggcagagataaaccagtgcttctcagtcatttttgctttttactagccatgggaggtattttccagtaaaggcttctatgaccaaatgcatttgaaggaatgttccatatgctctcccacacgccttcaatttcctgagagtgacaagaataccagaatagccaaggttctaagatatccttcaggatacctgtttaacttaaacttccccaaactatttgattatgagactcttttcaagcataaacattttccttccaggaacatttgtattcttataagaaaatattagaaagcattccaggtgacttacctaatgggagaacctcaggcgccaagccagatgagataaaagtttcaaatagtgctgataaggttttcttggttcagctgcctccctccaactcagctgctgtcacacttctaggcagttttgactggactgtaaattccttctggctggggccatgtctcagcaccttgtgcaggagtgatacaaactaatgcttcataataaatacttactcactgactttctctttattcatcccaggtgagcatgttttccatccccttcaatctccacactcacgggcaaaagtgagttgtgggtcttggaactctcaagaagaggaggagatcttcaatttgcatatgcagaatccaaacaagtcatcttgagtccccacaagtaggtgggcttatttctcacataacaaaatcgcccctcctttgcagcctctacaccactgcagatcaagcccagctaaaccttgctgtgctatcctgaaggtattgctcccagatcccggctgtcagctcctgtccagcatcacagggcaagtccagagacatgatcatgtaattgaccagggatgacaagtgggtcctctcagtggacaggtgtctgcagtaggtaagccctgtcaggagaggaaagaaaagcatcatcatctaccacctgataccctttgccctgtcttatggagtccccaaagtgctgtcccacactcccatctttatttttttatttttctgagacggtctcgctgtcacccaggctggagtgcagtggcgtgatcatggctcacttcagcctaagcctcccgtgctcgagcaatcctcccatctcagcctcctgagtagctgggactacaggcatgtgccatcatgctcagctactttttaacccctccttttcttcacaaggaaggcaaggcttgatgtcacttgctggctgaatggcttaatagctctacaaccctagggaagtcttatcaccttgctcagccacagtcagggtgatgccatcctcctctgctggaagccaaaacatttaattgataggctggaggcagagaagggacaggaaagaaggtggccaatgactctgtggccttgctgtgcctttgtctgcctccaatccatacacagagaaagacactgtgagatgtggacaactttctttcaaatatcagctgaatacaggtattcatccaaaagaaaggaaatcagtacatcaaacagttatctgcatgcccatgtttactgcagcaccattaacgatagtacaaaatcaacctatgtgtggaggaatagtacagaatcaacctaagtgtccatcaatgaattgacagttaaaggaaatgtggtatatgtatgcaatggaatattactcagccatgaaaaaggatgaaatcctgtcacgtgcagtaacatgaatggaactgaaaatcattatgttaagtaaaaaaagtgaggcacagaaagacaaatatcacatgttctcagtcatacatggaagctaaaaaagtatttctcatgaatgcggagagtagactggtggttaccagtggctgggaagggaagagtaggaggggaatgaagagaagttggttaatggtacaaaaatccagttagatggaattaagttcttgtatattatagtaggaaaaatataattaacagtaatttattgtatatctcaaaatagctagaagaactgtaaagttcccaacatgaagaaaacataaatgtttgaggtgatggatgttccaatcacctcaaacgtgatagatcaatacgcagtggatctatcaaaatactacatgcacccccaaaatatgtacaactacagtatatctattacaaatttttttaaaaagagggccggccgggcacagtggctcacgcctgtaatcccagtgctttaagaggctgaggtgggtggattgcttgaacccaggagttctggactagcctgggcaacacagtgaaacccagactctacaaaaaataagcaaacttagctgggtgtggtggcgtgtgcctgcagtctcagctacttgggaggctaaggtgggaggattgcttaagcctaggaggtcaaggctgcagtgagccaagatcttgtctctaaaaaataaaatcggctgggcgtggtggctcacgcctgtaatcccagcactttgggaggccgaggccggtggattgcctgaggtcagccatcctggccaacatggtgaaaccccgtctctaccaaaaacacaaaaattagccgggcatggtggcacacccctgtaatcccagctacttgggaggctgaggcaggagaattgcttgagcctgggaggcagaggttgcagtgagccgagatcgcgccactgcactccagcctgattgacagaatgaaactctgtctcaaaataaataaataaataaataaaacaaaatcagataaaaataaaacaaaattgcagctggattaaaaaggccccagtaagtcaggaaccagggagagagatactgagggggcagcttgctttcaatgatggtcctgcctcaaaagcacacctaccaatgtgccaccccttatctgtcacaccctgtcacctggagggtgttaggcaaagtgcctcagcaaacgccagcccgtgctgtttgctctggctgtgccctttccttctggcgttccccagccatttcatcctcaattcccagtgagaaccctggacattttgcagcctggggactaaattctaacaggagggtcaatcatagcaatgatgatgatgatgatgaccacgatgatctaatagctaatacttacacagtacacactatgtgccagggagctgttagcagagtttgcataactcagtctcgccacaacccaagaaagcaggcgctactgttatttccatcttatggatggggtaagttgaggcccagactggttatgtcacttgcacaagttacataactggaatctgaaaccagatcacctggctccaaaacctgggctctcaaccaccatcagccatgagccacatcatctgatgacattattccagacccgtatcaacccccaacccttcctgcaggaagatatttcatttgggtccaaaaatacttgcccaatgcctgctccacgccagcccctgcattaggcaaaaacgtggattgtaacggaacaggcaaaacctttgtcctagtagagtcacgctctccccgcctctgcagcactcaggtgagctgcactgtggtttcacaggcccatgcaggtgtgtgtatagctgcaggttttatttccctagcctcacagcctcaagaggagagataaaatgtgtatattcagggatggaaaacacacacacattttctctctcccatcaaggctgtgaggctacggaaataaaacctgctaagaataaatatacggagaagaaaaaacaaagccttggagtcaggccagagtctgagtcccagctctgctgcttggtagctgtgtgaccttgggcaagtcactttgtctctctgtgccttagtttcctcatctgttaagtgggaacaatcagaatacagatactaggaatttaatttttaagttttgggggaggcataacgtcactttactcttctgcttctgcccatgacagaaggaaactgacatttactgagcacctacagtatgcaagactagctgccaggggctttctacatgctcctcacttaatcctgaaaacaaaccctccactgtggcacctgggggtacaatggtgatttaatgaaacctctgtccccaggggtccccattgttcactgccctctcttaggactcaggcataaaatttatccccaatctgtagatgatgaaactgaggctcagaacggttcatgtaaattcactgaaaccaggcattcaggtaatagaggaggagaggttcaagctccaaagccagtatctcctggtatcgctgacatagagtaggcactgataactgcccctcggagactacacggcaacaaagacctatgtacatccatagaaggctctgcagaggatctggtacttcatattgtcacaagagaagtttctggggagccctgcaggcagagaaggagggagatgcttagaatagattcaaacacagcccaggttttttggagaggagcacaacttgttatctctagagggtaactgaaatcagccagtcatgaggagtgcagggagggtgctattacctccacctttacaacatcacctcttccactaccagtgacccagtttgcccttgagaaatcactccgtccacaactttctgtctccggtttctaaagggatgactctacccatttataggaccaaagctggagtcatagtaatggaagcggagattgtcatatgacccaacctgagccaatgagaattaggcttgggactttcattgtaactaccaggaaaaagtctttttctgcttcagtttctaaaccagtgggatacaggacagtagctcctaggagctatctttgccacaacataaaaagggcctgcctgtggatggaaccatcacagagggaagcagagccaagagctgaagaaacagagattcccgtctcgagcatctgagcctgaagccactatgactctaagcttctgttatgccaacaattttttttacctgaaccagtctgaagtgggtttctatcacttgcagaaagagttctgatttctttttttttttttttttacacagagcctcgctctgtcgcccaggctgaagggcagtggcgcgatctcggctcactgcaagctccacctcccaggttcacgccattctcctgcctcagcctcccgagtagctgggactacaggtgcccgccaccacgcctggctaatgttttgtatttttagtagagacggggtttcaccgtgttagccaggatggtctcgatctctgaccttatgatctgcctgcctcggcctcccaaagtgctgggattacaggcatgagccactgcacccggccgaaagagttctgatttctaaagtgacccagctgaaccaagagccaaactgggattcagtatctggctgtttgctaagtaggtgatgcctcaaggattctccctgcatgggaatttgtggcaacttttttggctgaaagaggcaagaggagtaaggtaccagcattgctggataaatccaggactgctgaagggagtgttgtacgctcttgcaatgaacagaatggaagaatatcggcatatttattctcagcacatcccaaaggacatccagaaaaatccagggagactggggtgggggaaacatagccgaagtcctctagttagacatgtgaactccaaatatgagagacaggtctcagttaatttagaaagtttattttgccaaggttgaggatgtgcgcccacggtaccgcctcaggaggctctgacgacatgtgcccacggtggtcagagcagtttggttttatacattttagggagatatgagacaccaatcaccgatcaatgtatgtaagatgagcattggtactgttcagaaaggcaagacaacttgaagtggggaggaggcttccaggtcataggtagataagagacaaacagttgcattcttttgagtttctgatgagcgtctccaaagggggcaatcagatatgcatttatctcagtgagcagaggggagactttcaatagaatgggaggcaggtttgccttaagctgttcccagcttgacttttccctttagcttagtggtttggggccctgagatttactttccttttacaggcacatggaggcattgaatactgaagtgtcccactttgtgccctcaggttggtgaggcttacagttgctcaggttacatgagaatagggtcacataaacagctgtcccactgtgggcttggttttctgcaaggtactgagttccccattatgccaggtgtgtaagcagacgctgtaacaggagagagggcagtaagttatggcagcattttttttcttttttcttttctttcttttttttctttttgagatggagttttgctgttgttgcccaggctgaagtgcaatggcgtgaccttggctcaccacaacctccgcctcccaggttcaagcgattctcctgcctcagcctcccgagtagctggtattacaggcatgcgccaccacacccagctaattttgtaggttacagcagcatttctcactggtccatggaccatcagcctaacagttacttgcagttgctccaacatgtgtattcctgggccctgcacagacttaatcagaacttctatgaagtagtctaggagctggcatgttttgctacctagcccaggggattctgatgcacaataagagaatatccggtaacattagcacttctcaatcttaaaagtacacacatggtcttgggactacgttaaacacaaattctgattcagaaggtttggtataagagactgaccatctgcccggtgctgatgctggttcacaggccacagtctgaggagccaggagcttagatgatgacttcaacaatgtaatgccagccctcacaccgtacactcctatggctgaagactggaccacacactggtacagaagaccagcaaggacaatagggttccattctaccaggcaaggccaggaggaaacaaaaccagtctcatgaactggctgaatagttccaaagagacaaaagctctatgggcaaagagagagatgcgcctgagatttaagtttacatgataaaatggtaactgttatttactgaacagtactgtgtgcaggtggcatattctggccactttaaaccattatctgagctggcatttaccatagccatataaagtaagcaccagaatctccactgtgtggaggagcaaactgagatgaatgtggttgacattaaataatatttgagattattctgccttctaggctcatggtagggctgcacttcctggctccttgtggatggggccaatgagctgtgggtgggtatgacatgctaattttgggtggggcccttttattgtgggttcaagcccctccaatgctacctttccctgtcactgtgactggcaacattcaaatgatggctgctccaacagctggaccctttggtgtggaaaaaacagagcctcaccatttgacctatgagagacacacagcatgcatgataaataaaatttgttgtaaaaagctgagttttaggactgtttgttactgcaccatataaccttgtatagcctgactaatacacataagtttcaacagctagaatttcacaaggccaggatttaacctagatctggttgactccatagtctatgttcactcaattcaatgtagggaaagatactggcatccacaaatctcagccgaaccactctgtcaacagaatgagaaggacgatttccaggagctgggctgacataggaatgagaggttactcatggagacatccatcagatcctgggggactgtggtgagtagaacaagagccctggtcaagcctatgtgggtcacagaaacctcatcccagagcaagcagctcatccccaggccagcacagggatagggaaagaccctggaggtgacagcagaaaacagcagccccaattatagtctgacccaggctattgagcccacctgacccaatgaaagccaccaccaaaatctgggggctccaacagataggcagaactgatgacaactgaagagagaggaagagaacagagagagacaacagccaagaaaacaggccctatcccagagcaggccaagcctcaccatgttgtcacttagtcatgctcaaaggatgctacaggaaggaaggggcacctgctgggtgcttctgtagaagaggcaggcctcatggggtacgatgaaagggagcctgactcaacagatgaggcagggcacccatgggcaagagacccagtggagccgctgctaatgaaagaaaagggtacttgcactatccatggttctgaggctaaagctgctccaccaagtgggtctcaaacatattagtgacaatagctgtcgctttgtactgagtgcaggtaccatcattatacccttttccagattaggaagctgagacatggagagtttaaacaacacgcccaaggccacccaactaacaagtggtggagccaagatcccagcccaggggatttgactcttcttctgagactgagtcttgctccgttgtccaggctggaatgcagtggtgcaatcatggctcactgcagccttgacctcccaggatcaagcaatcctccctccccagtctcctgagtagctgggactacaagtgtgcatcaccacacccagctattttttctgtatttttttgtaaagacagggtttcactgtgttgcccaagctggtctcaaactcttgggctgaagtgatcctcctgctttgacctcacaaagcactgggattacagcgtgagccactgagcctggctcagggatgcgactctgatcttactcttcctccctcagctgtgttcccataggctcttgtggctacacaacatctgctctgtcctcaagtggggtgattctgtcgatgtctggagagactttggtttgccatgccttgtggattaactaggtgctactggtgtctagtaggtggaggtcagggaggcttctaaacactctataatacaccagacagccctcaacacaaggaatgatttggcctcaaatgtcaacagtgctgaggctgagaaaaccaatgttagaccagcactatccaacagaaatacaatcaagtggtcaaggcccggtagctcacatctgtaatcccagaactttgggacgccaaggcagggggattgcttgagcccaggagtttgagtttagcctgagtaacacaacaagaccttctacaagaaatcaaaaaattagctgggcatggttacacatgctgtggtcccaagtacccaggatgctgaggtgggaggatcgattgagcccaggaggtcaaggctgcagtgagccatgatctcaccactgcactccagcctgggcaccgaggccacactacccataggctgctcccagccagaagcgagcatgctaggtactagtgccacctgttcctgcaggcaagagagtcctctaatagtcaacagtccaccagagactcccaactgatctggccaaatgttcctagagctgtgtgttgtgtctcagactcctcctgcccaaccttcttccttcaccctctccccttcatcagctggcttactgttcacttcaaggtcaagacattggctgtctgatgcagggacatccctggcacggcctccatggtcatctagcaaggggagggtggagcaaaggcttggtcccatagcatatattcacccatctccttgtccatttgttgtcttccagcagaatgtaagctctgagaaggtaagcagtttcctctcctttcctacaactgctgtcttccttgtatctagcacagtggctggcacaggctaggtgctcagtaaatatctggtgaatgaacccaggtcccctgaattctctgcttcatttcacaaagctgatctgagcacctattaggtctacaagctgtggcaggtattggggataagatctgagcaagacaggacccttgccttcaaggcactgagttctcaaaggcaagatggtagctatacagctaggcacagaattgtgtgactacagactatggccacagagctcctccttgctgacagctggtgggagctggtgttggctttgtttactgagcatccctacaaagggatttggggcttatgtaatctgaactcaaccagaaggtcagagaaggcttcagaccaaagtttaagataaagaggctgaggcaaggctccagtcccagagcatccccaggaggcctaccctgttcttccatgaatgtctcttgattagaaactctagagtctaggaggtcaaggtgggaggaacacttgaagccaggagttcaagaccagcctggacaacaaagcaagacctcatctctataaaaaataaaaattaaaaataactaaaaataaaatgagagacagagagagagagagagagagagagagaggacagaccagcctaggcaacatggtgaaaccctgtctctacaaaacatacaaaaattagctgggtgtggtggtgtgcacctgtggtcccagctactcgggaggctgaggtgggagagtcacttgagcctgtgaggcagaggttgcagtgagcagggatcgtaccactgcactccaagtctaggtgacagagcaagaccctgtctcaaaagagagagagagagattgtgagaaacagcagagtctgactggagctgaattattgagctcagcctgggaccaactgtcccacccactgaccagcactgaggacagagggtaaaccctgcaaaggaacatttttcatcactccaagacctgatgttaaccacactgaggcttcacattacacagaacacaatgacaatgttctggttatgtttcttgaaaagagtttttttttttttagagatacacattaaaatatttacagatgaaatcatataatgtctgcacgttgcttcagaataatattacaggggagaagggataggctgattcaggccattagggcctggtgaaggtacccgagttctgtctatctttaggttaaaactttttcatcataaaaggtttcctgaaaaaagcaagaaaatgtaaaaatatatatatatagattacatgtggacttggagcagccaacaccattgcttcctgtccccaccagcagccaagactcctcaagctgaaatactggggtcggccacacctttgcaccacagcttcctttgttcttcctgaagtctttcctaattgtgctggaatgcaggcattgcagcagggaatcccctgttccaaagcctttgctggatttttttttttttgaggcggagtctcgctttgtcgcccaggctggagtgcagtggcgccatctcggctcactgcgagctccgcctcctgggttctcgccattctcctgcctcagcctcctgagtagctgggactacaggcgcccgccaccacgcccggctaatttttttgtatttttagtagagacggggttttaccgtgttagccaggatggtctcaatctcctgacctcgtgatccgcccaccttggcctcccaaagtgctgggattacaggcgtgagccaccgtgcccggccactggatcttataaatcacaggatttcagaggagatgcggccctggatcagatactaacatcttatgtcttcccttgagtgctgggaaaggggaggttggagactgggaaacattttgccatttgcagtcttaggagatctttgtaaagatttctccctctggctggttttgaccaggatattgccaaattccacgtcttggtttctggatcctcccgagcctttgagtttcccgtgaggccacagctgtagggaggctgagccaagtggccataacaaccaggcagagtagcaggaagaagcaggggcagggtacaagcctccccctcaggaggggaacttccctgtgccaaggggaatgaagggacccaggagatgcacagcagacccagtgccctacctctttttatagtccaggtcccccacagacccctttatcagctggcttactgttcactccaaggtcacgacagtggctgtctgatgcagggacagaaatccctggcacagcctccatgttgtccctctgcagagacaggaggactcaggcctggccatgatgctggagtcaccgtggatataggccctggcccatttgactcaagaacacatacataactggaaccaagaggctggcgaatcctctcaagaccctggccacttggaagaccctaagcctccttgcaggtggccatactaagcaaagtcacttgcagccacccttccacgatgcgttctacatcacccagctgtgaaaaccacccacccccatccccatccccttcacactcatgccttcctcctgagctcaaggggccctggcccaaggttcctttagaaccaggaaggaggttttgtccctctgaaaatcatccttttcaaacagaaggcatttatcttggccaggcttaaaagacaaaaagatgatagctgagctctagggcccatcccacagacaatatccagaaaccttctccccacaattcccacaccagcctcccagcagctggatcttttctccacgggatttgcctacaagacttctctccggctttatctcaggcgggtttgtcaggggagcaatgtcaccatccctccaccaaattcacctcaacaacatttactgagcaccaagtgtgtccccaccgtggctcagccttcccacgcactgtcctgatttaaccccacgtgcttataacccaagggagaatcactgcgatattttatcaatgtaaagacacacatcttaattgttcatattttcatgcacctgaaatttgggtaggtcttctaattacaactgtgacatggctgtcccgcctggtcccatacagactcagtcacagcagttcatagcattgtcactttaattaagttttgggcatggttgttacttcaaatgtggagtgtaggtgctattttaaatgtcttcaaaaagattcaactgtgattcagctttgaattgaaaagctattgtgcacacaggaagcctgggaacagagcagcagaatgcctgtgcgatgctggcgaggcagacacatattcatccctgcagacaggcccacaagtccagattttcttgcaaagcaccaaccaaatacttaaaaacttaaaatgggacttaaaaaccatcccaggctgggcacagtggctcacaactgtaattccacagctttgggaggccttcaggattactgaagcccaggagttggagaccagcctggacaacatggtgagacccccatctctacaaaaaaaaaaaaaaaaaagaaaaaaaagaaaaaacttaaaaattacctggacatggttgtatgtgtctgtagtcccagctactcaggaggctgcggtgggaggatcgtttgagcctgggagttccaggctgcagaaagctacgattgtgccattgcattccagcctgagcaccaatgagatcccatctcaaaaacaaaacaaaacatccccgggatgagtggacacacttgcaagaaatgcctcacttcctgtgcttctcgattaggggccaccaaatgtttcatgcaaagggtgatagggaatatttttggtttgtaagctacacaggctcagctgcaaccactcaactctgccatcagggcctgaaagcagtcatagggttgtaactatgctccaacaaaacttttttttttttttttttttgagacggagtctcgctttgtcacccaggctagagtgcagtggtgcgatctcggctcactgcaacctccgcctcctaggttcatgccattctcctgcctcagcctcccaagtagctgagactacaggtgcccaccaccgcaccaggttaatttttaaaatatttttggtagagacggggtttcactgtgttagctaggctggtcttgatctcctgacctcgtgatctgccggcctcagcctcccaaagtgctgggattacaggcatgagcctccgcgcccagccccaacaaaactttatttgcaaaaacaagtggaggaccacatttggttcatgggtggtagtttgctgtccctttctcttgatagaacagaaaacaatgtggaaaaatgagggcactgatgattttaagtcaaaagtgatacagaagatgaactttgaactaaaaaaaaagttttaagaatatcttacttcaatgatattttatctgtgtgtacttacaaaagtgatgtgtgattaaaaaaccaaacaaggggactgccatcagcaacagccccaaagcccactgggctccttggtgggttgtgagttcagcagcctcagcagggtgcatcagtcgagcacagctaggactccccacaacatgcgtgtcccaggctggcactgagacacagcgctgatgttgctgccgggggctgctgatggcactggtgctggtgctggggtggctgctatgggtgagggggcgtcaaggaagagcacagtagtgtgtagatgtgaaccagggtccccaggtggtcgcctttgaatgggccaatgtccaagacctgtacatgattgtgctctgcatccttgcagccagcctggccaagactggttctacctgtcccacaaggtcaccagcatagtccctgagagcaccctgctcatcatcctgggcctggtgctgggcagcatcatctgggtggccaaacacataacatccttcatgatgatgtccctcatcatgctagatgccagctacttcatccccaactggctcttcttcggcaacctgggcaccatcctgctgtacaaggtcatcagcaccatgtggaatgcatccaccaccatcctgtccctctatgacgtctctcttagtaggctcatgggctacctgcagatagggctgctggacttcctcctgttcggcagcctgatcaccactgtggacccagcagctgtcctggttgtgtttgaggaggttcatggcaatgaggtcctgttcatcatcatcttcagggagttgctactgaatgactctgtcatcatggttctgtacaatgtgtttcaatcttttgtgacactgggtggtgacaacgtgaccagcatgaactctgtggaaggtgtagtctccttccttgtggtgagcctggggggcatgctggtgggaatggtctttgcctttctgttgtcactggtgacccacctcaccaagcatgtgcacatcatcgagcctggtttcatgttggtcatctcctacctgtccattctgatgtctgagaagctgttgctgtaggccatcctggccatcatcttctgtggcatctgctgccataagtacatgaaggccaacatctcagagcagttggcccccaccatgtgctacaccatgaagatgctgaccagtggcaccaatcccatcttcatgtccctgggcaccttagccatgaacctgctcatctggacgtggaacaaggcattcatccgcctgcactggccttcatcttcaggtactgaggccatcagtgtcatccactcctggctcctggactgctattggatggtgtggctggaaatcataggccaggtggtcatgtcctgtggaggcctgcatggggccatggctttcatcctggtcatacttctgaatggaaacaaggtcaaggagaagaacctgtttgtcagcaccaccgtcaacatcttcaaggtcatcttctggggtctgaccatctagtccctggtgcagtggctgaaggtgaagaggagtgagcactgggagcctaagttccatgagaagctgcaatgccaccctctcgaccacatcctcttggccatcaaggacatatcgaggcatatcaggcacaatgatctcaaagacatgtggtcccactttgacaggaatttcctcagtggagtcctcatgagaaggctggcccagaagtctccagaagggatcctcaatgtcttccatgcactgaacctgaaggatgccatcagctaagtgaccaaaggagagtgcctgagatccctggccttcatcggctccccaagtactgataacgtggtaaacgtggacttcacaccacgatcgtccaccatggtggcctctgtctcctaccacctgagggagaacatcagcaccgtctgtctagacattcagtccctggagcagcatggcagagcattcggtacggggaggacacggtcatgcaccacatgctgcagcaatacctgtgcaagctggggaaggagtatatgcatcgctacagccacaccagctgaggacaagaagcaggaccgagatatcttccacaggtctatgaggaagcacctggaatccttcaagtagaccaagctcaggatcacccagaacaagaaggcggccaagctgtacaagccaaagcgtgcccagaaacagagaactcccaaagctctgtacccgctccagcacagctgcactaatgccaacccaggccagggcctgggcctgagcggccatcctacactgctgaacaaaatgaatttgcaaaagtgataccccaggcaaggctccaggcccctcccagcccagcatctctccccagcacggtggggtgcatccagagtgccaggactcagggcctgaccctggagtggctgcaggcccagcaagtggcccaggctcaagtgctattttcaggtccttagcagtttgttgaactgctgggtcacctcgtgcgctgcaggtaaagttgcaggaatgtcttctgtttgctcagcacttgcgatttagactccttgaaccagcacctgccccctttccctcccagttaccatcctgcccttgccagctttggaggtggaagctctgggtggctgccatgcaaatgcctcttctggatctggtatcgcaaggggggatagagggatgaggcctgaggtgaccttgaggtcatttaaattttctaaattagacaaaacaattaaaaaaaaaccatattcccatgccttttaaaaatcaaaaccacgtactgtttcttttcagtgtaagcagttttaattacctaccaggtgcagagtctaggatacaagacagaactgcagataaagtctctttccagcatagctaggagacatggctcactccacctgttcccaggcctcacctagaaatctaatgaatggctccaaaccaggtaaactagataattttccaaagtcaaagaagcagtttatgacattaaagcacttagccaatttaacctctgacttaatttagaacaaatgtctaaattttaaagacttttttaccaataattttaaaactgtatttcccaaagattactgaagtcatgtgaaataaaaggcatgagagtgtctattcttctgacaacatatttaagaggtttcattttctcttaatccaattaattagagtaccttcatataagcatcacacacacaacacttctagacaggagaagatctagcagttgtaagtttttctttcccatcttatgactttctgacttgtcctatattttgctctttcctagtcattctactttaggacaagaatttgccatacaagatgctctctcacataaaatttctttccttcataacctatcttacataaatatatcttcatatccacaactttttcttttcttcttttttttttttttttttttggagatggggttttgctcttgttgcccaggctggagtgcaatggtgtgatctgtgctcaccacaacctctgcctcccgggttcaagcaattctcctgccgcagcctcccaagtagctgggattacaggcatgtgccacaacacctggctaattttctatttttagtagagacggggtttctccatgttggacaggctggtctcgaactcctgacctcaggtgatccgcctgcctcggcctcccaaagtgctggaattacaggcatgagccaccatgcccagtttccacaactttttttagatctctctcccctactaatttctgatgcccacccaaatcaaaaaggtcagataaagcaaggcaaaacagagtagagccttagattttgagagggacctgtctgcttacacttcttgaagttccataaggaaaacagacgtttctcctaaaatggagtctatggcaccttctgtttttcctaaggagtcccaggttgtcaggaattaccttaggtcctctcatatgagcatcaagagtggcaagaagacagactagggaaataattcagtcaactgagaagaaaaagaaaaccttagtactgttccccttgtaaagatggataaatggaggcaccatgcatactgtacggaacccgcccaggcaatgcaacctgggatagcatgcccaacgtgcccccgtggagagcagtgcagacccagataccacacctaccctgcttccttttctaccactctggccatactcccactgtgggctgccctcctaccgctctccccgctgcagtctccatggccaccaccaacctcagctaagcgaaacacgttgccacacgctcaagcctaccgcatccagcaggcgtcttacccttctccttctctaagctgggcaccgaacatcagggtatgcagacacaggagagcccggtaatggcctgattccttgccccctcagccggctttatatagggaggttttgcaactgagtgcctggactacatattctgattggatgagagaaaacgtctaggcctactctgattggactttattgtcatgttctgattggttgccttaagaattgctctcatccaatcagaacatgataataaagtccaatcagagtaggcctagaggtttttctcccatccaatcagaacatgtagttcaggacccagtggtgtaacttccctatataaagtatgctgaggggacgtcaggccattgcagattctttagtgtttgcctcctcagcggctcttgcccggcttagaggaggaagaggcgaaaggaaagacacctccctcactctggcctaaggcaccacggctcacctcactgctgtggttggtggttgctgccacggagactgaagagccaccggagtagtaggagggtggcccacagtgcaggagctgctcagtgcccggcttaaaggaggaagagaaggggaagacccctgtcccaagctggaggctggagctcttggcacctcggctggcctctctgcgattggtggctgtaatgaagactgcagccccgcctgagcattaagaaggagaaaatagtttttgggtaaatggagggagaaaagagagtggcaggtggaaggagtacagagagagtagtaaaggggggaaaacacgggggcgagcaagagggagaggaagttttgcgaaaagagagtggggagaaaagtttttgggtagatagaaggggaaaagagggtggcaagcaggagccataaaagatggtggggaaaagagtgggggaaaagtttttgggtagatggagggggaaaagagggtgacaagcaggaggggggaaggagggttgggaaaacgacggaaaaatagttttggggggcagatggagggtgaaaagagggtggcgtgtgggagaggggcgggagtggggaaaagaggttgttgagcaggagcggggagaaggctttgtgaaaagatggtgaggggggaaagacaagaaaaaggtttttgggtagatggagggggaaaagagggtggtgagtaggagggggcaagagtggtgagcgagggagacaaggttttccaaaaagaccatggaggaaaatgtttttgggtagatggagggggaaaagagggtgacaagcgggagaaggaaaaggggtggtgagagggagggagagaaggttctgcgaaaagaaggaagacagaaaagaaagatggtgcagaaacaaaaaacgtgggtaaaaagcttttgggcagatggaggggaaaaagtggcaagtgggaggagaagagagggtggcgagagggaggtagggaagaggattgggaaaaagatgatggggaaaatagttttggggtagatggagggcaaaaagagggtggcaagcaggctaggggaaagaagagggcgagcgggaaggaggaagggctttgtgaaaagacagtggggaaaaatttggggggtagatggaggggggaagagggtggcgagccgaagtggggagaaggctttatgaaaagacagtggggaaacgtttttggatagatggaaaagagcgtagcaaggaggggaaaaaagacgatggggaaacagtttttgggtagatggagggggcaaagagggtggtgagtagcaggagtaggaaaaaggctttgggaaaagatggagggaaatgtttttgggatgatggaggagcaaaaggctaatgagagcggaagggggaaaaagagggtgggtaaaaactgtggggaagtttttgggtagatggggaaaagagtggtgagtgggagagtagagaaggtgttgtgaaaagacggtggggaaaaaatgatggggaagaagttttggggtagatggaggaagaaaaaggatggcgagagggaggggtccgaaggcggtcaggaaaagaaggcagggaaataatgatgggggagaaagcttttgggtagatctttttctgatttttaaatcagattatttgcatttttgtttttgagtagttcttgtcttctttatatattttgtgtattaacccctcgcctgatgcatagtttgcaaatacttccattctctggattatttcttcattctatggattgcatcctctgctttgcagaagttttgaagtttaatgtaattccatttgtctatttttgctttttctgcttgtgcttttgatgtctatttgaaaattccttgtcctaaccaatttcctaaagtatttttcctatgtttttttctctagtagtttcatagtttcagatcctatatttaaatctttattttgagttgattttcttacatggtaagataacagtctagatttattcttctacctgtgggtgttgggttttcctagcacagtttattgaagagattgtccttcctgaatgtgtgttcttggtgcctttgttaaaattgagttgactgtaaatgtgtgaatttatttctcagttctctattctgtttcatttgtctatgtgtgtctgtctgtcatttgtctatgtctgtctctctgtctctccccgccccccccccttttcttgccagtaccatgctgttttggttactatagatttgtagtatattttgaaatcagtgtgatgcctccagcttttttctttttattcaacattcttttgtttatctgaagatattttgcatttccatgtgaattttaggctggtttttttttgtatttctatgaagaacatcttttgtaatttaacatggattgcactgactctgtaagtcatatattgggtgacacagatattttaacaatattctttctagtgcatggacataggatagctttctatttacttgcatttgctttaatatctttcatcaatgtgttttatagttttcattgtgggatcttttgcctttttggttaagtttatccctaggtatctttttttggtgagtactgttaatgaaatagctttcctgatttttcttaggtgtttcactattggctcattggtgcgctactcatttttgtatattgatattgtgtcttgcaattatactaaatttattatttctagtaaaatttttagtggaatctttagggttctctattatatgatcatgttacctgaagacagagaaaatttgactcctttttttccagtttggatgccttttattcatttgtctaattgcattctcttgcctaattgctgtagtgaggacttccagtactataatgaacaaaagtggtaaaagtagccacgtttgttccagattttagaggaagagcttttaaattttccccattgattatgatgttagcagtgggtttgtcatatatggcctttattgtgctaagtaatgtttcttttgtattcattttgttgagtttttatcatgaaagaatgttgaattttatttttttcagcatctactgaaacgattacatggtttttgttgttgatttgctgaatatgatgtatcacatttatttgtttattgaatcatcctcattttcctcagatgaatcttgcttgatcatggcagattatctttttattgtattgtcaaatgcaattttcaagtattttgttgaggatttttttgcatctgtgttcatcagggatatttgtctgtggttttctttttgtgttgtgtcctggtctagtttttgtaccagggtaatgctcgccttatagaacaagtttgaaagtattcctcttcatattttggggaatattttgagtaaaatcggtattcgttgttttaaaaatgtttggcagaattcagcaataaaaccatgattcgtgtgtttttcttcaattgacaggagactttttattactgctttaattgcattactcattattcgtctcttcaggttttttatttctttatcattctatcttgggaatttgttatatgtccagaaatttattcatttctcctacatttttcaatttgtatataagtgtttttagtaatctcttagaatactttgtatttctgtgtgatcaactgtaatgtctcctttttcgtctatcattttcagtttttcttagtctagttaaagcttgtcaattttgacttttttccaaaaacaaaaaaaccccagcttttggttccgtttgactttttgtattttttttagtttcaatttttaatttttttctaatctttattattttatttctactaatttgatttttcttgtttttctcattacttggtgtattgtcaggttgggtatttgagatctttctacttttatactgctgtgttgacttctttacccttatataattatctttctagtttttctttttttgacttaaagtctattttatcagatataagtgtagctactcctgcttttttgtttccatttgtatgggatatcttttatcatcctttcattttcagtctatgtatgtctttataggtgaagtgagtgtcttagtcagtatatagttgggtcttgtctttaaatccactcagccactttgtcttaattggagaatttaattcatttatattcaagattattactaacaggtaaaaacatactgttgccattttttacttgttttctagttgttttgctactctctttttttgttttctcctttcctttctcttctctcctctctctctcctttcttcctttcttttccttcctctttcccttccttcctgtctttatttgtagtgaggtcattttctctggtagtgtgttttaatttcttgcttttttatttttagggtgtctattactgatttttgttttctggtcagcatgaggctaaacaacataattataacgagttattttaaactgaagaaaacttaaccttgattgcaaagaacaaaaaagagagaaacaaaaaaaactaaaaacatttaccctgtaactctatcccccgcaacacacacacattttgtatttagatgtctttcagtatttttttttttttttttttttttttttgagacggagtctcgctctttggcccaggccggagtgcagtggcgctatcttggctcaccgcacgctccgcctcccaggttcacaccattctcagcctcccgagtagctgggactacaggcgccagccaacgcgcctggctaattttttgtatttttagtagagatggggtttcaccatgttagccaggatggtctcgatctcctgaccttgtgatccgcccgccttggcctcccaaagtgctgggattacaggctcagtatgtttctatattgcctatccctttaaaaattgttgggttatattattattttaacaattttgtattttagccttcacatgaaagatataggttgcttatacatcacaactatagtattctaaatttatctgtgtacttttagtaatgagatttataccttcagatggtttcttgttacatgttagcatcattttctttcagactgaacaactccctttagcatttcttgtaaaccaggtttggtagtgatgcatttcctcagcttttgtctgggaaaagtatttatctcttcttcatttttgaaggatctattctttgggtgtggtttttttcattggtattgtttttcttaagcactttgaatatgtcatcccacttctcccataggagggaggccctcagcctgtttaatttttgctgagaactctgcttcctgacatatcaaaggtcctcaatatgttgtttgattcacttctcttgctgtttatagtatcctctttgtccttgacatttggagttggattattatatgccttggcatagtttttttttttttttccttgagatggagtctcgctcttgttgcccaggctggagtacagtggcacagtcttggctcactgcaacctctgcctcctgggttcaagcaatcctcttgctcagcctcccaagtagctaggattataggcacccacgaccatacttggctaatttttgtatttttagtagagatggggttgcaccatgttggccagggtggtctcgaactcctgacctcaagtgattcacctgcctcggcctcccaaagtacttgggattacaggcctgagccaccgcacctggccactttggcgtagtcttatttggcttgaatctgcttgatgatctttggtcttcatgtacctggatatttatatatttctcttgaattggaaagctttctgttaccatctttttgaataagctttctactctttctctgctttctcttgaagaccaatgactcttaaatttgctcttctgatactatcccatagatttcctaagctgccttcattcttttttttcttttcttttttctcctattgtgtatttcaaatggcctgtgtgagctcactgattctttctctgttggatcagttctgctgttgaggccctctcatgcatttttcagtgcatccattatatttttcagctttgaggtttttgtggtcttttaaaattatttcaatctctttgttaaatttctttgatacatttccgaattacttatatttttaaaattgcattgattttcctcaaaacagctattttttacctccctctctgaatagtttaacatctttatctctcctaggttagtcactggtgacttgtttattgtttggtgaggtcatacttccctgaatgttcttaatgcatttgggcctatgttcatgcctgggaattgaataagtcagtatttattccagtctttgtagtctggtcttgtttgtacctgtcctcctctagatggtcttccagaaattccaagggtactgactattgagttccctaaggctggggtcactgaagctgtttcagcaccagggtgccctaagctcaggttcactgtgactcttgcaggactgaggtcccagagggccctgatggacttggagaagataagggaggggttccctgggttcccaggcaaagtgcttcattcacttccctcttcttcccattggaaggagtctgggtactaagctttgtggatctgggagaagggtggcttgggcactcccatggccactgcagctggcaccacatacccgaagcccacagcctctaggaccagagcagcactggggcttgtctgagtcctgtggccactactgcctgactgctgctgacttatgtaggtcttgaggccgagctactctgctggtggtgaagctggccagggtttaggtccatcccgccagggcagcaggttctcttctacctccaggcaggtctagaggtgtctgggagctcctgcctgggatcagggccactgtgttctgcctgatgctgtgtccaccgtggtggagcctggactgggttctcctctttcctgcataggaaaggagttctcccggcactgcactgcctggagttgggattagggtaacacaggcagccctgtggccactgtagcggatgtcatatatgaaacccacagcctcccagaccagcacatcattggttgctggggctcacccaaggaccacagtggctatggcctgcctgccactgaaatttattcagagcctgaggccactttaaacagctggtggtgaaggaagtcaggactcaggtttgtcccaccgggcagtggattcccttctagcccaggtcatgtctaaatgctctgtctgtgggcaccggccatggaatcaaggaccatggggttctgcccagtgctgtgttttactgtagcagagctggtactgggctccaaggcaaagtttaatgcacactctcttctccctcctggaagtggacacattgtctctctgcactgcctggggttgagggagggatggtataggcactgcaagactgtcttttccaccctgtttaatgtgtcttttcttgtttttaagctaaaaccaggttctgtgatctgtcacctgatttctttggctcttgtgaaggtattctcttgcttagattgttggtggttcaatttgatgttcctgcagggagacaatcttgtagagttctattctgccatctcgctccaccacttctcatttatttaattgttcttcaacttatttcaacaatattttgcaggtttcaaagtatgaattttgcactgctcttgttaatttctaaatttattacttgttttgttggtattatacatgggtttgtttccttaataccattttaaagcagtttattgatagtatatagaaataaaattaaatttttagtattgcatttatatcttgaaactacgtcaaatttatttctaatagtattttactgaatttcttagaattatatatgagatcgtgccatgtgtaaatataaaaaaattattttcttttcaataaggatgttttaaattttccgttctttactacacctcgctacaatctacaatataatgttgaatagaatttgcaagagtggacattcttgtaactgattagtcattcaccctctcattgctgagtataatgatagctgtaagtttcataggtaactaccactagtttcaggaagttaccttattgttcgtaaatttggagtgttttgttttttttttgttgtttttttttttttttggagacagagtttcactctttttgcccaggctggagtggtacaatggcgaggtcttggctcactgcaacctccgcctcccaggttcaagcgattctcctgcctcagcctcccaagtagctgggattacaggcgcctgccaccatgtctggctgagtttttgtatttttagtagagacggggtttcaccatgttggctaggatggtctcagtctcttgacctcgtgattgcgcccgcctcagcctcccaaagtgctgggattacagttgtgagccaccgctcccagcctggagtgtttttattattagaatgtgtgatattttctcaaatgctttctgtctgagatgcttatatatttttgtcttttattctgttaatatggtgtttgcatgcaatgattttcaaatattaaatcaatggtgcattcctggggtaaatcacatctgcgtatagtgcataatctattttatatgtttctggattcagtttggcaatattttgttgaagacttttgattttataaaacaatgtgctgggcgtggcggctcacgcctgtataatcccagcactttgggaggcctaggtgggtagatcacctgaggtcaggagttcgagaccagcctggccaacatggtgaaaccctgtctctactaaaaatacaaaaattagccatgcatggtggtgcacgcctgtaatcccagctacttgggaggctgaggcaggagaatcgcttgaacctggaaggtagaggtcgcagtgggttgagattgcaccactacactccagcctggatgacagagtgagactctgtcacacacacacaaaatgaaagatactgttctatattgttttgtgatacagttttggtgtcagtaatcctggctttataaaatgaattgggaagtgttctctccccttttattttctgcaagagttggtgaacaattgatattaatttctcagtgtgtttgatagattttgcctgggaagctacttgagatttttattgtaagtttttaaaattacaatccaatctttttaccttctgtagatctatttcgattttctatttctccttagtcctttcatctattttagtttgtgtctttctaggaattcatccattctatctaggctatctgatttttttaacataagattttcactgcattgtcttgtatttttattttgtaatactggcagtgatgggttttcttttattgctgattttagtaatttgagtctcttctctctttttcttgattgacctaagtaaacatttgccaattttgttatcttttcaaacatttaattttggtttattgattttctctgttgtttcatattccctttctgttggcttaactcttattatgaaattttttttgtctttaaaaattttatatttggttaattaaaatttaagttgattttggggtatcaacgcttctcttatatgaaaataagagcatgaatcaagaaataatgggttcccaaatactgcagtggaaacacatttttttgggggggtacaaaacaagtatccatgtacatatagtccttggttccccaagtcattgagtcaacttagtcaaaataagtagcctctcatttcttatctcatgagggtggtcttgccttgcttggagacattataatgaattcacttgatgtagttacttttaagcataccagtttacttcatatcccattttcaaccagttatcgtacccggaataattgctagaatcaaattccatcatgcacaggtaaataagtaaattctgtcatttactatctaaattagatatataattatttatagatacgtacatatattttacttgtaattcagtgaacataaggctttgtatgctctgtctaaaatatgctgtctatattaattctcatgatagtaaagaatagagtgatggagtctatattttacatatatcttccatttagtagcagaaataaaatccttgtacttgatttggtaaattcctccatttaaattaagatgttacttcccggaaacaaaatttttttttcttttttttttttaaattttaaatctttaatttctgttttcacatattttctttttgcttccaaaaggaaaggagtgcgtagctctgttgactgtgtacatcgtccacagcccctgggtcggggcagggtcccctaggccgcccgggggtccacatgcagcccctggggggccggcgcggggtgaggtccgggggccgccttattgctgaggtccggccggttggggcccgccgctaggcgcgctggctgggcagctcctgggagatgaagcgacgcaggcgctccaggtactggctgtagagctcgatgtcgttgtgcccggcgccctccacccacagcggctccaccgccttggggcagcgctcgtagagcgccagcccgtgtgagaagtcgatcacctcgtcctccatgccgtggatgatgagcacgggcgacgtgatcttggacaccttctcgatgttagggaaggcgtcgaagcagtaggtcttggtgtcggggaaggcgacgcgcatgcccgaggtgagcggcgagtgcagcaccaccgcggcacactcgtagcgcgaggccaggtccacggtgggcaccgtgccgatgctctgcccgtacaggatgatgctgtccgggctgatgccgtacctggcggcgccggagcagggtcagccgcggcctccgacgcgggcgcacccttcccaccagcgggcgtccccgggcccagctccggatgcgaccctccagtctccccactcagctaagtcagtgggtcagacccaggctccacaccagtcccgagggccacccccagcccccaacaccgcggcggtgggcgaagccagcggccccgccctattccctggcgctgccgttcactggcgtttcctagcaaggatctgcagggatcccgcctacagagtgcccctggggcaggggtaggggaggccctggcacctctcctcctcctggtcacccctaggtgcacactgggaactgtgtgccccctacattctgaatgcttcacgcctccctgcccgggttagaaagccgttcctggtgcactggccaggacagcagacactcttcctccctgcagcctttgcccacccccttggccatgaggaattcaggcagctgtgtccccaaatgtctccacccgattttggagtctcggagtccccacgcccaatgagatgccagtgcaacccaggtcagcatcgagggtggtggctgcggaggtggcaccccctcccaccagcaccttcccttgggagtggacaagtcctcggccacctcagcaccaccagctcccacccaggggcacccccacccccaggtcactggtgtgcggcccctgacccagctgatccagcaacagttacaaggcctcctcgtgcccaatcccaaccacgcgggacccacctgccaccctgcccatgccgggaccccacaactctcctcccacacgctccaggctctgatcccaggcagacgccctcttgcaaggcaggagcatgggcaggtgtgcatcccctctgcctggcattcggactccaccagcgggctgtccccgtccctggcctggaatcccagcctcctggcagcactccacagctcgccactcacccatgccccaaaggatgctgcctggctggtgcctgtggccccagctctgcctcggcctccccggcctgctccctggcagccatggtcagtagtgtgctgagccagcccagccctaccacctgctacagtcaggagcccccagctgccacctggatgtcaccactcaaaggaacgggacacatccccagtggaggccctgggcatgctctggcctccccctcacagctctgggcctaggttcctgcaggacaaagtggcagcaggacagatggccgagcagacagagctcagagctggccatggcgggtgtgactctgccagaggcccaggcagtagagacaggaggggccgaggaagtcgcatgaagtggtgattggtgtcagcgccccacactgctgggaggcccccggagccagggtggtgccaggggaccagctcccaggcccacagcagggaccgcctgcaatatcaccaaggcaacgaggaccccacctccccagggcctctgacttctcagagttgtgcctggtcccctgcgggagcaggtcagaccagtgggctggggagggccaggacgagacagccccagtggatggcgagcaggaaaggccaccagaggcccacccgggtctcctcgtccaaagcagcactggcccgggcggtgctcaaacaccggtgaagggcccaggcaagcgcagggctggggacctggatgactaggagggctggatctggaatcgaggctggcccagacctcgggtgtgtgctgggggtctgcaccttaccctgcaggccctgccccaggatggccaagctccgcagccacagggcctcatgggccaggcctcgggacctggatgcagcagcctcgcctcacttggccccaagtgctgcctccgcagatgggctcccagccacacgtgcacagacccccagaccaccacccactcccgactgccgggtggcatccacgcccctgtgataagctcagccccttcccgtcctcaggccaggggttcccagggagcctggctccacaggccagggtgtgggaggaccgcctggccacacctcagccatgtggaggcggcacctgcacacccaagctcgcctgtccggctctctggccctgtgcatccactgtggctcccctcctgcagggccgcccaacttcctcccagggaagcccgccccccggcccccggcttggtcccctcttgggtgtgcccaggctgagctgcccccagggtcgccctcacctggtgcgcagggcctgccaggcggcgtcgatgtcggcatagaggttccactcggaaggcctgcccgcgctggcaccgtagccggagtagtcgtagatgatgttgcagtggaggcgggagttcagcccagtatagaagctgctcatctggcccaggtccaccgcgttgccgtgcgagaagaagaccgtgtacctggcaccaggcacgcagcgaacatacatgcaggagacgcggttgccgtgggcgctcttagtggggaagacctcgatggtgtccagctcgcgctggctgtactggaagtcggcgagctccgtcaggtgcagcttccagcgcccgaggaggcccgcagggtccccaagggggcggccccggccccaccaggccccggccccaccaggcccgggctcaggcaccagggagtaggtggcctccggcggcaggaaggcgagcttggcagcgatgcggccggggcagggcgggtagcagaaaaggcagcagagctcactcagcgacagcccgttcatggcaggcgcctcccgggccgggcctccaccggggcccccgccaacaacgccgcccggcctggccgggcaggggaggggtgggggtgctccgagtcgcgggcaggggtgagagccccagacggcagccccattaggaggccagggcccagccccatcgcggtccaagccgccccagggagcctcgcaaccacaggtctccatgtcgtgccgtgggaaggccaccccggcccgcgcccccgggccccagggccgcgctccatggctcccgaccgcccgcccgtgcatccgtcggtccctccgcgccccggcccggcctcctgcaccgccaccgccgcagctcccccacgaacggaagcaaaatttttcttaacgggatgataattcactagtttacctctaatgagtctcagtatttaatctatcatgaaattacgcggcaccaaaataaaatataattagttaaaacacaaaaattattttattgattaatttagacatcagatgtttacattatgaaatcaaggtattttttggtttttgttttgtttttagaatattagcaaatattaccaaacatgaaccatagtaaaagttcttcagtaacactttaccattccgttttcaaataacctgaatttatgtgccagattgaaaagcttttacatgagtgacctatatttctgtatgtatccaaatatttgtatatcatgtagacaagccaagaaaatacacagatatgtaagccattgcatagaatggtaaagaatacattcttaataagatgcattcgcttaatgctccaaacaggtctctagtatctcaaatgcagcattcacccactatttccaaacatatcagggccaggtgccatggctcatgcccataatcttggcactttgggaagttgaggtgggtggatcacttgaggccaagttccagaccagcctggccaacacggcaaaaccctgtctttactaaaactacaaaaaaaataaaaatagctagccatggtggcacactactataatcccagctactcaggagactgagatacaagaatcatgtgaacacgagaggcaggggatgcagtgagctgagccgagatcacgccactgcactccagcctgggcaacggagcgagtgagactctgtttcaaaaaaacaaaaccaaaagcattgtatcatgatatgtgactaagctgaatttaaaacactgtaacataaactagatgaaaagtattatacaaaatttttctttgtatttctatttgttttgaatttaccaacaattcaaatcttgctgagaatatttgcactataaatatttctgtgattattggttatattcaaattcgctcattttcaaagctacctgtataaaattattaaaattgtacatagcttggaataagagtatgttgaatataattgccatgtgatacatttatatttaataattaaaggcatattacaacacttacgcctcatcttaatgttacttaaccttagaaacagagtaaatgataggaataatatgggagacaaactgtggaaagccacattctgtatatctctgttgtttttattaaacttttttcctactgcactttaaatttgtcatagaccattattttagtaattattaatgtaatcttacgtatgtatattctctaccatcttagcaggttgaataaaatacatgattaaaggcaaaaatgtgtgcaaggaaaatatagaatatttaagttacaaaaagctactcttactgaatctcttaaattacagcttatagctaaagagtacaaactattgtaaaagttttctcccatttgtaagtaattacacatataaagtatctccccattcagtagatcttatatttctttgagaaacatatattaaatataaaatattctgaattctaaattgcatttaaaattgttcatcattggttatattatgtaattataagcaagtacatttaatgactacatactgtaaactttctttaccacgtggcacaaatagttaatttaccttttttttctgtctctgtcttctatgtcctaggctatttcagttttctcacgagtagccattattttcaatgaactaccaaaaagttataaggcagccacgatcaaacaaaaatgttagtaatatagtatagtataaaggttttttatttcttaatttatattccaaattgttaaataattttatcatccagtcttgatgtctgaaaacatcttaaaatagagaagttcacagtattagatgctgtatctttcttcatctaatgacaaaagactttagttcttttctcaattttaggagaagttttgctttaagaccaataaaaacataagtttacataagctgagagcacgttatgtatagctactctgtggaaaacattttattttaagagctattaggaacatcttttgagaatattcaagctatatatgatgctgcaaatttatttttatggttgctataactggcaaggcaagcagatgatatgcttgaagctatctcgtgatgagcacatctgagggaataaagaagggccttcacaagaagagggaggcagctggtacattcagtaatgcatcatgaacaccaatgcagtggctcctgagaaagagtcaatataatacctggattccttgtttctatctcatatgtaatccagtttcagggaagtataaaagtgacagggatggggagagtatatgaaccattaatatgaaatctaaagaagtgcaggcatccagctgtctggtgtctactgaggtcgttcacccagattaacaatacagatacttagttaaattctgaactgcagataatgggaaagtaggattgtggaaatcggctccatccaaattattactcaggtctcctcctcttccagatgctgtccccacagtatactcaaggtgtctgatgacagtgatgagcaactgaggaatcatttaattaccaagttcttcatccttacttaaaaatgtagagtcacaaaatcatatatgaaaacacactctttttttttttttttttgagatggagtctctgttaccaggctggagatactctttttcaatagagtatggccttctgtccactctcctcttattctttccagagtagcaaggtgtccttacggcatacatttagcataaaattagatgggttccattataaaataaaatggagacagaataagtcaatactgaattctttggtaaatcaagcaaagtctttaaaaatttttctagaaaatggatttatttttgtttttatttagtgtttgttttatttagttatttttagtttttttgtttgcttttgcttcattgttctgcattgctaactcgttaaaatcacaagctatcttattgtatattgagtgtatttgcaagagctgtttagtgttttcttccctagtgaaccaacataacgattattctgctatgagtctatgttacgaaatatgtctatgtcctgctattctcaggcttcatttttgcctctaaatccttcaggtactgttgttttgggcagtgtaatggatgtttcttcttttgttctttctgtgccttgaaaatttcagtaaggaaataaactggttgtcaaaaacacctgtttgttaaaattggaatcagactttttaaagaagagatatacttggtttccttggctaaatattcaaaagttaataggatttttttcatagtataacatagtttcaaaagttaaacgtaattgtatttagttttattgaatacctacttgtgtggcatattacatttatttttgttaatattaaatttaaacaattttaagtataaattattatatagtgtgcaaatgtctttttcatataatgacttctttttctctgggtatatacccagtggtgggattgtggatgaaatctatttatagatctttaaggaatctccatactgttttccatagtggttgtactagtttacattcccaccagcagtgtaaaaatgttccctttacaccatattcatgccaacatctgttgtttttttattttcttaattgtggctattcttgcaggagtaaggtggcatctcattgtggttttgatatgcatttccctgataattagtaatgttgagcatgttttcatttgtttcttggccatttgtgtatcttcttttcagaattgcctagtcataccctttgcccactttttgatgggatttgtttattcttgctgatttgtttgagttccatgtagattctggatattagtcctttgtcagatgaatagtatgcaaaatattttctcctaatctgtgggttgtctgtttactctgctgattatttctttttctgtgaagaggctttctagcttaatttggtcctagctacttatctttgtttttgttccatttgcttttgagttcttattcatgaagtctttgcctaagccaatgtctagaagagcttttctaatgttatattctagaagttttatggtttcagggcttagatttaagtctttcatccatcttgagttgatttttgtaaaaagtgagagatgaggatccagcttttttcttctacatgtggtttgcaaattatcctagcaccatttgttgaatagaatgtcctttccccactttgtatttgctctgtcaaaggtcagttgactgtaagtatttggttttatttctggttctctattctgttccatttgtctatgtgcctatttttataccagtaccatgctgttttggtaactctagccttgtagtatagtttgaagttgggtaatgtaatgcctctagattttttttttttttttttttgcttagttttactttggctttgagggcttttttttggttccatatgaattttagggttgttttttctagttctgtgaagagtaatgatggtattttgatgagaattgcattaaatttgtaggttgctttagtcagtatggtcattttcacaatattgattctactcatcgatgagcatgggaggtgtttgcacttgtttgtgttgtgtataatctctttcagcagtgtcccttagttttccttttagagatctttcatctccttggttaggtatacattcctaagtattttattttttgcagttgttgtaaaagaggttgagttcttgatttgattctcagcttggtcattggaggtgtataacagtgctacctctgatttgtgtacattgattttgtatcctgaaacttggctgaattcatgtattagatctaagaactttttggatgagtccttagggttttctaggtatacaatcatatcatcagtgaacagcagcagtttgacttcctctttacctatttgaatgccctttgtttctcttgtctgattgctctggctaaaatttccagtacaatgttgaatagaagaggtgaaagtggatatccttttcttgttccagttcttaggcgaaatgctgtagatttttctctgtttagtataatgttgactatggatttttcatagatggcttttattaccttgaggtatgtcccttctatgctttttctgatggttttaatcataaatggatgctggattttgtgaaatgggtttttttgcatcaattgaaatcatatttttaaatttttaattatttatatgtgattaattacatttattgacttgcatatgttaaaccatcccttcatccctgatatgaaacccacgtgatcatggtgtattatctttttgatataatgttggactcagctagtattttgttgaagatttttgcatctatgttcatcaggggctgaactatagacctacagagtctgaactattggtctatagttttctttttttgttatgttctttcctggttttggtattagggtgttactggcctcatagaatgatttaaggaggatttcctctttctttatcttttgaaatcatttcagtaagattggtaccaattcttcgaatgcctgatagaattcagctgttaatccatttggtcctggacatttttattgttggcaattttttttactattgtttcagtctcactgcttgttacttgtctgttcagtttctttctcttttttttttccacgtaggatctcgctctgtcgcccaggctggagtgcagtggcacaatctgagctcactgcaacctctgcctcccaggctcaagtgattctcttgcctcagcctcctgagtagatgggattacaggtgtgcaccaccacacccagctaattttttttattttcagtagagacagggttttaactctgttggccaggctggtctcaaactcctggcctcaagtgatctgcccacctcagtctcctaaagtgctgggattacaggtgtgagccactatacccagtgcagtttctatttatttgtgttttaatctaggagggttgtatatttccaggaatttatcactctctctaaattttctagtctgtgcacataagggtgttcatagtagccttgaatatatttcatatttctgtggtattggttgtaatatttcccatttcatttctaattgagcttatttggatcttctccctttttttcttagttaatctcactaatggtctattgattttgtttatctcttaaaagaatcagttttttgtttcatatatcttttgtatttttgtttcaattttatttaattctgatctttattatttcttttttcttctgggtttgggtttggttggttcttgtttctccagttctgtgaggtatgactttagattgtctattcatgctctttgatgtaggcatttaatgctatgaaccttcctcttaattttgctgtatcccagaggttttaataggctttgtcactattatccttcagttcaaacaattttttaaatgttgcataacaatgtttatttagttttacatttgtttacaatttcttataaacacttttcgttataattttatacaaacaacagtaggagaaacaaggagctagaaaacattagaaagttgagatttggagggaagaattttaaagactggaagtactagagggagagaatctagagaatgaaggaggcaatacttgaagagataacacaatgttccaaatttgttggtaaaacatgaattcgtaaattcaggaaacacaatatataccaaacatatatttaaataaaatccaggcctagactcaaggtagtagtaaatgacaagataccaaacacaagattttaaaagcaaccatggggagaaaaagatcatcaatgaaggcaagacagtcaaatcgtaggcttcgtaacagcaacagtgtacccaaacaattattttatttatttatttattttttgagatggagtctcgctgtgtcgcccaggctggagtgcagtggcgcaatcttggctcactgcaagatccgcctcccaggttcacgccattctcctgcctcagcctcccacctagctgggactacaggcacccgccaccacacctggctaatttttttttgtatttttggtagagacggggtttcatcgtgttagccaggatggtctcgatctcctgacctcgtgatccgcccgcctcggcctcccaaagtgctgggattatgggcgtgagccaccgcgcctggccatatttatacttttttaataccactaggctcaacccgtatgatattttttgcagcagctttcttgagatgtaattcacataccgcataaatcgcccatttaaaatgtacaaccgagcggtttttagcgtattcatagagtcgcacatcaccacaatcaattttagaacatttttatcaccccccaaagaaatccacatcctttagccgtcaacctccaatccttccatttctctgcacctaggcaatgtataatctactttctgtctgtatagatttgggtactccggatgtttcacgtaaatgcagtcatgcgacacgtgatcttgtggctggcttctttcacttagcgccatgttttctagtttcacccgttttcagcatgtgtccgtccttttccttcttttcaaaacagttttattgagatgccattcacataccatgcagttcattcatgtaaagcatctgtaattcaattgcctttagaatatgcacagttacgtagccatcaccacaatacattttagaacattggtatcacctcaaattcctttttattgccaaataatattccactgtatggatataccacgttgcatttatccactggtgggcattttcactcttagaatattataaataatgttgctatggatattcgtgcacgagttcttgtggggacatatgtcttcatttctttcaagtatatacctaggaatggaattaatgggttatatggtaattctatgattaagcttttgaggaactgtcagacaagccatgtgattgattgattgatttttaaagacagggtcttattgtattgccccagctggtctccaactcctgagctcaagcaatcctcctacctcagcctctgaatggctggggctacaggcacgtgccactgcacccagctgccatgtgatttttttcttcccaattttctcactgaacattaatcatgtgtattttcatgaatggttaagtgttctttgagcatgtggcttttaacatttgcttttaacatttaacatatccaaattttagttggccaatcccctgttattggggacacttccaattttcattatgataaacagcatttccatgggcatctttttttttttttttttgagacagagttttgctcttgttgcccaggctagagtgcaatggtgagaactgcagcctccacctccaggattcaagtaattctcctgcctcagcctcttgagtagcggggattacaggtgtgcgccatcatgcctggctaattttgtatttttagtacagctggggtttcaccatgttcgtcaggctggtctcaaactcctgacctcaagggatccagccacctaggcctccaaaagggctgggattacaggtgtgagccactgcgtccggccccatgagcatctttaggcatcaatcttttatgcatctctggttatttctctagagcacattagtcaaatgattgtatcaaagggcacaggcagttttgaggctctcagtgcatgatgatatattgctttccaaaaaggctgtgcccgtttgcattctcaaaagtagagtgtgcacccctccttatattttaatagtttcctgaggtcatcagaacatgaacatggggagggcagggacttgcttgggcatcttggataccatgcccagttgaatgtgcagtacttagtaggggtttgtgtgacaggaatgagtgagagcacatgaaggcccagatgagtgcagggtccgtggggcacagaggagggtacaggtgtgtgagcaccgtgtggacttagcacacggctgacgtgaggactcagtgcagacacaagtggtaacaaggcctcgtgaatcaaagagctcctcaacctggaggtcgaagcagctgattggagatgaggaagccacactccaaggtcacttagggacagacgctggcagggctgatctgaagactggcagcaactcctttttatactccactctgcaagcgccagtctttatgcagagttctggaagaattcccttcactgagctagcaaggccatcaaactctgcgttcacctggatatcctaaggagacacccattacaaggatgaactttgttactatctgagaacttcaccatttttcactcacacacgcaaggtctcagagaagctccttcgggcggcttctcccctgtggatgacagtctcatacccgcaaactagtaagatccaggagagaaggggacaatgggggatgtttagaggcctgctgtatttatttatttagaaatgggatcgtactgtgtcaccaggctggagtgcagtggctcaatcgtagctctcttcatccctgagctcctggactcaagctatctatcctcttgcttaagcctccagaatagcagggactacaggtgcccaccaccatgcccggctatgctgtatttccagatctgggggctggttacatagacacctatgctgtttgtgaaaattctccaagctctatgcttaatctttgtgcatttttcagcatagatgttgttcctcaattaaaaacaaaaaaccaaggggttgtgaagaacagaactggcactgatggagtccttctctgtgcaaggcctttcccttaggtctgtcatctcagcttatgttcatgatggccttgcggggtagacgttagccccatttcacaaaaacacaagtctgagcccagggaaagattttccttgaactataagtcttcaaaactatttccctcaaagctcagaataaaatctgggctagtcagattatactagtgataacagataacaacagttaaggaatagaaggtagaatattcaattcaggctaattgtttttctttgtttttttgttttttgggtttttttgaggtagagtctcgctctgtcacccaggctggaatgcattggcatggtctcggctcactgaaacctccgctttctggttcaagcaattctcctgcctcagcctcccgagtagctgaggttacaggtgagcaccaccacatccagctaatttttcttctatcttttacaacacagagtttcactcttgttgctcaggctggagtgcaatggcacgatctcggctcactgcaacctctgcctctgggttctcctggaggtgattctcctgcctcagccccctgagtagctgggattacaagtgcataccactatgcccggctaatttttgtatttttagtagagacagggtttcaccatgttggccagactgatctcgaactcctgacctcaggtgatctgcctgcctcggcctcccgaagttctgggattacaggcatgagccaccaactccggccaaatttttgtattattagtaaagacaggttttgccatgttggccagggtggtcttgaactcctgacctcaggtgatccacctgccttggcctcccgaggtcctgggattataggcgtgaaccatcatgcccatcccaggctagttattgattgatcgtttatgattctttgactcagaatcttgtccaggatctcacactgatagacacaggatttggtcccaaccctgaactgattccaaagcccatggcattcccacgagactaggggcttctgataatgaccatacattgtgacaagtaagtgtatatttgggcaggataatgccatatgacattctatttcttttagaatgacagatccagtgctgacaggaattctcagagcagcaggcacatggttaaggcaagaacaggccattagaaggaaatggtaaggacgtttgacatcggttgtcccaaacctgaagaattgaaactacacagacacatttctggaaaggctttcactcaagtctgggttgaaaaaaatcagggttagaatcagcactgatttgtaactcaatttttttgtttccttccctttttttttgagatagaatctggccctgttccccaggttggagtgcagtggcacaatcatagctcactgaagccacaaactcctgggatcaggtgatcctcctgcttcagtcttctgagtacccgaaactacgggtatgtgccacatgcctggctaattttttaaaaagctttttgtagagatggggatcttgctgtgttgcccaggatggtcttgaactgtaggcttcaagggatcctcccacctcagcctcccaacatgctaagattataggtgtgagccatctcacctggcactttttctacattaaaaaatcaaaattcaccaggcgcaatggatcatgcctgtaatcccagcacttggaaggccgaggtgggtggatcacctgaggtcaggagttcgagaccagcctggccaacctggtgaaaccctatctctactaaaaaaaaatatcaaaaaaaaaaaaaaaatcagccgggcgtggtggcacacacctgtaatcctggctactcaggaggctgaggtagaagaattgcctgaatctgggagccggaagttgcagagagccaagatagcaccactgcactccagcctgggcgacagtgagactctgtctcaaaaaaaaaaaaaaaaaaaaaaatcaaaattgacccaagacatgagagaccatggcacaggatcacttgaggtcagaagtttgcaaccagcctgggcaacatagcaagcccccatctctaaaaactttagccaggtatggtgacctgtacctgtacttccagctgcttggggagcttagacaggagaaccacttgagccaaggaatttgagactgcagtgagctacgatcacaccactgcactgcaactgggtgacagagtgagaccctgactcaaaaaaaaagtggcaaaattgaatgaaaagggatcctaatctctctcacagccactcaagtgaagcttccagcaccacagtccacctgcagacagtcaggggaggggcagagggcagccttgcaggtgctgcgcctgcagatcgaaacctcagtggatagggagcatcatgcccagacctccacttatcctctctcagccaatgaagaacccaggcaggtgccccaggtgagatcccatggaaccagcagtctggagttcttgtggggacatatgtcttcatttctttcaagtatatacctaggaatggaattaatgggttatatggtaattctatgattaagcttttgaggaactgtcagacaagccatgtgattgattgattgatttttaaagacagggtcttattgtattgccccagctggtctccaactcctgagctcaagcaatcctcctacctcagcctctgaatggctggggctacaggcacgtgccactgcacccagctgccatgtgatttttttcttcccaattttctcactgaacattaatcatgtgtattttcatgaatggttaagtgttctttgagcatgtggcttttaacatttgcttttaacatttaacatatccaaattttagttggccaatcccctgttattggggacacttccaattttcattatgataaacagcatttccatgggcatctttttttttttttgagacagagttttgctcttgttgcccaggctagagtgcaatggtgagaactgcagcctccacctccaggattcaagtaattctcctgcctcagcctcctgagtagcggggattacaggtgtgcgccatcatgcctggctaattttgtatttttagtacagctggggtttcaccatgttcgtcaggctggtctcaaactcctgacctcaagggatccagccacctaggcctccaaaagggctgggattacaggtgtgagccactgcatccagccccatgagcatctttaggcatcaatcttttatgcatctctggttatttctctagagcacattagtcaaatgattgtatcaaagggcacaggcagttttgaggctctcagtgcatgatgataaattgccttccaaaaaggctgtgcccgtttgcattctcaaaagtagagtgtacacccctccttatattttaatagtttcctgaggtcaccagaacatgaacatggggagggcagggacttgcttgggcatcttggataccatgcccagttcaatgtgcagtacttagtaggggtttgtgtgacaggaatgagtgagagcacatgaaggcccagatgagtgcagggtccgtggggcacagaggagggtacaggtgtgtgagcaccgtgaaggccagctccataggacttagcacacggctgacgtggggactcagtgcagacacaagtggtaacaaagcagaatggtgcagactgtggcaagttgagaacttatgcctctgtaaagggggcagccaccactcagttactgcagattactctatctttgctgaggacagttgcacaggtagtgcactgcagaagggtaacaccttagagggatgtcatttgcatcatagatgcaaaattcacaggcaaagactgatgtagtttgtccctaaagttttgctttgatttgcagatatttatccatggcagtttcgtgaaaaacgtctatagaaggttttgaggaatgggcaccttttaatttgctactaaactaaaccccaagggcccattatatgccagcgtggtcctagagattccacactcattcagttccttttcatcataggaagtgggcattataatatcaggtccactataagagctggaggctgggcatggtggctcatgcctgtaatcccagcactttgggaggcctacctgggcagatcgcgggagcccaagagtttgagaccaggctggacaacacggtgaaactctgcctttacaacacatacaaaaagtttagccgggcttggtggcatggccctatagtcccagctattcgggaggctgaggtgggaggatcgcttgagcctcggaggtcaaggctgcagtgagcccagattgcacaactatactccagcttaggccacagagcaagaccttgtctcaaaaaataaaataaaataataaaaagaaagaaagagaaaggaacagatcaataggtacaataaagtaatatttgtataaaaaaagcaaaagaacatatttatttatttggatatttgtttatattcataaactatctctagaaagataccaagaaattgaatctatttggttgtatctgagaaactgcaggaatagggacagggttgagatgatgccttctgaattttgaaatatacaaatgtattttctacttagaaataaatgggccgggcgtggtggctaggccgggtgcggtggctctcgcctgtaatcctggcactttgggaggccgagactggcagatcacttgaggtcaggagtttgagaccagccttgccaacatggtgaaactccgtctctactaaaaatatgaaaatggccaggtgcggtggctcacccttgtaatcccagcactttgggaggctgaggcgggcggatcacctgaggtcaggagttcaagaacagcgtgaccaacatggagaaaccccatctctactaaaaatataaaattagcctggtgtagtggcgcatgcctgtcatcccagccactcaggaggctgaggcaggagaattgcttgaacccgggaggtggaggttgtgctgagctgagattgcgccattgtactccagcctgggcaacaacagcgaaactttgtctcacaaaaagaaacaacaacaacaaccacaaacacacacaaaaattagctgggtgtggtggtgggtgcctataatcccagctactcaggaggctgaggcacgagaattgcttgaacctgagaggcggaggtcgcagtgagccaagatcaggccactgcactccagcctgggcaatagagcaagactcaatctctaaataaatatataaaataaataaataatattaagacaaaactcataaggacattacataaaccaagttatgccagtgatttttttaaaatatcaaaacaggcagttttatagaaaaatataacttcaggccaggtggggtggctaatgcttgtaatcccagcactttgggaggccgaggttggcagatcacctgacctcaggagttcgagaccagcctggcaagcatagtaaaaccccaactctactaaaaatacaaaaattagctgggtgtggtagaacatgcttgtaaccccagctacttgggaggctgaggcgggagaatcacttgaacctgggaggcggaggttgcagtgagccgagatcgcgtgactgcaacagagaaattctgtctcaaaagaaaaatataacttcataaaaacaaagtagggagaagcagaaaagtttgtctagatctagaaccattaaaggaattgaatgtttattttaaaatctgtatcccggccgggtgcggtggctcacgcctgtaatcccagcactctgggaggccgaggtgggcggatcacaaggtcaggagatcgagaccatcctggctaacacggtgaaaccccatctctactaaaaatacaaaaaattagccggccctggtggcgggtgcctgtagtcccagctactccagaggctgaggcaggagaacggcgtgaacccgggaggcggaggtggcagtgagccgaggtggtgccactgcactccagcctgggcaacagagcaagactccgtctcaaaaaaaaaaaaaaatctgtatcccatcccctcaaaaatctcacaaaaaaacaaaaccaaagaaaagcaccaggcccagatgattttatggacagcaaacattaaaaagaacataaagtttttatcttctacataatttttaaaaattaattatttatttttgacaggaagtctcgctttgtagcccaggctggagtgcagtggcgcgatctcggcacaccgcaacctccgcctcccgggttcaagtgattctcctgcctcagccacaccagtagctgggactacagccgcgtgccaccatgtctggttaatttttgtattttagtagagacagggtttcactatgttggccaggctggtctccaactcctgatctcgtgatccgcccgccccaatctcccaaagtgctgggatgtgtgagccgccacgcctggccactactttttcttttctttgtgtgtttttttttttttttttttttttttggtgtgtgtgtgtgtgagatggagtttccctcttgttgcccaggctagagtgcaatggtgcgatctcagttcactgcaatccccgcctcagcaggagagcaggaatcttcagtgatccactggcggatctgcagccattgtgcgcgccaggtcttcccaagtcttttgtgcgcgcgcctctccttccagtacctatcaagccagcgtcccctagcctcccgccattgccagcaggtgctgagatcgcgccattgcactccagcctgggagacaacagcgaaactccgtctcaaaattaaaaaaaaaaggatgaaaattttggaaaaatatggaagaaaccaaatggatttctagctcaactaaatcgtaattattcagtgtctagtttttgcaagaaaccatatatttcatgtccacaatcggccacagtcccagctctcaagtgtaggtctttcctaagcaaattgaagaacacaggcataaaagtgcattaagtcaataaacatttttctctgtgtctctctctctctttttttttttttttttttgagacggaggttcgcactgtcacccaggctggagtgcagtggtgagatctcgggtgactgcaagctccgcctcccgagttcacgccattctcctgcctcagcctccagagtagctgggactacaggcgcccgccaccacgcccggctaattttttgtagttttagtagagacggggtttcgctatgttggccaggctggtctccaactcctgacctcgtgatccacccgcctccgcctcccaaagtgccacagccccggcctttttttttttaagacagagtctcggccgggcgcggtggctcacgcctttaatcccagcactttgggaggccgaggcgggcggatcacgaggtcaggaggtcgaggccatcctggctaacacggtgaaaccccgtctctactaaaaatacaaaaaagcagccgggtgtggtggcgggcgcctgtagtccgagctactcccgaggctgaggcaggagaatggcgtgaacccggtaggcggagcttgcggtgagcccagagatcaggccactggaatccagcctgggcgacagagggagactccgtctcaaaaaaaaaaaaagaaaaaaaaaaaagactctgactctgttgcccaggttggagtgcagtggcgcgatctcggcgcatcgcaatcccttcccagcccccgggttcaagtgattctccagtctcagccgccggagtagctgggactacaggcgcgtgccaccatgtctgactaaatttgtatttttactagaaagggggtttcactatgttggccaggctggtctccaactcctgatctcgtgatccgtccgccccgacctcccaaagtgctaggattataggcataagccgccacgcccggccttttgtttttctttttcttttttttatttgaagactgagttttgcacttgttgcccaggctggagtgcaatggtgcgatctcagctcactgcaatctccacctcagcaggagagcaggaatcttcagtgatccacgggcagatctgccgccattgtgggcacctgttcctcccgcgacctttgtgcccgcctctctccttccagtacctattgcatgaccccccacgtccgcctcccgccattgccagcaagtgcctcgcgcgggtacctggctgcgcttattaatccgttaagctcgctctgtcacgggcgccgtgatgtgctcacgcgcccgctccctcaggtttaaaaggcgcgttgcccggcaacagaagaaactgctggcttagccgttggccgagttggcggctggacgaggacgctcagagcccagctctcgagagttcaagcaaccgacggttccccactgctcccaggagcggttacctgggcactctgtgcccctccttcctgttcgggcccaggccgaggacctgccagtagggctcagttgcctggagcccgttcagcccatcccccagttcactttgcctgtgggatctccccgttgctcctgcccgtggactgagtggcaggccatcctacaagcacccggacacttgacatccgtggtgtcaagacaactctaagaaggttttccgtgatcctgcaagccctgccttcctttctgggatcctgccttcaatttgattgcacaggtaccacagcaagccagtgctgtgtgctccgagttccagggcgtcctccagctcagccactgcactgagaacatggactctctgtggggcccaggagctgggagtcacccctttggggtccacaacagccggctgtccccagacttgtgtccagggaagatagtgttgagggccctcaaggagagcggggcagggatgcctgagcaggacaaggaccctagagtccaagagaatcctggtgatcagagaagggtccccgaggtcaccggggatgcaccgtctgcatttcggcccctgcgggacaatggaggcctctctccctttgtgcccgggcccgggcctctgcagacagacctccatgcccagaggtcagaaatcagatatgaccagtcatcccagacctcctggacgagctcgtgcaccaaccgaaatgccatctccagctcctacagctccacgggaggcttgccggggctaaagcggaggagggggccagcctcatcccactgccagctgaccctcagttcctcaaagacagtgagtgaggacaggcctcaggctgtctcttcgggtcacacccagtgtgaaaaggtggcagagaaagcaccagggcagacactcgccctcaggaatgactcctccagatccgaggcctctaggcccagtacacgcaagtttcccctgctgccacacaggcgaggggagcctttgatgctgccacctcccgtagagctggggtaccgggtcactgctgaagacctggactgggagaaggaggcggcattccagtgcatcaagagtgcactgcaggttgaggacaaggccatctcagactgcagaccctcacggccttcccacactttgtcctcacttgcaacaggggcttctggtctgcctgccgtttctaaagcacccagtatggatgcacagcaggagagacacaagtcccaagactgcctgggcctagtggcccccctagcatctgctacagaggtcccctctacagctcccatgtctggggagaagcacagaccaccaggccccctgttctcctcctcagatccccttcctgccacctcttcccactcccaggactcagcccaggtcacctcgctgattcctgcccccttcccagctgcaagcatggatgcgggcatgagaagaacaaggcctggcacttctgctcctgcagctgccgcagcagcccctcccccctccacattgaaccgcacattggggtcactattggagtggatggaggcccttcacatttctgggcctcagccacagctgcagcaggtgcccagaggtcagaaccagagatcccagacctcccggaccagctcgtgccccaaacgaaatgccatctcgagctcctgcagctctacgggagacctcccgggacgaaagcggaagaggcgccagcctcatcccactgccagctgaccctcagttcctcaaacacagtgagtgaggacggacctgaggctgtctcttcgggtcacacccagtgtgaaaagacggcagatacagcaccagggcagacactcggccccaggggtggctcccccagatcccagtcctctaggccccgtagacacaagtttcccctgctgccacgcaggcgaggggagcctttgatgctgccacctcccttagagctggggtactgggtcactgctgaagacctggaccgggagaaggaggcggcattccagcgcatcaacagtgcactgcaggttgaggacaaggccatctcggactgcagaccctcacggccttcccacactttgtcctcacttgctacaggggcttctggtctgcctgccatttctaaagcacccagtatggatgcacagcaggagagacacaagtcctaagactgtctgggcctagtggatcccccagcatctgctgcacaggtctgtagtcccagctactcgggaggctgaggcaggagaacggcataaacccgggaggcagagcttgcagtgagctgagatcgcgcgactgcactccagcctgggtgacagagcgagactccgtctcaaaaaaagaaaaagaaaaagaaaaaaaaagttcttgtgacatttctgtatgaaatcagccttcactacatggataggaccagcacgcttccgcggcacgactctgcaatcttactacattttttttattttgtattttatttattccttttgagacagtcttactctgtcacccaggctgaagtgcagccgagatctcggctcactgcaacctccacctcctgggttcaagcaattctcctgtctcagcctcccaagtagctgagactacaggcacacgtcaaaaggcccggctaatttttgtatttttagtagagatggagtttagccatattggtcaggctggtctcgaactcctgacctcaggtgattgacctgtcttagcctcccgaagtgctaggattacaggtgtaagtttatttatttatttaagatggaatcttgctctgtatttattaatttatttatttgagatggagtcttgctccatcgcccaggctagggtgcagtggtgcaatctcggctcactgcaacctctgacttccagtttcaagcgattctcctgcctcagtgtcccaagtagctgggattacaggtgcctgccaccacagctggctaatttttgtatttttagtagagacagtgtttcaccgtcttggccaggctggtctcaggctcctgacctcatgaaccacctgcctcagcctcccaaagtgttgggattacaggcctaaggcaccatgttcggccatatttatttatttaattatttagagacaaagtcttgctctgtcacccaggctggagtgcagtggcgccatctcagctcactgcagcctctgcctccaaggtttaagcgattctcatgcctcagactcctgagtaactgggactacaggtactcaccaccacgcagggattttttttttctatttttttgtagagacacagtttcaccatattggccaggctggtctcgaactcctgaccttaggtgatctgacagcttcgtcctctcaaagtactgggattacaggcatgagccaccgagcccggcctctcactacatttaagtgatgccatggctcatgcctgtaatcctagcactttgggaggccaaggcaggtggatcacctgaggtcaggagtttgacacgagcctggccaacatggggaaaccccgtctctagtaaaaacacaaaaattagtcaggcatggtggtacaagcctgtaggcccagctacttggaaggctgaggcaggagaatcactttaaccgggaggcagaggttgcagtgagccaatatcatgccactgcactccagcttgggtgacagagtgagacaccatctcaaaaaaagaaaagaaaagaaaagaaaaacatatgatgccggggcatctcggcctcaatacctgcatgagcacagtcatgtccaggccagggctgctggtcgaggtccggccccatctcttccagcagaaagggagtaagcttgcagggaggctgggggacaagatcccaggatctcagcctctgctcatggatcagctctgagaccccgagtgagctgggggtgctctgtgcgcattggtttccccagctgtcaagtaaagggattggatgaggaagtcttgtcaaggtggaatgatctcagatttggggcagcagtgaaggatcccgctccctgggccatgccagtggcccggcctcggctgaacacagccccaacactctggaatggggatgagggggcagtcagctcttgctcctagtaagagagatgcaacagggctctgtggctgagctgggtgccttgcctcacacttgtaatcccaacctttgagaggccgaggcaggaggattgcttgaggccgggaattttgagaatagcctggacaacatagccagaccccatgtctacaaaataataagaaaacacacagctatagtccaagctacttggcaggctgaggcaggagggtcccttgagtccaggaattggaggctgcattgagctataatcgcaccactgcactccagcttgggtgacaaagtgagaccctgtctctaaaagaaaaaaaaaattggcctgtgagcatgggtttgatcttcaaacaggacctggagggtagggacagacagtgctgtcacccttaggtgctgaacactcagaaacgggccagcggcagcccttccctcacctgcagacaccagattgggcagaacagcacgtggcacttgcagctcttgcagtgagggcagaacccagtgtcaacccttctgcctgtgggaggggctgctgaggcctgcggagaggccagggtggaggctcgtccccttgtccagcccttggcgtggtctccaccaggtccccagcccaccagtgcagggcgcccctgagcctgctgctgccacgggccctgtctctacccaggacgtccccccaccctcgctgtgtcagggaaatgatcatggtggcggtgacactccgcaggcagggctgctgagagaagctgagaagggtcacactgcaggcagaggcccgtgtgacaagcccctctcaccccgagagagctgaccaggcagctcacgagcagagccacatcccgggagtccgagaaaggtcctggctgggctcagccacctcattggccacgggcagcctttgtcgtgtgagccttgctctcctggggaggctcaggctgacggctgatgtgggcattgccgagggtaacctgtggcccagtgtatatggccgggtctcctcaagctgcattcattcaagtaggacccagggtgcgtgcccatctccagcccagggcagctcccctgtaagctgggtgagctactgaagccaaggcaggaggcagctgacaacacccacggcccatgcagaggtggtggaaaggctggagtcagcagcaacaccaaatcccggaccaggcagaaaccacccaagactgaggggctcgtgccagagcggtggccacaggtaagaacccgggcccaggctgtgtggcaggaatcctccatgtcccagggcttagcatagcaaaggaagaccagccgggtcaccctggtggccatctgtccctgtcccacctgcagagtcagaacagcctctccccagtggggatcatctctctctgccaaagcaacagcggtccctgccccaaccagactaccccactcagtggagttacggatgctgctccagcatcctaacactgcccagctggtgcctgcctgtgctcacccgcaccccccaggccggccttccctgcagcctgggcttggccaccttggcctgattgagcactgaggcctcctgggcacccagccccatcactgcacctgctgcttccagccccaccccacaagctcaggggttcttcccagcggcgctgatcatgaagtcaacatgcacgcaagtcgtctcaggaaactttttaatgaaagtgttggccacggtggtgtgtaggtggctgagctcagattgcagctgctgagacaccagccacttaccaagagaaagccaggctgcttcaaacccagggcccgcggcaaaaaagcatcacttccggccggggagtctggaagccacgccttgtgggaggtcacactggcatctaggccttcgcctgcactgcagaaggagagccgggtccccctcctggagaacgctgcgttccccagccccacaccggctttgccaccacacaggctgttgaggcaggaggcgggtaagacgtagctgtagacccaaagcaaccaccagccctgggaccctgcgggagagaagcacttttagaacatggaaaagtgtggtcatcccatcattagacagcacacatcctacataaataaaaagtcgtatggggaaggaggttggggagggaataaaaaactggcacagacattgatagactggtttccagtttcaaggtaacagatgcacatcatgagaccagaggaggcagagacaagggctggatttggcttttctaagcaacatgtgttcctgcgcagggctgaatggtcactgagacagagatggaagccaggacaggggagcccactgggcccagataggtacagagagcagaggctcctgttctgtcctcaccacccatgagggtgacactgcttgtaaatggtggctgtgctctcccagcaagaaaaaagcacaactaaatccacactgcacaaagacgcagacagaaagccttcaagtggctctgttttctgctccctgcctcatcaggtccacaagcagagaggagtgtcaggtacatatccctgctgtcaggctccccagtaagctgcgggctcagcaggagctgcccactgacacacaggggacacccactcctgccaccttgggagcggttgccagacagagccgtactgggtgctggtgtcatccagggaccccacacacttccttaaatgtgatcctgcttccctctgcgcagctgcatcctctcctcctgcaggaccgtctggaaacttggctctcagtttgctctcccttctctcctctgcctgccccaagcccctctttctaaaaaagtgatgccacgttcatgggattatttcttgaaaatacttggcggcctccatgcttctgttttctttgagtcaggtagtcaggagggtttacaaacaatgcctgggctcccccgcaggtgccggcagatggggtagcgaatggtcctgtgcctccacctgctccgggagggagtctcccgtctctaggcctggccccttcctaaccctccacgtatcctgttctccagagacttcagaacccactcctgagaacagcggagccaggcgcttagaggaagaccaaatgctgccaggacacggattgtccagggattacattccagcatcttattaggtatctggatctgttggggaaaaaattagaaactatgtataaaacttacaaatattcaagtatcaaaaggttatttaggatgaaagttttaaaacaagtcatcagcaagctgctaccaccaagtggagacttatacaaaagttgagcgagtccactgagctgagaggacagaaatgaagtcacctgtgctggggcaggggcagggacactgggggcagggagtgtgtgggcagagaagccagagaagtccaggcctgtggaagccaaacaggagagcgtgggccggaagggcggtcaggatcgggggacgaggtcgctctccctggagaacgaaccctaaggtgcgtagcctgggattccctccctggaggtcctgtcccccgacatttcacaggccttctgagctgctttccaaggaggactaacacggcaacaaaagaaccatttctgcacaaaaatcctggaaagaaaaagaagcaagccgagaatggagtcaaaacgctacccagtgctgactaagcctctcaaaccctgttctaagtggactgtggtttctaagtcagggaaatggaagaggccccacccacacagggacagggccacggcccccacaggatgaagcagcagcgtttattcaagatacaacagtgagggaatccggtcacgttcccttctccccagagagggcgcatcttgacaagtgatcgagtagaaatcttttaaactctaagttaagttcataaaaaccactggtttcactctgtctcccagggccaggcctggcctctgagatgcactggcttggggcgccctcaggtggctgcatggaaaacccacagtctgaggccagcctggggctttcagacctgggcgggatctgcccaggccacctgtccttctgctttgggccgctgtctcttggcagatggcctgacacctgggggtggcccaaggatgcctcagaaaatcttgattcccactctacagatagcctgattagccagaggtttccaggccatctgtccgcctccaggagatggactgggacctttagacatcggtggagaacaggatgctctgtcccttgctgtccggggcagggacggcctccagccgcaagaagtacagcagcacctcgacctgccctcgcggagtggggaagaggagagtggctcagaggggggctcacagctgctggtggggaggtctttggggcccaagtccccaagtccacctcaggtgctagaaacccctgctggtgtcatgaaccccttacagtgagacgggggtggggtggggtcctgacaaggcatgacttgttgggtggggggtggttatttattttagagatgcacagggccttgctctgtcccccaggctggagtacagtggctccatcatggatcactgcagcctctaactcctgggctcaagcaatcctcctgtgtcagcctcccagatacctaggattacagatgtgtgccacaatgcctgcctaatttttctttgtattttttctagagatggggtttgctacatttcccagactggtctcaaacacctgggttcagttgtcctgcctcggcctcccaaagtgctgggattacaggcatgagccaccacacctgaacacttggggtggttttaagcccccagcaaggtgcaccagcaggagcaggaggtggcctaggctccccctatcactcccatccatgcaaacctaggcaagtccctgtctctgaatctcagccaccaccacatacaatgcaagttggaagatgggcaggactgggggtggggcaggcagaggccacctctgtcaggctggggttgcatgggctggagcctgtcttcccacacctgggacatgacctccaaggaccagctgtcagtcatggtgatgggctggccggggttggcagggagcttgctctccttctcggagggccggagcagcatggggccaaagacagtggcaaggttgtgcagggacatcttattgactgcctccttctctgccaccctgtagaggaccaaagcagaaggtgctgtttcaacgccaccaccaggagagaggcagaggggctgtgccgtgctagagtcctcagggagagagtgacctcgaccctggctatgagccaatgcgcccggcctctcactcttctttattcagcataatttattctgacgtatcttcagtgtaggtattctctttttattctcctattcctgttaaacccattgggctgaatgctgtttatttctagaatgtctacacctgtttttctgcaaggtcatttttttttctcgtttgctgttcgtcacatatactttcaagctcatcggttccctccgtgagtacaggtaagtggaggagcctcatggtctgcctcaggtctttgagatgttgagtctctggatctggtcctgctgctggccttttctgtccttgctcatggggcattgtttccgtgaatgtgtggttacttttgactgcattactcattgtcctggaaaaatgactttgtgggaatttttcagacctagggtaaagatgcttcctccaaactaggtttacgcttccttctgccaggtacctcagggcgctgtcagcctaaagccaatttaaactaaatccatcaactgtgaggttttggaatcttctcactggtgtgaatttgggccataagtcccaaattctgtggggtgctctgtggggtggggaccagccttagagttctcatcggaagcccggggtggctggatgggggcagatgttttcagggcaagagcggcttggctcgcctctctggtttctggtttccccagatggtgcctggcggctcctcactgtcttgtcagcccctggatgcctttaagaaaacatccttttattttgtcagcatttttggtacttctcagtgtgagggctggtccaagtatttggcttatcatagttttacaaaaagttggtttctatgaaatcttaagtcacctcttttttaaaaatgtaccttttagtccgggcacggtggctcactcctgtaatcccagcactttgggaagccggggcaggcagatcacttgaggccaggaatttgagaccagcctggacaacatggtgaaaccctgtctctactaaaactacaaaaatcagtcgggtgtagggccaggcgcaggggctcacgcctgtaatcccagcactttgggaggccaaagcaggtggatcacctcaggttgggagttcaagaccagcctgaccaacatggagaaaccccgtctctactaaaagtacaaaattagctgggcgtggtggcgcatgcttgtaatcccagctgctcatgaggctgagacaggagaatcacttgaacccgggaggtggaggttgtggtgagccaagatcatgcgattccccctgcctcagcctcccaagtaggtgggactacaggcaagcaccaccatacccggctaacttttttttggtatttttagtagagacaggattttaccatcttggccaagctggtcttgaactcctcacctcgtgatccacccacctcggcctcccaaagtgctggattacaggcgtgagctaccgcgcccagactaaaagcgcgcccggccgtctactacttcttatagggtgagaggcgggaggatcgcttgagccctgaagtttgcggctgctgcagttggctttgatcgtaccactgcactccagccagggtgacagcaggaccctgactctaaaaaaagaaaaagaaaaaaaagcatatactattaatacttcctccttactataatatttaccgtggcctttatcagactagagagtgcttttatctctcccttttgtaagaaagagcttttagaattatcaatagatggtcaggtgaggtggctcaggcctgtaattccagcactttgggaggccgaggtgggtggatcacgaggtcaggagttcaaaaccagcttggccaagatggtgaaaccctgtctctactaaaaatacaaaaaaattagctgggtgtggtggcgagtgcctgtaatgccagctactccggaggctggggcagagaattgcttgaacccagtaggcggaggttgcagtgagccaagattgtgccactgcactccagcctgggcaacagagtgagactctgtctcagaaaaaaaaaaaaaattattaatagatggtgaccctcatcttcacgttttctgcatctattgaagtgcgccactgagatcgtggagttcttccctgtttgtccatatgatgaacaacactgattttctgatgttgaacaatccctggaataaactctgtttggtttccatggatttctgtttccctttagattttgttagtaatttattttggatttttgcatccaagttcataattgtaactggacaaataaaggcagattttaaaaggacaagttgggaggctaaggcggaaggatcacttgagcctgggagattgaagctgcagctagcttcgattgttccactgtactccagcctggtgacagcaggacctgcctctaaaataataatacttaaaaggacgagtttacctacagtctcaccaagcaatgaaagagcttatcttcttcctgtttcctttacggatcttgctcatgtattttatcttagttactttagcataaatgctaaatcaaattctttttcactagacatcataatagctctaggcataccacataatacccaagcacattttaatcattaaaattgtttcctttttttgtggctactgtaaccacttcagcgaaccatttagtgtgtagtgggtttaaattttttctccttcctgggataaatttcccaggagagggataattgggtcaaaagttacgaacatatttatgggttcttttccacaagagatcgatcagtttgcaagtgccatctgcactgtgggggaaccaatcttcaacttgcctgcatttggtattagtatttcattaacctttcattgatctaattacggctctttgacacaattttcatcagtgatggactaagtgtgatccggcctgacccgcctccggccggcgtgagaaggggcatgtgtcgggctaccctcgggcttcccctgccgcccattgtgatccagcccgctaggcgctccctgccgcccattgtgacgcctgccagccgcaggctgggtccccgaggcgggcggcatttaggctcggtctccacagccatggccgcgacgcaggagctgctgctgcagttgcagaaggataaccgagatggtcgccagcggaagcaggagctagagaagctgatgcgcgggctcgaggccgagagcgagagcctgcctcaaccagcgcctgcaggacctgagcgagcgggagcggaggtgcgcggggaacgcccctctacctggcgggcgcgcgagggtcggtcccgcaggcagcgccgcgaggtgcttcgcagagtaccaggctgatccgcccgggcccgcatctctgctctaggcccttgggaacgggtgatccacccagcggacccaggtgggggactcggccaggacttcccagtcctcaatcatgagcctgcggctggtccttcctggcgactgcgggatcctgagcgacccagtccgccttgtagcgccaacctcagtttccctctgcaggctgctgcggaggcgaagccaggaagcgctgcttctgcaaggggaggtgcgcgaggcggcgcgggagcgcgcgcagcgggtgcgcagaagactggaggaggcggagcgccacaaggaggacttggtgaggaagagtcctggaatggggctggacccagggtggggtggggcagggcgggcggaagggggcaggatccgggggtggggtgaggtaggaccggcggtgaggccggcaccgccccaggaccctgtccgcaggagcagcacagcaggcagctgcagggcagtgggaggagctgtcgagtcaggtacgtgcaggagatgggagggcctgtctcttggttcctctcggaagtcctgcccttgccctcgctctcattgcctccccgtccctgtctcccctgacactcgttcctccagaagcccggtaaaccccgtccttacgagccccgcccctagctcttctactacggaggggaactgcagagccagaagagcacggagcagcaactcgcagcccaattggtgacgctgcaggtgcttgagcgggaccctgaggtctttagtaggggcggagcagcagcgtgagcggggccgtgaccacctgggggtgtggcttaaggcaggccctgaaggcgtgggcggggcggggatgtgggcggggcataatcgcctgggggcggggccctgagggctagatacgggcggagcgcggagggggcggggccatgaccagctggggcgttgcttacgactggtcctgaggacgtgggcggggtcatgatcgcctgggggcgggcactgagggccgggggcggggcccggaggcgcagcgggttgccggcctgcggacctcctgacattccctgggtccttctcaagaatgaactggagctggcggagaccaaatgcgccttgcaggaggagaagctgcagcaggtgagggcagaagcgggttctgttggaggagggtaggctttcgagtgtggatggggaagggcctgtcgccccgcccccgccgagtctaacccgggtgtccacacccaggacgcgctgcagacagcggaggcctgggccatattccaggagcagaccgtagtcctgcaggtgcggccccactcagacgccaaggtgcctcccgcctctcctcccccagacctggggcggtaagtctcccaacccaccgccaggacgcctccccgaggcctcagtccgcactctcacccgctccaggaggtgcaggtgaaggtgatggaggctgcggaggagctggacgcctggcagagtggccgggaactgtaagggagttgggcttgcgggcgcggcggggcactgtggggccgggccgggctgggctcccacctgcatgcctgtccccgcaggtgtgacgggcagcttcgcagagtgcagtacagcaccgagtcgctcatggaggagatggccagggcggaccgagtgagcgcctgcgcgggtccgggcggggtgggctggagcgggacacccctccccatcccccccgcggtaccgcctccccctcctcctggaaaccgggccggcgccgcgggcgcggaggtagctggatgcggccctctctccccgcaggagacgcggctgttcggcggtcctcgcgcgctggccatcaggtgagcagggcggtgggcgcggccgcggtcccccacgtgcccgcccgagccgccgcccacctgcccgcctttcgccctgcaggcgctgctgacgctgccgctcctcttcctggggctgtcgctgctctggacggtgctgttggaccccggcgccgtctccgcgtggctctggagcctcacctcggagacgacgctgcgccgcctgcgctacacgctgtccccgctgctggagctgcgcgctaacgggctgctgccaacctaagtgcagcgccccgcgcctggctccaggtggactccagggcaccggctttatttctggtgcactcctctcctgagagtgtagaccaaggtcgcctaataaactcctcaagggatgaagctcgtgggttcgtcgtctgtctcccatgtcatgtaggagcttgactggcttttcagcctccaaagattccttcctttcttacagctcatggatttagatccactccccagtattgtaaacagcatttttagtttttcaggatacataatttgccatattgccagaaacttgtacatagcatttgacacttttttctttgccaatttgacaagctgcttttttcaagtattgtgatttgaaattatttctactatatttgaatttatttctaccatttgtaacatgttgatcctgatttttcaatgctcccctttccttctgtttgattatttgggaagtcacactctgtattctggtattcttactacttgagctcagctcattgctgtcatcttcccctaaaccgccttaaagcatcttaggtcttttccctctgatcacatgtgctactttttttttttttcttttcttttgagatggagtcttgctctgcgcccaggctggagtgcagtggcatgatctcggctcactgcaagctctgcctcccgggttccagcgattctcctgcctcagcctcccaagtagctgggacttcaggcgcctgccatcatgcccgtttaattttttgtatttttagtagagacagagtttcactgtgttagccaggatggtctcgatctcctgacctcgtgatccgcccaccttggcctccccaaagtgctgggattacaggcatgagccaccgtgcctggccaacattttctccagatatcttaccgagtcctaatttccactgcggacagagaatacactctgcgtgattttaattctatctcatttactgagacttgttttgtggcccagcacaaagcttgtaatgaacattgagaagaaagtgtattgttgctgttgacagagtgattttttttttgagacggagtctcgctctgtcgccaggctggagtatagtggtgtgcaatctcggctcactccaacctccacctcctgggttcaagtgattgtcctgcctcagcctcccgagtagctgggactacagatgcatgccaccatgcccagctaatttttgtatttttagcagagacagggtttcactgtgttggccaggatggtcttgatctcttgacattgtgatccgcctggcttggcctcccaaagtgctgggattacaggtatgagccaccgtgtcaggccgacagagtgtgttctaaatacccagcaggtcaaggtgagtgacaggcttgttcagggctcctgtgtttactttcttgttggtagcgccgtcaattgcttattgtgaaatgccccttcataaacacccatacacattttgattatggatggcccgtcttttttccatctgttattttcatcttagatctgtcttcatatgtaaagtgctttggttataatcagcacataactgggtctcacttcttcaattcatgtttataatccctgacttttaaattgggctggtaagtctattatgtttctccttttctgccttcttttggattagtatcttttaaaactccttttaacttatacgctgactcatattttttattaagacagtctcactctgtcattcagtgtggagtgcaatggtgtgatcttggctcactgcaacctccacctcccgggctcaagcgatccacctcagcttcctgagtagctgggactacgggcttgtgccaccatgcccggataattgttgtattttttgtagagatggggtcttgccatgttgctcaggctgttttcaaactgctggactccagcaatccacccacctcagcctccgaaagtgctgggattacacatgtgagccactgtgcccagcctatatttttatttgtactgctcaggactcaactgtgcttcctaaagctgaatatttgtctttttcaactctggaaatcccattagaaattgattggggccgggcacggtggctccaatctcagcactttgggaggccgaggcgagcagatcacctgaagccaggagttcaagatcagcctggccaacatgacgaaaccccttctcttctaaaagtacaaaaattaattagctgggtgtggtggcgtgcagctgaaatcccagctacttaggaggctgaggtaggagaattgcttgaacctgggagagaggttgcagtgagcagagatcacgccactgcactccagcctgggcgacagagtgagactccgtctaaaaaaaaaagaaaaagttgactggagcttttcattcaactttttttttttttttttttgaccctgttacccaggctggactgcagcggtaccatcatagctcactggagtcttgctcttcggctccagtgatcctatctttcttaccctcctgagtagctgggactacaggcatgcaccaccatgtggctaattttaaatttttttgtagagacagggtcttcccgtgttgcttatgctggtgttgaactcctggactcaagcaatcctcctgctttggcctgctgaagtgctgggattaggagccaccccgcttggctttcctttccttcacactgcatgtttggtcatttcactattctgatcactgattttctcttcttacctgctgctgtttagctgatcttttggagtttctcttttgtttcaggtctttattcctatctgcttcagatgcagggcctcggtgggtgggagtagatgcttgctgggtctagtcacacaaagattttggagttccagagcacagcacttcaaaatgagcaagagggaaagactagagcagtgggaagatgctgcggagagccacagacaggcccccacggcagccctgagggagacagttttggagcgggcagacagcagtcaggacaaacacaatgtgtgttttggtgcacctatgccgtggtgagattgtgggaatctcatgtttgttaagccacaacccgtgctcctgggccccagcctatgagtgcagccaacactgggcccccctctctaggggcaaatccaggaactgccctttggctgaaggtggacttaggacttgacacaaaacctcacagattccaacacagcactattttgggtttttattttgttgatgttggttaaatcttatctctttttttatacacaatacttcatgtacctatgaaataagacaggtagggaatatgtccagtgcaaacagaggactcacacctgtgcatagacagcaccatccattgattgtcgctgcagtccatggcgttaccaaggctgcgccacccacgtgctgccccaggaggcgctaccaggttctttgggccacaggcctctcctccactgcatgtggcggcagggcagggaggtcgcagggctccatgattgtgggacagctttgagggcacatggggcagaggccctcgaaggtcccctcctcagtaggggatgtcattctgatagtactggatcatgtcgtaggtccggctcctgaaaggccaaggaagagtgaagggagattcgaggagccagcagggtctggggtccctccccacagggagccctacctgtccaatcagccccttatggctgcccagcacctgaaggtacaaatgtcccaggcgtgccctcccccacccagtgaccacatctcctgctccaacccgggggactccgaggccacctcatgctcctcagccaaaccgcttccatccgtgggagccactgctctgccccatgggactcgggccccttggctcgtcctggccagatgcctccaaggggtctgtacgctctcctcgcacctctggagagccccttctcgccctgccccagcccctcttgaggtcctggccgcctggcttctctgcttcctatcagcaagagctccttccgtgcccagcctccacagtgcccttgttagggtgccggacccgggcgccacctgggggcaggtctcagcttcctctcacgctcctccggcagttccccatgcagatggccacacctgggcccctcctcctagtctgtgaatgtggtctgtcccatggcacagccttgggctcccacatgcccctcagggccttaccaaccccacatgtttaagtgctgcccccttcggggatggctcacttgctgggatcgccatcctccctttgttcaggccggacccctcaaagccacctctgactcccacagcagggagcctgtcagcccggtgctctgccttcagaccctgagccagccctccccagggccccctgcacccatctcctcccaccacagtagtgaccagcagcccggcctgcacctccagtcactgcccacgaagcagcccgaggcaggcgcagggaaggagtgggctctgactcctcagccctcctgggaggagggaggcctgacaccacactcagttctaatactcctggccttgtgtccctattgctccttcggcctcacgagccctgcccaggtgggcccggcctctgccaagtgttcccctcggcacaccacagccccctaaaccagcaccccactgctcctcaagagctcctgtcaagacttgggtcttcatgagaggggcggcttggggacagcagaatcctcatcgcctggtgcaggcaaggccctgcaggtgcccagtggccaccgaggcagtgggagaaggcaggggggcggggcactcacctgttgctgaggaagcagctctggatgaccttcatgatgaaatttgcagcctcgcgctcagtcatgttggggctaaacctgtgcctgggggagaggctgtgtcagggctgccatgggcagggccgtgctggctccctggcccagtgggaggagggtcttccatggggacggacttcagctgagagccacgccctggaaatgtacctttggggtccacatgttggaagatggggtgctgtgaaggccacgcctggcctatcatgggccctgtccccttcccagcatcacctgagtggccccatggcattaggggactaagcattggggagctaagctactgcagccccagaccttagggtggaggtgggttgggcgtagcatccttgacataaagaggcccctgggtgggtctctggtgtggccggcacaagcaggggcccctcacagttgtggtctaggggcagagcctcacccaagaaccctgtctgctctgaggttccaaggagatgacaaccacagtgacaattacatgaaaggtacctatcttggatggagcctcagctaatggacaactgtcccccagatggcctgcgtgtccaccaaggaacctacttcaagagcttgattgtctggccgcgaaaacagggcaggcccgtgtccaacatgagagtgaccagggagacgaccgcgtccatgtagggcctggggagagataggagggagcggtgggctgaggccagcctaggtggtggccctgcctgtagtcctgtggactggctgatgccaacagcctcaggtgtgggctcctgccacccacctcgcctgccacatcttgcacatccccgaggcaactttcgatctgctgcacttggtaacccataccgcccaggcaagggctgcccacacgcactctggacaggctgagtgtcctgccctgtcccccacataaggctgccggccatggcttctgcacttgggtgggatgcagacacgctgacctgcctttctctgcagggcagtggggatgaacccaggttggactgtggccttggccaagtgacctgtatatgaaactgggacaaagcccatctttggcacgtagcctgtggggtggcaggtgctcaggctttggtgacagggtggatgggatgcccagaaagggagagcccatggctgaaggcgtgggcaggatcgtggggaaggtggttggaattagatgtccagagcaagaatttactggcacaggtgggcagacagaggtgaccaaaggacaggtgtaggtcagcaggtggctgctagcacctacctcactctctggaaccggattcccttcatcctaaaggggatctcagaacgttccacacaccccctccgcctccaccctggccctcacccaggctcaccgcacagccaggtagcctcggacacacatctccatgaaccacttgaagggtgtggcctccatcttgccccccatgatcatcaccatctcatccgtcagcttgatgtcgggttcccagccgagattgccgcccggcgagctttcaaacatgaagccaaagtctgcaaaaccccaaagagctgcctgtgactgggtaggagccagggcgggcaaggacaagtggtctgttttgaggagtggaaaaggactgcaacaggagcaccccctccacccccaacaggcaggttgtgttttcttggagacagtgatggggtgggtggtggggcagcaggcagagaaagagaagggaggaagtggaggaaggagccaagctggggcactgaacctggaccagccccactccgcccagctccagcttctgactcagagcaatggcggctctcgccctagctccctggggccggggccaggcaccctctacagcagaacagcttggtggccgacagttcggacctcagagctggaccctgacactcctggcagggtggtcctgggcattctcctctctgtggggtggggatccctatccacccctgggtgccaggggtgaagggagaggagggtggcgctgtggctggctgaccgatgtggatgatatgacccttcttgtccagcataatgttgccgttgtgtctgtccttgatctgcagcaggaacagcaggaggctgtaggcggccatgcttcggatgaagttgtagcgggcctgtgcagagagcgccctgggctcaaaaaggccctggggcctgtgggcattctccctggtcccacacccaggatccctgggcctgtgggcactctccctggctctgtacccccactgtggaagcagagcccgaatcagcaagccagtcttcggtagcaggagtgacaggggctctctgtggaagtgggcgtgcaggcacttcctcccacactcagaacttaactttcttctaaggagtccaacccagccctacattcttttgactcccaaagtggcttacagatgccctggtgttttttttttaaatggagtctcgctctgtcgccaggctggagtgcagtggcatgatcttggctcactgcaacctctgcctcctgggttcaagagattctcctgcctcagcctcccgagtagctgggactacaggtgcccaccaccatgcccagttaatttttttacttttagtagagatggggtttcaccatgttggtcaggatggtctcgatctcttgacctcatgatctgcccatcttggcctcccaaagtgctggcattacaggcgtgagcactgcgcccggccaggtgccctggtttttttgtgtttttttttttttgagatggagtctcactctgttgcccaggctggagtgcagtggcgcaatcttggctcacagcaacctctgcctcctgggttcaagcgattctcctgcctcagcctcctgagtagctgggactgcaggcgcgtgccactatgcccagctaatttttgtatttttagtagagacagggttcaccattttggccaggatggttttgatctcttgacctcgtgatctgcccgcctcggcctcccaaagtgctaggattacaggtgtgagccaccgtgcccggcccaggtgccctggttttaacccttaacaaaggatgactgaggagagcagggtgtgggtggaggctgggtatgggtggctggggtggggtggagcacacacgacctcccccggcctgtggccaccctggctacctgctggaaggccagagtggactcatccccgtactggcgtgtgaagtagtcgtacatgccgaagtctgtctggcggcccagctggtcccgggaggtgcagtcggggatgcactcgatcaccccgcactaggaggaaaggccagttctgaggcccgctgggtgcgaggtgcccagggctgccctactggctccactcagggaacttaccccaggggcagtggccaccacgcggtagggaaaaacaaagaggtccaggccgaccagctggaagatgttcttgaagaggtcgatgatctgcagggccagcatgtcctgggaagccgggaggcgcaggatgcggtcagttggcgtccttgcaccccagcagctcttctggctcatgcagggcaaaagccaagcacccagagatggagtgaggtggggagaccacagccgagcaagagtctggaaggccttcctttctgaccaccgggggctggactcaggctgctgggaccaccaggccctgggctgagcatgaggctgagctgtctggtggggtgtgtgagataaggcacccaacccctggacagttccctcaggtgggcactggcatggcggggacagtgggaaaggggctggaaggagaggcctctgggttttgcagaagccctaatttaccccgtggcacctgaaccatataagagaaggaaaagattcacatttctgcatatgagattggactctggcgggcctggagccttggggagcagcaagcccagtccccaagcctactcgaggcctgaccctgcttacctgccggcagtcgtctcccaccttgaagatggctgcctgccaggagatcttctggccgtcggcctcctgcgtgctgcactcatcctcggagtctgagcggcaccgcagacctgcccgcagggagagaggccgctgttagcctgtaggcagtgagaagccctctgagggggccagggatgagtcctctcacatgcctgaaaggaaccccagcaatcttggggatcacttcttcaaaaccccaaggaggccaaggaggagcccagcagggcccaaggaaagccttggaacagcaggtggaatccagggttggagtctaagaacatttaggcttaaatggaactaaaaacagagccccatttcatctgcagtgaagacccaggtgtgcctgggtcagtgttgggtgctgtgagctagggggcaggaggaatgtgtctgtacactggggtcctgggagggctcggggccagcgtgcagacatggccatgggaggcaggtccctgcaaggggtggcagccccctctccacagctggccacaccgtctgtactgggttgaagagtgtctccctaaaattcatgttcaccccaaaccttaaaatgtgtccttatttggaaacagggtctttgcagatgtaattaggttaagacaaggtcacagtggattaggacagtccctaatccaatgactgatgtccttcaagggagatcatcatgtgaagagggaggcggagatgggagtggagcatctgcaggccaaggagtgccaggactgctggcaacaccaccagaagctgaggaggcaaggtgtgacctgcccagagccttcagagggggcacggccctgatgatggactccagcctccagaactgagatcgtccgtacggtagccctgggaaactaacaccccccaacagccccgggcccctcagcctcaggaaggagcctgctggagcatgccagctgactcacggcagacagacctctggggtggcacatctgtcagtgcatttgagctccctgccatcccccaatgagggatctgactgagtgagggcagacagatggacagacatcatcttttatggagagctatactaaatttaacacatgccagaagaaactggcattagcaaggaaaagcactgagctcccaaacaaaatcagggttctttactgaccttctttttcaagttcactaactccacatcgcttcaccttgaacttggccagatatggggcttttgcagcactgaaaacaacaaaaagaatgtggcacccatgatgcagccgagaaaaacttcgcacgcggacgcgtggaagtgggggatgggtagggtgaggcgcccacctctgcatcggggtcccagacttgtagtcgatgtccagcacaatggcctcagggttgctgggcaggtagcagcctgtgcagggacagaggcagtcacagggagtgcatgtgtcaccacaggtgagccagagtcagtttccaacacggatgttacatgcgtgtccaccctgcaggcacaccccgcccctgtggaggggcctctggtccttgtccagggcaccactaacttattattccatggccgctaagggtccgtcctccttgactcttcgactcttccagccatcaaccaaataagtctgcaccttctgggaaatgctcttcctggaggagcactgagccccatcctcacggatacagccctactgcttctgggggtgcgtgtgaggcctgtcctgcctccacctgcctgagcaaccctctgaacagccctccattcttggagtccttttttttttttttggatagagtctcactctgtcacccaggctggagtgcagtggtgcgatcttggctcactgcaacctccgcctcccaggttcaagcaattcttctgcctcagcctcctgagtagctgggattataggcgcctgtcaccatgcctggctaatttttgtatttttagtagagatggggtttcaccatgttggccaggctggtctcaaactcctgacctcaagtgatccacctgtcttggcctcccaagtgctgggattacaggtgtgagccactgcgcctggccttccttacccatttgaatactactctctcaaaaggcttacttaaatgtcactatgtccatgaactgtccttggttctcccagcctttaggacttttgtctaagacgtttctttttttctttttgagacggagtcctactctgtcgcccaggctggagtgcagtggctcggtctcagctcactgcaacctacgcctcccgggttcaagcgattctcctgcctcagcctcccgagtagctggaattacaggcgcctgccaccgcgcctggctaatttgtgtacttttagttgagacggggtttcaccaagttggccaggctggtctggaactccttacctgaggtgatccacccgccttggcctcccaaagtgctgggattaaggcatgagccaccgcgcccggccaacattgtttctttatgtttattttatatctctgtgagttcaagcttcttcagctcagggaccatgtcttactcatctttttaacagctacaatacctaatgtcatgccttttcttttcttgtttttgcttttttgagatagagtctcactctgtcacccaggctggagtgcagtggtgcaatctcggctcactgcaacctccacctcctgggttcaagtgattcttgttctcagcctcccaagtagctgggattacaggcacgcgccaccatgcctggttagttttttttttttgagaccaagtcttgcactgtcatccaggctggagcgcagtggcgcaatcttggcttactgcaagctctgcctcccgggttcacgccattctcctgcctcagcctcccgagtagctgggactacaggcgcccgccaccacacccggctgattttttgtatttttggtagagacggggtttcaccgtgttagccaggatggtcttgatctcctgacctcaggtgatccacctgccttggcctcccaaagtgctgggattacaggcatgagccaccgcacccggcccaggctcccctttctcagtgagtgctcagtaaatgtgtgaaataagaggacaagggaaagcctgtttctggccaaggaactgccagtccccaagggggatgtgtgctccttgagccctgagaggtgggctttgaggggagccaagcttggccttgctgtggggtacagggagaggggggcatgccatctcctcctcttcctcacctgcccttcttcctgctccaggctgtggctcacactcaggcccctctgtgctctcctgctagagccctgctggcttccctgacctctggggcaagactcagccaacacaatctagagccaggggctggggacttctgtgcatgccccctgcagtacaatgcttccagctctttttgcccctccccagcagttgtggccttcccgatgcgggaacagaggccctgcatacatgtcctgccctctctgggaagccgtgctgttgtgtgagctcaacacaatgtgttgggaagaaatggttaaaccggggtcctgcagggcactccacagctgagaccagccgctgtgaacatctgcacaggacagagtttggaagacaagtttgtgccaatagttagaaatgcagagagaggccgggcacagtggctcatgcctgtaatcctagcactttgggaggccgaggcgggcagatcacaaggtcaggagattgaggccatcctggctaacacggtgaaactctgactccactaaaaatacaaaaaaattagccgggtgtggtggcgggtgcctgcagtcccagctactcgggaggctgaggcgacacagcgaaactccatctcaaaaaaacaacaacaaaaaaagaaatggagagagagctgcccagtgaagtctggatttccatcttctcttgaaaagctcagcttgaattcccatgtggccacagccacaggcacccaggagcgacttcccatggaggcggtgggggggtggtgctgatgggtcccagcacacctgagccgtcccacactgggcccgccatcccctcgtctgtgtgacctgctcctgtaatgctggagcctaggaaccctcttctagagtaacagctactgaggtcactgtcagcctccagaaaaacagcaggcagcaaggaagatgaagggcacccactgacgagcagctcccgctcactagcggcagattctggggaggggctggggtcctggggcaccaggcaccgtgggcccaagcaggtgtggggctggccaagccactgtgtccacatcctgcagtgcctggagagggcagcagccttcacgccccgccgcccgcctgcaggaagaggttggtctgagcctccagaagccacctgctcacccggctgcaccttcacttcagacagggccgacagacaagccttctttctctcgtcgcctttagggtagggcctgagaaacaggaaagaaattcttgctttgtctcctggaggaactggctgctgggggacagcccagggcccctcctgcctggattgccctctctgtccctctcttcccggctctagctgctcctagcgcagccaggcaccactggcagcgattcttgccctgcattcctcatggagaatccccgacagccccggaagggctgttttctggcaggctctgcccctgctgtgtgcgggggtgtgtggctgggggtggtgggggtaataatgcctgccacctgctgccacccaggaaacgctagctcccgtccttcatctcgtgggttagaagctgccagcactgctattctcagcacccagcccagaaaaggacctcaaagtgaccaaggtcagagcagtgtaagcactggagacagcccagccagcgtgcccagcattgatgactccagggtttcatcccttatgaatgcacaaagccatcaacatccaaggatggtgtcaggtccacatgaatggaaggtctaggaaaacgatgacaggacctgcaaaggcagtctggttttcctgacaccatgaggatcgatccttcaaagtgtggagagggcagggtggcctcaaattgtggagccatgtgctaaattccacaaacctcaggaatgaaactaagctgtgtttcctgaaactggcgtggccgtgcattctgccataccttcaagagccctggctcaccccaagcagtgcttccccacccaccctggctgtccatcagaaccaccagcggccccgctgctagagactctcattcatctggttggggccaggcacgggtatttttaaagcttcccaggcaattctgttaagctgcagggactggaaggagatcccagaaggtggtttctgaagcactgcacttacttgatgatagccgacacgttggtgatcttgttaaagaaatcaaactcccgctggtaaaagtccttcgctgggccggacaaggagcctgtgatctcctctaccaactgatccaggaggtcgccgatgtcagctgccaaggaagcaaagaggcttaagtctctgtggctgtggcagaggcccctcaggaataccagccctgtttcccaggccccagactggcagtgcccagagtatgctctgcaggcttggtgagaccataacagctgccgtgtgccccttttgctgtgttgacacagctgacgctgctgggaagctaagctggtgcctaagcggagctcaaggcaggggccaagcgcacaagtggacgtggaatcctcactgctgcacacgctacacacgcaggaagaaaaaagcccgtgtcatttatgaatgtcacagggcatagaatcctcactgctgcacacgcagggagaaaaaagcccgtgtcatttatgaatgtcacaggtgaagcaatgaaaactaattcttattaaactctaccctgaatacatgtctttttttttttttaatagaggcacacagtgggcggggctctatattaaatagtgcctctcactattcaaatcccaggctgaatttaaattcctgggctcaagagatcctcctgtctcagtcacctgagttgctgggactacagctagtaggtgggactacaggtgcgcatcaccacatctggcttttaaagtatcctttgtgatgaaatgggatgtgcacgaagcactcttgccgcatctaaggcaggcgctgtcctgagaagcacctggagcttgtctgattttggagcctggactaacctttttcacagacctttgtttttacttgaagaaatgactgacagacaacatatagctattcagacttagggatgtggcagatgttttcctgaaaatgaacaaaaaataaatcttccactcaaaggaactgaaacatttttttggaaaacttggatctgctgctgtgagctcaacagcttcccttaaaaactctttctgggccgggcgtggtggctcatgcctgtaatctcagcactttgggaggccgacgtgagtggaccacaaggtcaggaaattgagaccatcctggctaacatggtgaaacaccgtctctactgaaaatacaaaaaaattagcaggcgtggtggcaggcgcctgtagtcccagctactcgggaggctgaggcaggagaatggcgtgaacctgggaggcggagcttgcagtgagccgagatcgtgccactgcactccagcctgggcgactaatcaagactctgtctcaaaaaaaaaaaaaaaaaaaaaaaaaaccctttctggtaagactggcagatgtgaacaaatatgatttttccacactgtacaaagaaatgcatcaacctttgaaagatgtgcataactcactggcctatattttacaaatgcccaccgtttgatgttataaaagcttttgtgggtccaggtgcgacgtagacagacttgaacaaaacacagcatgagaagtttactgccaagtttaagatgccacactgcaattaaccttttttttggcgatcctcctgccttggcctcccaaagtgttgggattacaagcatgagccaccatgcccagactgcaagtaatcattaagaagctaggctgagctacaaaaaattaaaaattagccagtcgtggtggcgtgcacctatagtctcagctacttgggaggatgaggcaggaggatcgcttaagcccaggtggtcaaggctgcagtgagccgtgattgcgccactgcattcctgcctgggagagggaccctgcctctaaaaaaataaaacaaaagctaccacttctcaagtgtggtgcagtatcaaaaagaatctccacaatgacctgagagactactaacatacaacttcctttttcaactacattcacttcaactgaaacaacactgcaacagatcaactgcagaagtggaacgagaatgagaatccagccgtcttctacaaggaaatgccactcttttggctcattttttagttttttggggaaagttattttcccaaaaagatgttatttatattaacatgtaatgaatgggcttacattttctgaaattctgtcttaatctctaatactcgttaacactgacagctaatgctcacattaaacagcgctctttgaggacctcaataaacatttctgacagtgcaggggtcctgaggctgtgctatttgggaaccgctgccctgggctgacggccccttcctcacatgcagtcacagttgtgttgaccatggagactctgcagaagcagccactggagcagaagggtctcactcgcacttgggagtgcagggtggcatcggacagcaagttagcaaaggtgtcatgaaggaggggtcctgctcccctgtgtgctgaaaggtgagaagtgccccagcaaagggtgggagtggaggggtcggtgagctggggcagtgcaggctggcgagagccctgggggctgtagaaggtgcttggcagtgcactgaagacagtaagtgaggcctgtgggaggacaaaatactcacggtctttctggtggccctcttcatctagataaatgttagtcttcatgttccagatgaactggtgtgccagaagctgggatttagacgctgcccacagaatatactcccgcacatagcccatctgcaggagagcaaggtccctgtcagccaggctcggccctctccatgaggagggccttgtcagcagctgctgactcccggcatttggtagaccaggcaagggtaaggcccggtggctctagtggtgtggacaagctctccaggattgatgttgagtccagccagtggccaggccaagttccagctggctgggggctgggacctggggggcagggttgcaaagcgggcgacagtcagcctttgtctcctctgtgtcttcccatgggtttaagaagcacaactctcaaaccaatttctggagttgtcaagtacgagaaaaagcaggctgggtactaaaaactcacttgtgagctggttgtttagaacaatgttccaaagtgacagacaggttccagaaacatgcagagatacctccttcacaaactgacacactgatatgattaggttttgtgtccccacccaaatgtcatcttgaattgtaatcctcaggtgttgaggaagagacctggtgggaggtgactggatcatggggacggttcccccttgttgatctcatgacagcgaatgagttctcaggagatctgatggttttataaatgtttgacagttcctcctacacacacacttgctctctttcgcttgctgccaggtaagacggacctacttccccttccaccatgattctgtttcctgaggcctccccagccacgtggaactgtgagtcaattaagcctcctttataaattacccagtctcgggaagtttttttgtttgtttgtttgtttttgagacagagtctcggtctgtcacccaggctgtagtgcagtggtacaatctcagctcactgcaacctccacctcccaggttcaagcaattctcttgcctcagcctcccgagtagctgggattacaggcgcacaccaccacatctggctaatttttgtatttttagtagagacagggtttcgccatgttgttcaggctggtcttgaactcctcacctcaggtgatccacccacctcaacctcccaaagtgctggaattacagttatgagccaccgcacctggccaggaagttctttatagcagtgtgaaaatggactaatatacacaactgtggtcaccatcctaaggacctatcctcctcttccttcttggtcattttccgccactcatagtagtaactccagtttttctttttaattaaaaaaattttttttgttcctagagccataagttttgaaactccagttttaattccatgccctaggtttaaaaaggtgagctggcctttctgggcagcctcctggagtctgtggccactgatctggtgaagtgtcccttggatggacatttttgacctgggtgagtcgggggtggtcttaccacacaggcagaagtcttcactttgggtttcccaattctaacccggcaaatggatctaaagacaaactatgaatgttcaatgtgtagtgtttttaaatataagtttgctttttaattatgtaaacactgacagagttccaaagtcaaaattattaaatatggtacatatctgtcagttccatcctgatctctccctctttggccatttttattaacttttgatttactgttcctttttttttttgagacagagtctcgctctgtctcccaggctggagtgcaatctcagctcactgcaagctccgcctcccgggttcacgccattctcctgcctcagcctcccgagtagctgggactacaggtgcccaccaagcctggctaatctttttttgtatttttagtagagacggggtttcaccgtgttagccaggatggtctcgatctcctgacctcgtgatccacccgcctcggcttcccaaagtgctgggattacaagcgtgagccaccgcgcccggcctactgttccctttttttgtaaaagtataaacaaatatgtatatacatttgtattgccatagtgatataaatttttttaaacttaaaaaatattccaggctgggtgtggtggcacacgcctgtaatcccagcattttgggaggccgaggcaggtggatcacctgaggtcaggagtttgacaccagcctgaccaacatggggaaacctcatgtctattaaatacaaaaataggctgggtgtggtggctcacgcccgtaatcccagcactttgggaggccaaggcaggtggatcacctgaggttaggagttcgagaccagcctggcaaacatggtgaaaccctgtctctattaaaaatataaaaattagccaggcgtggtggtacacgcttgtaatcctagctactcgggaggctggggcaggaaaatcacttgaacctgggaggtggaggttgcagtgagccgtgatcgtgccactgcactccagcctgggcaacaaagactctatctcaataaataaataaatatttattatttttttgagacggagtctcactgtatagcccaggctggagagcagtggcatgatcttggctcactgcaagctctgcctcccgggttcatgccattctcctgcctcagcctcccaagtagctgggactacgggctcccgccatcacacctggctaattttttgcatttttagtagagacggggtttcactctgttagccagtatggtctcgatctcctgacctcgtgatccgcccgcctcagcctcccaaagtgctgggattacaggcgtgagccactgcgcctagccattaattaattaaaataattaaccaggtgtggtggcacatgcctgtaatcacagctgcttgggaggctgaggcaggaaaagtgcttgaacctgggaggcagaggttgtagtgagctgagatcacaccattgcactccagcctgggcaacaagagcgaaactctgtctaaaaaaaaaaaaaaattctggctgagcgcagtggctcatgcctgtaatcctagcactatgggatgccaaggcaggtgaatcacctgaggtcaggagttttgagaccagcctggccaacatggtgaaaccctgtctccactaaaaatacaaaaaataagccgggcgtggtggcatgcaccttcaatcccagctacttgggaggctgaggcaggagaactgcttgaatctgggaggcagaggctgcaaggagccgagaatgccactgcactgcagcctgggcaacagagcgagactctgtctaaaacaaaacaaaacgaacaaaaaaaaattccctaaaaatggaaagcaagaaagaaaccagtgaaactagctgagtcctgagttggtacaaccacacacagaagaatcatttcaggcggcctttctctggtagccaccaccaagagttcacacggaggccctgggtactggctcccctccccactgcctctggatctcacccttatgctaggcctgtatgcaagcagagagccaagcagtcaagggaaaataatgtgggaggggagccagggggaaggaaacaggttgctgaagagaaggtgcctcatgacaatcctgtaagttgccaccagtgtgaaggctccggcttggtgagtgtggctccacacatatcaccactcagaggcgcagagagtgtggcactacctagtgagggcagtgaatgattccacaggactcagtctttcagcagaggctggctgctgttctagaagcactttggtctacagactccaaggctagcccctgggacacccagccatgtaactcagccagcccacaggtgggccagagtggtgaggactcagccaggacacatggagtctgctgcccaattcatccagggaaatgaggtcagccctggggttggggaatagggcagacaagctgcactcagacacagggtgcagtgggcaggctggcgcgagggcagaggcggctcgggctcctggctgtggtcattcccatggatattttctgtgccatgacctgtgctgagcactttatgtccatggatactgttacgggctgaactgtgtcccttcaaattcatatgttacaggacctcagaatggtactgtatttggagatagggtctttatagagatgattaaggtaaaatgaggtcaatagggtgggtcctaatctagtatgacaggtgttcttataaggggagattaggacacagacacacacaaaaggatgaccctgtaaggactcagggagaagatggctatcaataagccagggagatgggcacagtggctcaggcctataatcccagcacttttggaggcggaggtgggcagattgcctgagctcaggagtttgagaccagcctgggacaacatagcgaaactccatctctacaaaaaatacaaaaattagctgggcgtggtcgcacacgcctgtcatcccagttacttgggaggggtagcggggaaggtgctgaggtgggaggatagcttgagcccgagaggttgaggctgcagtgagctgagatcacgccactgcactctagcctgagtgacagagcgagaccctgtctcttaaaaaaaaaaaaaaagccagggagacaggcctcagaaggaaacaaccctgttcgaacaatgaccttggacttctggcctccagaattcatgttttttgtttgtttgtttgttttgttttttggcctccacaattctgagaatgagaatagacatttctgtcgtttaagctgcccagtctgtggtgcttcgctatgcagccctggcagactaatgcatatgtcatctcgttaattttcctcaccacttccggctgaagagggcaggattcagggatttgaggggaccccaccgatgagagggaagcctggccaggctgcctagccaggctggcaacagccccagaaccggctcgctccacagagcatgcttgggcctcagggtgaggcagtgggtgaacatgggtatcaagggacaatcacagggcctggggtagggggagcaaggggactgctgggcagccctgcccctgaggaggctctgaggagcctgtgagggctggggacagaccgggcacaagctggtgtggaacacactctgtgagtgaagaggacggccatgcaggtgcaggcttaccttgtcgtacctgagggcctgcacaatctgggggatgtagaagaggatggcgtcctgtggaggtggagcagagttggccatgacttctgagagcagagccacccaaccctacggcccaggccctgcctctgcttctgctctgcccacagcagggctgagaactggggaaagcccagaggatggcaggcaaaatgaccgatggctcagaacacaggaatggaggaaacaggtaaaaggagcaaggctcccgctctacagcgggcgagggcctcgtgctcctcactagggagcctgcctcagggaatggtctgctgtgggtcagactctagaatattccagagacccttctccaccatcatcatggctatctcgtgggctccctgggctcccacaaggagtgagggaccctccacgggtgaggtcactgtggggttccaaggcacagctagctgcactgctgtgtggggtgtgcacagctgccgcgccgcctcgtaatcaaactcaagttaactttatgtctttaactcaaacgcctcactagattaaaaaacaaatgtaactagagaacacatttgaattagaactaaatccatcttctacaactacttgagcaaaaaacagggaaaggaccagtatgtaacggggcgacctcatggccaatggtggggcctgtgcctctcaccaggtaagacccctcccaacagtcctaccagaggccagctcagcagggccctgggctcaccggagggaaggaccgcaggactttcaccccgtactgcgccgtgagagggtgcggcgggtacatgctggagaagtaggagaggcctgtgggtgggtccgtgggcgcccagcacagcacatggctgagctctggagcatcggcgtcgatggtgtgccaggtgaccaggaactgcagagaaggtggggagatgctgtggcttgggcagtcccgggacctctggaaatacctggtccacgggccacacaaggacggccatgagaagtgatgtttctaagcatcggtaaccatggggaagatgcttctgatgtgttatggaaaacaacgtaactgcaattagggtgaagtgcattacatttttttctactgtgaacaaaataaatgctacagacaagaaatagaaaacacaggaaatcagaaaaaccatgaatagcactgaagttgccaagcggctgtttttgtctcatttctagtttcaggcatttctgggtgcagtgtgctattttgtgcagtttgaactcaggccctggtacgtgggctacactaccttgattgcttcaggcacatcactaacggctcccgggtccaaccgaacgagacgggtcacttcgttcccaatggcttctgtgttcttaaacctacagtgcacagagggtatgggtggtgctgcctcgccagggaacctgcactctcccaccacactggagtgaggggagccagggggaaacactgaactggagggattcacatcaataccaagtgacggcttgggtacaaacaaatagaaagaatgaagacctgctatttgatagcacaacagggggactacagccaataataacttaattgtatattgaaaaataactttaaaagagtgtaactggattgtttgtaactccaaggacaaatgcttgaggggatggataccccattctccaagatgtgcttatttcacgttgcatgcctgtatcaaaacatctcatgcacctcataaatacagacatctactacatatgcacagaaatttaaaaaaaaagtttaaataaaaaaatgtttagccaggtgacggctaaatgttctattatgccactaactagtaggtctgaacattagtgttttttaaaaagaggattataatctgctgtgatgaaatgctggaactttcttaaagaaacaggaatttttctacacttaactgtttaaagggcttcctttcaccatccttgtcttaaaacccctgcctcttactccttttcctaccatatcctctcctgactctccacagctgctcatccagtgagtcagtgtctcagtcaacagtccaggggccacaaggcacctggtccatgaaggggcagctactggtttccaggtgttcccacctcaggctaatgcaaggcggatgtcccatgagcactgtgctttgagacaatgcagagctgcgctgcgatcctattccagaggatcaaagtagggctggagagaggatgcagtacattggcaagtctgggctcacaatggagaatcacccaccctggacacattcacaggaggctgtggaccatctggtgggattctaaacagggactctgcagtccctctcagccaccatcggtctgaagttctgtccccataagagctgccacagagagatcacaggaatgtcactgctgtctgcagcatgtgcctcctccaaatactctgccactgaaaggtgacatccaggaacaaacccaaaccctccccaaggcggttccggcagccacctgccaggagtgacagcctccacatgcttcctatccggcaggaatcagatcttggctctgaattcaccctgctgctacctccctaggctccagctgctgcagcaccccaggcaggcatctgaaaagatcacgagggttgctgggttatctctgcacagaagggctcggggagtgtcctggggctcgaggactagactacttcctgactatccttgaaaggggctgcagggcactcctgagaactcatgacccagctggcaagcaccctgcgctggacctctggtgaggcctgtgtcaggctgtggtgcccgggggcccacctggcaggcagctgcacggctaggtagggagagatgctccaggcgaggttcacgttgtccttccactgcttctcactcaggctgatgtacttagatctccagttggccacgctgttctctccggcctggtctagttccagttccggggctgacagcgggttgtaccatgtgatgagacgctcgatctcagtggcctggcaagataagacataaggcctgatatgcaccccttctgtgagtgcccacacactgccccggccaccaggtgtcgtacaggcaggtggcgggcagcaggcacagctgcacctgtgggccttaccagcagggacagcagcagcgtcctgcgcttcatgtagtatttgtgcagctgggagccccggttggttttcttagacatgcctaggaggaaagacaaagcacaggtgtagtcctcagatgctacctgtctgccctgagattctaaacctagaggaagcttgcagtgctctgttctgctgtctgagcaagtgtccatcaagcagcttgcaactagaatgatagcttgcatgtgatggccccagcagcacacctcccaccgacctgatttcttggagatggtggacatgccgctggacagggggtatgtgttgatccagccttgggtggcttgttgccgagagccgacagttatgtccaggttgctccgggtgtcctgattatctgagggcaaacacattgttgattctagagtgaggtggctcaagaaaaggtaccacaaaaaataaactactattcaccagagataaagcaattagtggcagagcaggcattttctggagtcctggaatcgactgcaggaacaaatctgtctggatggtgggttttccaaaagcatgagaagttctttattttaactattctagatggaatgtttaaacatttttattatatttcttttaaccttttcaaaatttatttatttatttacttatttatttttgagatggagtttcgctcctgttgcccagggtggagtgcaatgacgtgatctcagctcactgcaacctccgcctcctgggttcaagtgatcctcctgcctcagcctcccaagtagctgggattacaggtgcctgacaccatgcccagttaatttttgtatttttagtagagacaaggtttcaccacgttggccaggctggtctcaaactcctgacctcaggtgatccacccacctcggcctcccaaagtgctaggattacaggagtgagccactgtgcccagcctatgttttatttttgagaaggagtctcgctgtgttgcccagactggagtgcaatggcgcgatctcagctcactgcaacctctgcctcccgggtttaagcaattctcctgtctcagcctcccgaatagctggactacagacgcccaccaccatgcctggctaatttttgtatttttagtagagatggggtttcaccatattagccaggctggtctcgaactccttacctcaaatgatccacctgccttggcctcccaaagtgctgggattacaggcgtgagtcactacacctggacttcttctagcctttaaaatagaataggctgagcacagtggctcatgcctgtaatcccagcactttgggaggctgaggcaggtggattgctagacgccaggagatcgaggccagcctggacaacaaggcaagacgccctatctctacaacaacaataaaaattagccaggggacctggcatgtgtctgtagtcttagctgcttgtgaggctggggtgggagaattgcttgcacccaggagtttgaggctgcagtgagctatgattacactattgcactctagcctgcgcgacagaatgagactgcatttctaaaaaaaagtagaaaataaaatagaataaaacaaatatcataattttcttgataaaagatggcagttatctgatcaccggcaacgtatagtcctttagtacggtgacaacttgagggcctgtgggggcagactgtaaggactgtttgccctcttctaagtggagccagaaagctgccttagaaagtcactgcatctgcttttttctttccttttcctgctagttaggttgtcagccgtgggtctgctaaagaaaaccatctcagccaggcaatgtggcccacacctgtaatcccagcactttaggaggctgaggcgggcggatcagaaggtctcagccaggcaatgtggcccacacctgtaatcccagcacttcaggaggctgaggcgggcggatcagaaggtcaggagtttgagaccagcctggccaatatggtgaagccctgtctctactaaaaaataaaaaaattggccgggcacggtggctcacgcctgtaatcctagcactttgggaggccgaggtgggcagatcacgaggtcaggaaatcgagaccatcctggctaacacggtgaaaccccatctctactaaaaatacaaaaaattagccaggtgtggtagcgagcgcctgtagtcccagctacttgggaggctgaagcaggagaatggtgtgaacccgggaggcggagcttgcagtgagcggagactgcaccactgcattccagcctgggcgacagagtgagactccgtctcaaaaaataaaaataaaaaaaaaagtctgggcgcggagatcgagaccatcctggctaacacggtgaaaccccgtctctactaaaaaaatacaaaaaattaggcaggcgtggtggcaggcgcctgtagtcccagctactcaggaggctgaggcaggagaatggcacatacccgggaggcagagcttgcagtgagccgagattgtgccactgcactccagcctgggcgacagatcaatactctgtctcaaaaaaataaaattaaattaaattaaaaaataaaaataaataaataaaattaaaaaattagccaggcatggtggtgagcacctgtagttccagctactcaggaggctgaggcaggagaatcgcctgaacccaggaggcagaggttgcagtgagccaagattgcgctactgcactctagcctgggagaacagggcatggcctccttacagaggtttgctgcttctttgcgtggcatgttttcattcggcatacccttccctggaatgctttgccctgtccaccctgcatgccggtgcagccattcagactcagctcaactgtctctcttccagaaaaccatctctgattcctcaactctggatgggccaagtgcctgtccccgaggagtgctcccatagttccctcatattgaaatcacctgtccatttgactgcctcctacaagacaacaacagaccataccccagtcatgtgggtgtgcaccagcctcagcccaatcctgggccgtcagctgctcagaggggtgtgtgaacgcagctggtgccagtgcagggaaagtgcggtgagtggagtctgctcagctgcctcgggtgcgtgtttatgcttctcagctcaggccagaggagaagcagagccaggcatgcaccggcctccaatgaccgtgcaacacagccaaggccagggctcaggggggtctaactgcttttccgtccctacctctggcaccctcggggcagcccacgtggcacccctgtcctgcctgcctccaccatgagcagctgcactgttgagggttacctgggggaacaagctggctggcggtcaggtacttcttatctgagaacatggcggtccaaaatttaatcatgatgcttatgtcttcacgcagccgcttctctccttgagtagggaactttgggggacagcttcaaacaaccataagaggacaagggctgagtgtctggagtcagggactagaggccagtcacacaaagcagtgagaaggtgatgcagacagtttcttaatgacaaaaggtcagcccaaagccagtcattagcaaggatgatctggcccattcccatgggaaggtgtggtggctcgggagccctcttatgccctcctccctcactgcccacagcagcccctacagctttccactgaagctgcacttgtggcagatcagggcaaggaagctgcactcacacaacagcacagcctatgggtgcagagccccaggcagtgggtgtttgcaattcttcgtgcaataagccttcacattaacagggaaattaaatggacgcacttaatctcctaaatcagttgaactgagggaaaatttgcctacatctcgctgggaggctagctctaagtacacgggacacatgcacagggctgaagggtatttaaatccacagggccagggatactgaaggaggaggttggtgagcacaactgggcaactgtgtattcctgtgagtgacttcctgggggtttggggcgatggagcacttggaggggctgcgccgtccctggacgctgcacagcacatcttgggggagtacctgaagtagtcaaaggcagtggagtagatcttctcgcgaagcacattgcggatggttgcatttggaaccacatcggcatgcaggagggacagccccagggtcagcagcctgtgagggagccccggacccagttagagcaggagcctggcctggggccaagttcaccttatggactctcttccctgcccttccaggagcagctcactgaaatgtgttccccgtctacagaagtaccgtgatacacagacgccccatgacacactgtacacaccaggggccctgtgctccccaggaagagggccctcacttgaagcggggcccgatggccgccacgtgccggttcatgctccccttggccccgccgatgttcagggacatggagcgctgcagcaggctggagaagatctccacttggtcagagctgcagtacttggcgatctcaaaccgctgcaccaggaactgagcgaaaagaggaagacgctgtggtggtggggctgagccgggctaaccctggggccggcagagacagctgaggaggggttctgggctgactggccgagcttgccgaaggccttgggctcggctacccccaccccaggaacagtcctggccccccaggtggagcaccccacagccttcgtgggggaacaggcacgtacgtcgatccagatgtagtggggggtcacttcggggggacagggtttgggttgacttgcttccgaggcagccagggggtctgcttcctttatctcagcagaaaacaggccaaatttctgctccaccgtcatgtgccaggcccctgccatctcccgcatgaactacaggtacagaaggaatgttagctcctctgtgaaacacaaaaaggggctactgtcaagttttctctaattaaaaaaaggaacacgtgctcactgaataagatttagaaaccaagaaaagtatgaagaaaaaaatgaagatcgcctatagtcccacatcccagggtcatctgtgtcagtgcttggtgtattttctccagcctctcgaggctgccttctgttcaacccggttcaccgtgtggacattgcaggtgtgaggtggcagcacccgggatgtacctgatgccctgacaggcactgggtaggtgactcttctctataaccctgataaccctctgtggctgtgagcgggaagacccctctgtgggatgctgagctggcaagggcagaagagggttctggatccagagcctggctcctcctctccaccccacacagaccctacctgatgccttcatcccgctaaccagattaggaaaggcccatggagccgaggcgagcctgcagccaccatggccaggcctgggagcccagggtcaggctgctcccatggcccagtcatgctcagccaggtccccattccgtgggggggcatgaggggtgcccagagggagcagcatggtgcccgggagacacctgggtgctgcagagagtaagaggtgcagctcacacatggaaagcccccatgatttctgggtgtttttacaaggagaccaacaaacagcatttggcatctggccaaagaggattctatccctctgttgtcccagcagcaccagcttctacaagggctccaagcgcctgtgcagaggtggcaacgaggcctagtgagtagaacacacaccgcggctccctccccagtaccatcccctcccttcttcctcatgaggtggatcagggtggccacgtggccagtcacagggctctcagccagggtccctgctggctgaggcggccactgttctccccggccactctaatgagccagggagagtgaactgggcaaggccctgggaacacatgccagggtgagcttcataaggtcaaggcagctggcctctgccttttgcactctgtccttgtcttccttcctgctgggaggcacagaagccatctggaggctgtgagggtggagacaaaggccacataagcccaggatggccaggagccgacgggagcccggggcggggctctgtctgctgcttccctctaagctgcccatggggtgaggactcctgggggacgaggcactagagcctgctttctgtttcctgcagaccgattagtcttatggaagcagacaagggagaaaaaaatgggggggaccccagaactgccatggacaagaagccatggaagagacacactcccacctatttgttacacaaccacatcctggtggctgcctctgtgccagggcctcgtggactctgggcatggtgctctgaatgaagacaaacatgaccacacagtctatggtggggaccacagacaacaagaaataagctacacacactgagaaacactaagaaacagcagtgcgagtgagcgtgtgacagaccaggtggccagggagagccctggcaaggaggggatatctgagatgagccctggaggagacgcaggagtgaggcgcaaggcacggccatctgagaagagggaatgcatgacgcggcctatggtgggagcagcccaggagggcagcttcaaaagtgaaactgatgggatgtgctgagaatcatccgtgggaagtgcaagcaggaccccagcatggccacagcacagcaagcaaggggaagagagaggatggaagtcaggtgggaagggggcttgcaggtcacagaaacaagcccaccttcgagtctgtaggggggctctgattcccccctggcttgcgccaaccgcatgtggagaaggggaagatgcctggggttggggagcaggaggccaggccagagggcagcagctgggatgctgggacttgtcagatcctggataaacctcaaaggtgaaggtgatgggatgtgctgagagtcatctgtgggatgtgcataagagggagtcaaagacgtctgagcagacagaaggacctcgctggcatctacagtgaagggaagggccatgctggcatctacagtgaagggagggaccttgctggcatctacagtaaagggagggacctcgctggcatctacagtgaatggagggacctcgctggcatctacagtgaatggagggacctcgctggcatctacagtgaagggaagggtcacactggcatctacagtaaagggagggacctcactggcatctacagtgatgagagggacctcgctgacatctacagtaaagggaggggccacactggcagctacagtaaagggaggggccacactggcatctacagtgaagggaagaaccaccctggcatcaacagtgatggcggatgggcgaccagtgtagcggtgtctggagctgtggttggacccattagttggggctgctaatcagttcaccatgcaggctgtgggccaagccactgaagggatgcacctggactaggagtgactgggctgggtaagcagtggagctggccagagtacccaggcagggaggaggagccctggggcatgccagtactgagaaggccctgagctcaagaaggtccctttattctggaggatgaaagggctacaaaaattacaaaggccttaagtccctgggaaaagcagttaggctcccagaacagctgctttcaagacccagaactctgaaggaggctgtgagcagctttccctaggctgatctgtcctcctaccatctggggcctgctagtgatatctgtactccaactgccctgcccccaggggtcaaccaacccactcctatctgaggacccactcctatctgaggaccagacagggaggccagaagttcaagggcacctggactaaggaagtggagaggagagaggtggatctgggctccagagccccaggtacaatgtgagggctgacacgtggtcaggagcacccccagtgccctatgaaatgggaacggctacagcccctactctttttcttttttttttttttgagacggagtttcgctcttgttgcccaggctggagtgcaatggtgcgatcttggctcaccgcaacctccgcctcctgggttcaagcgattctcctgcctcagcctcctaagtagctgggattacaggcacatgccaccacacctggctaattttgtatatttagtagagacagggtttctccatattggtcaggctggtctcgatctcccgacctcaggtgatccacccgcctcggcctcccaaagtgctgggattacaggcgtgagccactgcgcctggctgagcagcccctactcttaaggcccaccgaggtctgaggctgaagcagcatatggaaaggaatcctgaccatagcagcactgtgtcctgacagtcacaatttgtggtgaaaccagggcttccagaagaccctgagaggagggcacacttgtcctcttctgggaagtggagagtcccaccaagagatagtgtgtaggcaggtgtgtgtaggcaggtgtgtgcaggcaggtgggcacctgggcccacacaggagtgagcgtggctaagacttcccaggatcgggtccctcctgagcccacaggaggacagcctcagggtgtgggggaaactgcaaccatcagcctagaccccaaggcctgggttcaatggacaggagagtaatatacatataatgccctgcttaagttgggcacacagcaggaccagagcaagttatcagttactagtgcagcccacatgcatttattttgggtcatgaattttaagtatcatacaaggatcatgaatctttcccctctcagtgaaatgaaggtcccagacccctgtaaggaggtcaggctccccactgttcccacgctgagatgcgaacagcaagtgtgacatctcttcatctcctgggcactatgggacctggacaggtcaggtccttgtggaggcagagacagggagtgaggacctgaatgaccacgtgctgctggggccagtgccaggtgtgagtgtgagtgggtggagaagcctgacacaggccaagggacctgaggccagctgagccactggagatggtaggagcaggaagtgcaagctggactccaaaagaccccaaatgaaacagtaatttggtttgtataaaaatccctttaagacacctttcccaattttgcttaaaataaaaaaaaaaggaagtggggtaaaaagcaggaagaacccatacttcctgccaagaccagctattgagtaggaggaggagccaccagacataagaaagacatctcggacaggcgcggtggctcacgcctgtaatcccagcacttggggaggccgaggcaggcggatcacaaggtcaggagatcgagaccatcctggctaacaaagtcaggagactcagtcacaaaaaaaaaaaaaaaaaaaagcaactggctgggcgcagtggctcacgcctaaaatcccaacactttgggaggccgaggcgggcggatcacaaggtcaggagatcgagaccatcctggctaacacagtgaaaccccgtctctactaaaaaatacaaaaaattagccgggcgtggtggcaggcgcctgtagtctcagctactcgggaggctgagacaggagaatggcgtgaacccgggaggcggagtgagccaagatcgggccactgcactccagcctgggtgacagagcgagactccatctcaaaaaaaaaaaacaaaaaaaagcaacaacaaaaaaagtcccagctactgggtcaggaggccgaggcagcagaatcacttgagctcaggaatttgacgtcagcctgggcaacatagcaagactgtcttcaggaaaaaaaaaaaaacaaaagaaaaaaaataaagacctccttctctctgggaaaatatacagcagtcctcctcaactgtcagttttatttaaatgtacaatgtccagtatagaaacaaaaactttcaaacattgaagaaaaaagataaaaagaaactgacccaagatgactcaaatacaagaacagaccagataacgatataaaaataattacaataaatatgctcaaagatttataagaaataatggaaagaatgcatgaaggtaagagaatctcagcagcagaaaatgcaaactataaaaaagaattaaatggctgggcgtggtggctcatgcctgtaatcccagcactttgggaggctgaggcaggtgcatcacctgcggtcaggagtccaagaccagcctggccaacatggtgaaaccctgtctgtacaaaaacacaaaaattagccaggcatgatggctggtgcctgtaatcccacttacttgggaggctgaggtgggagaatcacttgaacccacgaggcggaggttgcagtgagccaagattgtgccactgcactcctgcctgggcaacagagtgagaccccatctcaaaaaaaaaaaaaaaaaaaaaaaaagaattaactagaaatcctagatctggaattgtttctttttcttatttttaaattaaatatttattttttgttttgttttctagacctgagaattgtatctgaaataaaaaatatacaagatggttttacagcagaatgaataaagcagaagaaaagaacagtgaactggtatacaggttaaaaaaaaaattaaccaaatgaaagagtgagaaaaaccctgaaaaactgaaaaagactacagagaatgtcgatgatctatgggacaataccaagtcactaatatatgtgtacctggaatccaaaaaggagaagagagagagaatgaagtaaaaaaaaattaaaaaaatattgaccttaagagcctaggaagtaaaaaaaaaaaagaaaaagaaatgacaaagaaatactgacctcaagatttccaagtttgatgaaaatcctaaatccctgaaattaagaagctcaatgaattccaacaggataaatacaatgaaattcacacacagtcaaacaactaaaaatgaaagataaggagaaacatccaacaagtagtcaaaagaaaaacaataacatatacagtcatccttggtatcctcaggagaactggttccaggatgtggaacccatggatatggagggccggctgtactgagaaacaaaaagactgttgacttctctccagaaacaatgcaagctactagacaatagaagataatatctgaaatgctaaaaacaataaaacaaaaaactatcaacctagaatcctgggcctagaaaaaataatccatatgcatcaaagatgaaggtgaactaagatgagagaatttatttccagcagacctgcattactggaactgttaaagaaaattacttggcagaggagatcacaggaagactgtaaaagtgtgagtgatgaaaaacatttggataaattataatgctgtaacaaagccttgtcttaatttctttgaaagacttttgatttttttgaacagaaacaacattataaggtctaatgcatatagtagtaaaatatgaaaacaggacacaaggaattagagggagaaattgggtgtcataatggcagtgggtatccacagtggcaatggtatacagctgtctctgcagaatcctctccctggcaagaactataactgatgtggccactccagttgtcatttactgacagctcactaggatgcaggtgctcttgtaatgatgtccaccatgcaggtgaggagccccgcccaggaatcagagccctgcaggctgaagcgtgacttccacaggcccttctgcatatctttgatgggagcaggctggtcaggctgagaacccagcactcccctgacttcacaggtgtccccctgactagacaacctcccccaggcgcccactggaccaaaatgtttcctaacagcgctcaatggtgtgattgatacaaaccccacgaggttataaaatagcaggcaaatgtgagatattatcatcactgccaccaccaccagcccggaacattttaattacatttttggaaatattccaattttcctgagggaagaagaaaatcaaaatccccctttttgaccactcatttcaactaatcctaagaaatacagaaagaaaacatgtcaaattccctgctaccctgacagttaacagaatctttgaaaaataaaattgttcttaagcgtttatctaatcagctgaaacgtgagtataaacttccttgtgggcaccccctgcagtagcaactccagaaatacggatgcagggaaagggggctgatcccaagattaggtcaagaaaaacattcccgtggacaaacacaactgctcccaatcaaattcaaagttaacaggtgttcaaaaagctggatttccaatttcagtagagaaatggctccccctaccgaggttttgggagataacggcttctaggcaccagtgggatgctgttaacatatattctattttctgtgactgtcaggtataataatagaatctgtaaggagactgaggcttgagaaggtgaggggcttgcccagtgtctccatgcttggtggtggcggcaccagggaaggctcttcccgtctgttatcccatcccatcctcactgccaacccgaggtcagggtcctaccggcacttccactccatccttgccagccagcagccactcccagcaggccagggccgtctccatgccatgctcattgaacatccggaggggaccccagcacagatgatgaaggagctgcgggtcacaatctggaaccaaacacacgtcagtcagaggcctccaacaacagctgaaccccaaaacagcttccctgggccaacaagagttgaccagctggggccagtgatggccttttattgactttccactcatgagagatactcctctactgggggagctcctgctctttctccggccagtactccagctggctatgggtcatcaaggccagcattcatttagaaacgagcccagaattccacagtgcttcagtgagttacctttactgctaatgagcattgcggtcagcttgaacatggcctgcgtgtagtgctgaggatgactgcggtctaaagctgaatgtagatcctggaccatcattttgttcaggtcagacatctggcctgtggtgcctgagaaccgaatcattccatacacctgcaaaaacattctcatcagcaactaagcatataatccaggcaatgtgggtaaggttctggaagccaccagaccacacttgtggtggcactggtgggtgcctcgctgccccaaagtggagctcatgcatgcagagagacaggctcatttcaatgatgctaccactgatcacagctttttttttttttaaagaacagctcctctagaaatgcatgttggcagtgccaccactgcagatgttccccaagggtgggaaccttgtccctcatcattgtacccagcagtgagcccggggtctgacccatggtgggactgcatgaatgtgagctggataaatacatttcctcaaactcaattaatgactcaaacaacaatatcagcctcattattattttttgagagagggagtctcgctctgatgctcaggttggagtgcagtggcgtgatctcgactcagtgcaacctccgcctcctgggttcaagtgatcctcccacctcagcctcccaagtagctggattacaggcatgcgccaccacgcctggctaatttttctattttagtagagacagggtttcaccatgttggccaggctggtcttgaactcctgacctcaaataatccgcccaccttggcctccctaagtgctgggattacaggcgtgagcggccacacccagccctccttactattattaataattttttctttgagacagagtcttgctctgttgcccaggctggagtgcagtggtgcgatcatagttcactgcatcctcgaactcctgggctcaggtgatcctcctgtctcagcctcccaaagtgctgggattactggcgtgagccactgtgcttggccaacctatctatttttaaagacaaatataacttttttttccagagagaagaacatacaagtgacagagtgctaagaaggagtgaactcccactcagaccaggccactgatagactttcagagtcaccagggagcttagaaatggcatagactaggctgggcgcggtggctcacgcctgtaatcccagcagtttgggaggccgaggcgggcagatcatgaggtcaggagatcaagaccgtcctggctaacacagtgaaaccccgtctccactaaaaatacaaaaaattagccgggcgtggtggtgggtgcctgtagtcccagctactcgggaggctgaggcaggagaatggcgtgaacccaggaggcagagcttgcagtgagccaagattgtgccactgcactccagcctgggcaacagaacgagactctgtctcaaaaacaaaaacaaaaacaaacaaacaaaaagaaatggtatagattagcttctgagtttatggagcaggaaatggaggcccacagatgtgatggcactggtgaggctggaataaactgtggtgtggtgggtgaaagcccacgatgtggagttggaagatgtggttccagaccccactccacttgtgcgactttggcaagttacttaatcttgggaacctccgtttatctataaaactggaataataatacatacatcttaccgagtgcccaagagcctatggcatgtaagtgtttgttactgctgtaaaaaaaagccaaaaaaattaaaaaccttcattcagtgtagccaaagtgtacacagagttaccctcttgtggaaaaaacaagtaactggtcattaacactctggaatgtgccaagaatcctcctaaaatgtgctctttaaatcctcctaaaatatgttaattccacatcaccgggacgctttgttcattttccactaggaagcggccaacaggcctcaaaacaagaggacacgttaaaggccctagggcgcaaggacaagagaagcacctcgcccgcgtagcggttgcgcagattcagggatgccatgaagttggagtagtctttcttcacacaggccgggcgctcgctcagctgagttgcctacagacagataaccattattgtagactatggcagcactatcctttcctcgtgtttaccatggctaagcctaaacccaatgaagcagtcacactcgggtctgggggttactattaataaaaatcttcactgctggcaagttaataaagcaaaatattttagaatacccagcagtttgatatgttccataagaaattaaaaaaaaaagtctctggaaggcagtttctgctactggtaaataggcctttgcaagaaaaagaatcactagattgtgagagcaatgtcacctgtgatggaaacgccatgaaagcattcacagccgtctccttgagagttgcgtgtgcagcttataaatgtcacttacagaccgtaaaggggctgaaggggagagccaaggccagcaggctcttaaacatctgctggctgctcttcagtctaatgggaagagacagaaaagggtacaccttgaatacaaaggcaacccacagaatgggagaaaaatatttgaaaactaccgcccacccactccacccctccagccactctctctgcttcagcctcagcctcccagccccagggcctcagtgacctggcttcctaacccaggctggctgctgtgccacacctttcagttcctgttcatccacggtcactgcagagtacagcatgcattgaaaaggacctcctttcgcatttccctttagcatcagtactaatggggaaagtgagcttctcaactgttttgagtttagagggatttttttttgaggggacatggtgtggagaaagaggaccaggagaagaaaatacagatgttggggaacatcaaaatataaacaagaacaaaaatacatgatttctctcatgaaattattaaactggtttatttaaaaaaataaattacgtgaaactgctttacattttctggaaacaatgcggtctttggcaccaagcaggactgagttagagcttggctctgatactaatcagctgtgagaccttgggaagtcaatgtctctgagcctcaatgtgctcatctgtaaagtgggcataaccctctcacaatgttgttacacgttcaacgtaatgacacacacaatgtcctggcatggcaaacagcacctggtgggcagtgcaggccggctccctcccttccaccatcactcctcactgcccaatgcgatctcggctcactgcagcctccacctccctggttcaagtgattctcctgcctcagcctcccgagtagctgggattacaggtgcatgtcaccacgcctggctaatttttgtatttttactagagatggggtttcatcaaaaaaaaaaaaaaaaaaaagaatttttttttttttttttttgagatggagtcttgctctgttgcccaggctggagtgcagtggcgggatctcggctcactgcaagctccgcctcccgggttcacaccattctcctgcctcagcctcccaagtagctgggactacaggcgcctgccaccatgcccggctaattttttgtatttttagtagagacggggtttcaccgtgttggccaggatggtctcgatccactgacctcgtgatccgcccgccttggcctcccaaagtgctgggattacaggcatgagccaccgtgcctggccccagaattaatttttaaaaattaaaaaaaataacttagagaaaacctaacttacatcaaattttctggggaaaaagaacaaaatattttaggcaaaacagatctttcacaagtcagctggctagagtctagaaaaggcttacaaatgagaacacatattctattttatgtaataaagctttgctcctaccacccccaaaaaggaaaaggcttatgactatcataaacacttacagtctatgagttccgcctctggcctctgtggccacccagtggcagagacgtccaggtcagggcactgatacctggtgccccgtcagagtaggaggcccagggcgggtggccctgcaggtgcaggctggacccagctcaaccatgtctgctagactggtgtctttagagatagtgcagtgacctcgaggagagtgccctgatagcaaaatgaggcgagaagacaccagcattctctggcacatcctcaggccccacaaaagccagagggcactcaggcccctctctcccgccggtatcccaagggaggcctgtcacccttcctcctgggtacacagcctctgcacctccacatatcccatcccatgctccatttggagagagttgggaagcacacatggccaggctctagattcacattaaccaacaaaatctctgaccagccccagtcacatggccaggtggaactgcctgctttaatcctttttaactcttagctctaatttaactcagaaagtattgctgtgtgaaccctctgtcctctagattaatctctagcagaacaagaagctgaaggcattcatgtgcggttcagcacctgcagaaaacagaactgttcaggagtccagtatacgctccagataagtgcaactgtggcatcgcgctgcccgtgtcaggcggagctctgtttccatcctctcagatggggacattcaaatcaaaatctgatcactgacatatcaagcactgatccccataaatccataaatttaaaaaaaaaaaagcacaataaggaaacactcatttcaatggccacctcttctttgggccaaggtgcggcttgcaccactaccattgtcaacagacatccacagcaccctgcatgtactcatgtgcgtcatgaaaagcgacagccgagctctaagccttcccctgcactgtggctcctatggtctaaggggtcactgctcttcagaaggctcgcacataccccaagagttgtgttctgcttgttgtagccagcaaagtgaaggatgctctcagtggccatggccagccccgtgtgctgggacagtcccgatacccagttctgatgtttgttcagatattcctgaaataggaaaaacacatggggtttcagttatttatctgatttttttagaggcagggtctcgctctgtcacccaggctggagtgtggtggcacgatcatggctcattgcagcctcgacctcttagactcaagccatcctcccgcctcagcttcccaagtagctgggactataggggcacgccactatgcctggctaattttgcaattttttttgtagagatggtgtctcactatattgctcaggttggcttgaattcctgggctcaagtgatcctcccgcctcagcatcccaaaatgtcaggattacaggcatgagccactgtgcctggccttgctatttcatttaaaggggaaaataaaactttataaattaaggtgtgggcaaatggaccaaacactgggtttctgtcctgggtctgcccctccctaactagctgtgggactgtcagtaagtcaaagcccctctatgaccagctactgctcatttgactgaggacaaggccaattccccgagcggctgtcatgcagtcactgcggtgttgcaccgtcaatgggagagggccatttattctttcagcacatccttgctgagcatctgctgtggtagccaccaggcaaataagctacaaagccttggccttgcggtcaacaggcaggctgtgtggtgtggagcctcggttctctactgcagcataccagcagcctggtgtgggtgaactggacagcaggaacgaagaacaacacctgtgtccacctggccacccagtgggagaagggtgctgggcaatgggatacctggcagagcccaggggtgtgagggaggcctcctgctctggggaccacagggggctcagcctgcaggagtaccaaggacaagggtctcgagggtgggggcaagcctggaacagatgcaggccctgtttacaggcgtgaaccaactaattcccttaagaagaaatgtacaggagtatatacatgcagaattgtctcaatggttttgggggactcctggagctccagaaacccatccttggacactatgacgatgaagagtgactaataatcaagtttaaaagggaagtacactgaccagataccctattaaaaccagactactctggtgggtggaggagagggcagattcggggaaggctgaggctgggcacggagggtggggaataagcacactgcaggggaagtgaaagggcaggcctggggcacgccaaggggacacctggtggaaaaatcaagaccgcttcaagccttttcattttccatttccttcttaggccagacctgcgtgagaaagtaaaaagctctatcagctgctttttttgtccacttaaactttctaggcattagagggggcctcccctcttcagacgacagacagccttgggacctgaggcccttttgctgtaaatgaacaaagggaaatagtttcttgccactgcgtttccacacagctctcagggctcttggagctggctgctctatccttcctggactccacaaccagaaacacttttgagcctgtttcatctttaaagtgctgccagggtaaacctcacaagagttcctctcagcacacccactctctgctaacacagattccttccagaggtatttttctcatctttgattccttttaaggcaattctttcctctcacaccctgtggcattacatggtttacttcgtggccatctgagtttccaaaccagtgtttttgtctgaaagactcccatgcacctacatgtgcagcttatgtggagctttaatgggacacaagtccccaactctgcctctgctccaccagccttggtcaggcccctgcctttgggcacaggtgccagcaatgcacttggcacttagagatgctgccatctggcagcctcccacatccaccacacaagcccttcctctcgtgagcagcccccaagtcttgccacagacctggcacctcacctggtgtgagccgtcagatgccctccttgtgccctggccagcactggccccacaggcgctcctaacacacagagcagcctctgaggcatctattattctcaggccctagactgatgcttccagtctccattcacactagtgctatttggattttgagttcttcatgtctctgtaaagcttttttgggagtttgaaggagcttatggcaattgccttttgatggtttcaagtacctgcaggtgggacttggtgacggtaggtgcccacttcatggcctcctggaggatcatcccacagcgtgcagcgaagtccttcacaatgctctggaagagggtgaagctgcttctcaacaacccgaggtcagttcatctgagctgccgtagtgactgtcatgggctgaactatgtctccccaaatccctatgctgcgccttaactggtaccagtacctcagagtggaactcatttggagatagggctttaaagaggtgattcaattaaaaggctgatagggtaggtcctgatccaatctggccagtatccttccttacgtgtgtgcagaggaaatctggacacacagaaatactggggcagggaggagggtgtgcacagagggaagaacacgtaaagacacagggagaaggctgccattcacaagccaaggagagaggtctccacagaaaccagctctgccaacactttgattttacacttcggccctcagaactgtaagacaatcaatgtctgtcaagacctttcaagctgcccagtctattgtcttttgctacagaagcccaagagactagcacagccactaagtttgaacctcaaggcccctggggccaggaagcccacacacactatgatctgtatgtaattcctgcacaaggtttgtggcagaatctacaagaataacatgtcacagggacactgtgcaacttgtgtcctgggtctgggactggatggaagggcaggctctgcgtggcaaaatcctcttcggtgccacaccactctgtgggaaactccccattgacagctggtctggcagaggtccagaggtaggacatgactcagcccaggctgaaggagctgtgagctgagttgcagtcttgccacagtgagggctctgagaccgagttggggagaggagagacccagtacatcctcctcttttggagtgatttattctgccagtttccccattggatagcacaagtcaaaggcatgatcccctattaccacaataacaaaatgtcagtgcacctcagagaagtgaagtccacctgaaaatcatgcttgtgcgacgcagactcgagaggctataaactggctggtagctgaagacctctttggcagctaaaccgagaacacagctgagtcaacatggctgaggtgggggagctgggcttggaagacagagcgacctgggggcagccagctccccttgcactcggtggagcctggcaatggcttggtctcctcactgggggatggggccagcaccacccacacctcaaattgctggggactgggtgagctcatgcaggttgaccatctcgtggaaatactcagggaattgtggtaaagatggcccttagtgcaggggatcgtgtcgggcctacctcacgggcttcgtacgtgtcaggaaccgtgatccggtagggggcgtcggggatgtcatagtaaggctgatccttgtgaatatcctgcaagcacagcaagactccctcttccaaactgccttccccaagttgccactagcaaccacatgggccacccctacccaccacctgtctgtctgtgacaggcctccatacttgatgcaacttattgcaaaacaccaggtggatttgggccccctcacccccaactcgacacctgtagcattaattatgttcaggcttattgtcagagaagcatgccacaacacagggcggacagggccggcggggtggtggtagagcgggtggtgtttgggccctaggtctcctggggacactcacagcgctcagtgacagtgacagggtctgcaggatgtccagcatggtcttcagcacagtcccgctccagagcaagtggggaaacctgcaccaagagccagctctcaggaccaagagccaaacctccaaggaaggtctgcttctaggagccccctcagctgccagcccgagcccatatctgcttcaggccagctgaaggaggaggtcgggaggcccttgcagcaggatgcctggcctcctcaggctcattgcagtaaggtgagcaacgcctggtcagaaaggctccccaggcccctgccagccccacttcttagggccagacaaacctgacaccaactgccttggttatgcactggccaggacacccctcactttccaaagcaatcctcttagtttctgaccagggttctccattatttctcacataatggagaaaacaacagtatctacctgacaccctggggtaagacaggccatgggctccgatggccccagggctgaaggagaggtgtctctgcacagctgtgacccaccagtggcccactgctcaggaagcccagctcagacacacgccacgtgtgtgctggactcgttctcgtgacccctggctggctcctgaccacctgtggtggcgctgctgcctggaccaggcacacagtatctgcaacaggctccagaaccactggatacctctggggagctgcaggcagcctccatgtgggtgttttgctgcctctggccttctcaccttggagaagctggtccagcccacctgtgagagttctcatcagtgtggggacatgtcccaacagggtctgttttggctcccagaacaaagagtatacagcacagaagggtctgtgtgggcttttgttcctgagaagcccaaagatactgatcctaccaggggacctctggctgggccctgggctagaagatggtgcaccaggtcatgccagagtgggtgggactgagagacacagggatgtggcacccagcaaatgtgctgtaagtaacatcgatagctcagaatgaacagaagtttctgcaccaaaattcagactctgcaggaaactcacagacattggagggaggctgcatcacccttaggagttttcattctgactccattttttcctagattaataatataaggatgatttttcccagcatttgaaatcacagaagtttatatacatacacacaaaacattagcaggaaaatgagcttacttatccaccagaccagatagatacttgtctgccaccctccttatcctcttgtggatgtggttgaagttcaccaacaggaactgagcgtgccgctccagctcctcctcgttctccttggtcttggcctagagatgcaaaagaaacaggtaccgcagtgccccagatgcctccagcagacagacacgcattcatgctggagaggcttactttatccgccatcatgttcaggaaggcatcgaatactttgtccgcgactgcaatcacacactgcatcatccctgaaacgagaaggtttccatggataaggtgcagcaacagagagagaatcctagcaactttcaatcattttcttttgaaatgattttagacttacagagagtggcaaagacagcacagagctcccatatacccttcacctagcttccctggattttaacatctgcagtaaccaggctgatgtgtcaaaactgagtcagatattgatataatcctattacctaaacttcagacttcgtctggatttcccaggtctcccacacatgccccgcttctgttccagcatccaacccaggacaccaggtggcatttaatctgtgtctcctactcctgtccaatatgtggtgactcctcagtctgtcaatgtcttttgtgactttgacacttttgaagaacagttattttgttgaatgtcccctaatttaggtttgtctgatgcttgtccatgataagactagggttacaggatttgagggagaactccatagagtggatgtgccctttcttttttctttctcttttttttgagattgaatctcgttctgttgcccaggctggagtgtggtggcgcgatcttggctcactgcaacctccgcctcctgggttcacgccattctcctgcctcagcctcctgagcagctgagactacaggtgcccaccaccacgcccggctaattttttgtatttttagtagagacagggtttcaccacgttggccaggatggtcttgatctcctgacatcgtgatccgcccgcctcggcctcccaaagtgctgggattacaggcgtgagccaccgtgtccggcctggatgtgctctttctgcatcacgtaagtggtatgtgataacagtatctcttattactggtgaagctaaccttgatcccttggtttgagttaccgtttttccctttttctattttttttgagacagggtctcactttgttgcccagtctggagtgcaatggtgagatcatagctcagctgcaaccttgatctcccaggctcaagggatcctcccacctcagcctccctggtggctgggattacagatgtacaacaccatgctcagctaattgattattttttgtagagactgggagtctcactatgtagcccaggctggtcttgaactcctgggtcaagcaatccttctgcctcggcctcctaaagtgctaggattacaggcgtgagccactatgcccagtccctttctctattctttagaagcaagtcactaaggacagcccacactcagagccaaggaattaaatgctacctcctgaaggaaatttgtgaatgagaattacagccaccacagcgattgatattttggggaagatactttgaagttatgcagagatcatgtcttttaagattttgccccttcactttggcatccacgagtgaattctgcctgcagtagttactgtggttgtcataggaattttctatttccctcaattctttctactttttaaaaaatgttggccaggcatggtggctcacgcccataatcccagcactttgagaggccgaggtgggtggatcacgaggtcaggagttcgagaccagcctggccaacatggtgaaaccccatctttactaaaaatacaaaaattagccaggcatggtagcgtgccactgtaatcccagctacttgggaggctgaggcaggagaatcgcttgaccccaggagacagaggttgcagtgagctgagatcatgccactgcactccagcctgggtgacagagcgagactccatctcaaacaaaacaaaaatttattttttagggacagggtatcgctttgttgcctaggctggtcttgaactcctgggctcaagcaatcctcctgccttggcctcccaaaatgctaggattacaggcatgagccaccgtgcccagcctcttctatttttattaatagtaactggaattctgtaaggaaggttcagcctttttccccattttttatttattcggtagtctaatcattacagaaccgtggatgtttattcgttgggttataatccaataccatttattctattcaaatcattccagctttggccactcggagctctttcaggttggctcctgtgtcattcggacaggccccatgtcttgtcttttcttcttctttcttggcgtgtccttactttctggtgtaacaaggtgccccaggctcatcctgtacaggcctccctagaatcaaccatttctccatggagccctggttccttttattggagaatactatttagaaaccaagatctgagcaccggatatgctcattgttacagaggtgccaagtaggctgtaaaaggcaacagaatgggctgggcacagtggctcatgcctgtaatcccagcattttgggaggctgaggcgggtggatcacttgaggtcaggagtttgagaccagcctggccaacatggtgaaaccccgtctctactaaaaatacaaaaattagctgggcacggtggtgcacacctgttaattccagctacttgggaggctggggcatgagaatcacttgagcctgggaggtagaggttgcagggagctgagattgtgccactgcactctaggctgggtgacagagcgacacactgtcacataaaaaaaaaaaaaagaaaagaaaaagaaaaaaagcaacagaacacagtgatcatcacagtgcagatgaagaaactgtaataaaatgccaattcacactccataatgctgtttctctatccagtgtttttaatttgcatgactacatgctgggtctgccctctgcctccaggcagagagacaaggcaggtgctatcagcttggcacctcacacccagcatgaagcctgagacataaagaggcctttcatagctatctgttataagggtaagtgggaccgcagcaatttgaaaagttatcagtgtgacctggacagatgctcaagggtagtgagaggctgctttcttaagaggctgggttgggtgggtgaaatcttattttgggccatgtgtttagtataatagcttttttttttttttttaattttttgagacagagtttcgctcatcgcccaggctggagcgcagtggtgcgatctcagctcactgcaacctccgacgggttgcattcccagattcaagcaattctcctgtctcagcctcccgagtaggtgggattacaggcatgcgccaccatgcagggctaattttgtattttcagtagagatggggtttctccgtgttggtcaggctggtctcaaactcctgatctcaaatgatccacccgccttggcctcccaaagtgctgggattacaggcgtgagccaccacacctggcctagtataatagttttttcatatagttctttggaaactgaaactgtaaattcctgataatcagatagacatcagatgccaatcaatgtcatgtagtagcatctaaggagattaaaaaaaattttttttttgagacgtagtcttgctctgttgcccaggctggagcgcagtggtgtgatcttggctcactccaacctctgcctcccaggttcaagtgattctcctgcctcagcttcccaagtagctgggattacagtcacctgccatcacacccagctaatttttgtatttttagtagagatgggtttcatcatgttggccaggctggtctcaaactcctgacctcaagtgatctgcccacctcggctcccaaagtgctgagattacaggtgtgagctaccacacccggccctaaggtaagtaagatttttactttaaaaaggccactctcctcttaaccccttagtttagctctggattactggtgaactgactcacaggatggtgggcaggtgagcagcaggctcctgccctcacgttcctgtgcagctgagaacataacagaggctcatcttatacctgcagagaggaggcagaagtccccactttagtggggctgctagatatttcatataccctctcctcctggtaggttctgaaaattcaagaataatatatgtctccaaagacatttccttcttatctttcatgttttagaggaaaaatataagagggatatacactcaatagctgtacatttactggctaagtgccacgctcagaacaaaaataatcagtttgaaaccatgtggaagagtacaatgtactgcaaaaatgaaaatcgctttattttgaattaaggtgaggaggaacaatcagtcccccggaacaatttaacgtcctctgatgtcacaggaacagaaaaacagagctcagagagaagggcgaatgagacatctcacttcagaaagggatctgattcggtttatgaatattctctagaaggctggcaaaatctgctaggttctccttcctttttttttttgagatggagtttcactctgtctcccaggctggagtgtgtggtgtgatctcagctcactgcaacctctgcctcccaggttcaagtgattctcctgccttggcctcccaagtagccaggactacaggcacacgccaccgcacctggctaatttttgtatttttagtagagatggggtttcatcatgttggccaggctggtctcgaactcctgacatcaagtgatccacccacttcagcctcccagagtgctgggattacaggcgtgagctaccgcacccagcctttttcttcctttttttgtctcctcaggtcttgtctgaataatgtgctaggtgcttaattcttctagaggttggcagtttcaattttgttgttgcttagtctctctcctagaaccaaagaatcgcagggtgggccaattgtctagcacaagcttttccaatctgcagtccacacacagcccaggatggctttcaatgtggcccaacacaaatttgtaaacttaaacattatgagattctgggccgggcgcagtggctcatgcctgtaatccctgcactttgggaggccgaggcgggcggatcacgaggtcaggagatcgagaccattctggctaacacagtgaaaccccgtctctactaaaaatacaaaaaattagccaggcgtggtggtgggcgcctgtagtcccagctacttgggaggctgaggcaggagaatggcatgaacctgggaggcggagcttgcagtcagctgagatcgttccactgcactccagcttgggcaacagagcaagactctgtctcaaaaaaaaaaaaaaaaaaaaaaaaacatgagattctgtgtcttaaatgtcttaaaatattataagattttttgtgtgtgatttttctttcttttcttttttttttttttttttgctcattagctatcgttagtgttagtatgttttatgtgtggcccaagacaattctttttcttccaatgtggctcaaggaagccaaaaaattggacacccctggtctagcacaaaacttagcacaaaatctgctactacatggacaaatgcaaggtggacggatgaggggaacagatcaatgaacagttcagccagagcttgacagcatctctcttatagccccaactggtcctggggcatgtgtgtgagactctctgaatgtggcccccaccccgccctgtgtctacatcccctctggaagaggcttctctgtagaaactgcctgcctgcacctcccatccctggcctcaaatgggctccttgctcactccaatcccctccttactgccagaagggggagcttccagaaccctcacagtctttccttgccaactccactggctcccagctgcaaaaataaattcatgcacctgacttcctgactgttgtacagcagtgtgaagtgctccacaaaggacttactagaagagtcttacctgaagcagtatctcagagcccctggggcatttttttgtttgtttgttttttaagagacagggtcttgctccgtcacctaggctggagtgcagtggtgcgatcctggctcacttcaaccttgaactgggctcaagggatccccctgcctcagcccccagactagctaggacgacaggcatgttccaccatgcccagctaattatattttttgtacagatggggtattgctatgtagcccaggctggtcttaaactcctggcctcaagtaatccacttgggttggcctcccaaagtattgggattacaggcgtaagccactgcacctggcctggggtgatttttaaaaaacatttcttgaagcgttgatttttctttttcttttcttttctttttttttttttttttttttgagacagagtctctctgtcacccaggatggagtgctgaggcacgatctcggctcacctcaacctccgtctcccaggttcaagcaattctcctgcctcagcctccccagcagctgggactacaggcgtgcaccaccacgctcggcttatttatttatttttgagacagagtctcactctgtcaccaaggctggagtacagttgcgtgaactccactcactgcaagctccacctcccgggttcatgccattctcctgtctcagcctcccgagtagctgggactacaggcgcaggccaccacgcccggctaattttttgtatttttagtagagacagggtttcaccgtgttagccaggacggtcttgatctcctgaccttgtgatctgcctgcctcggcctctcaaagtgctgggattacaagtgtgagtcaccgcacccagccaatttttttatttttagtagagacggggtttcaccatgttggccaggctggtctcaaactcctgacctcaggtgatctacctgcctcagcttcccaaagtgctgggattacagctgtgagccactgtgcccagcctgatttttcaacaaaagaaaaaatggtacaagaagtatcggaaataatttctccataagcaagaacaagttgatagattcaccaacctatcaaaggcttctggtgcggaaaggactacacactgttagttgtacttcattaatactaaatttgtcaatctcaagaatttatcaataagcatgcctcaaagaatttattcatacagttaatcaaaatttgtggattctccccaattcccttgcatatttaaacatgatttcatcataattacaaaaattatcaaattattctaagcatttaattaaaacttaggtctaacatttcagcatattttaaatttttgattttaaacaccttataaatcagacttcttagtgcccttacactaaaactggccaaaaagtgcttatacgcagcatttaactttttcctttgttgtctctattttaatatctttttattggctaaatacacttttgtaaaactaatattagccttttgcaatttaaaaaaattaaggtataatttgcatataataaaatccacaggtcttatgtgctcaattccatgacttaacaactgtacacactcacgggaccactacccaaacaatctagaggacacttccatcaatccagagggtctcctggtaaccttcccagtttccatctctcctttttattcttatcttagctttgtcttcatagggttttgatcattgtaacatttttatgccttcctacagtttccaccatttctctgtcttcccaggagttggtctcctgggctagggctggtaacagctgaggccctctgtgcactcagggtctgacgacaagttgcatctggaagcaagtggcatgatcatagctcactgcaatcttgaactcctgggctcaagcgatcctcccactcagcctcccaagtaacttgggactacaggcacaaactactgtttcctgctcctgacgtttaaaaaccatgactgctctctggcaacagcaagttgctgcaggtccatcagtgcccatccgaggagccctggtccctctagatgagtgctggagcacacttgagcatagatagtgggctagaatgaccatccttctgttcggggcccttgcaccagcagtagaaccattaaggcgtatatttgaaggctatatgttttatactgatctttctcatgcaatatttaacttcataaaacattttctacatgtagacagaaaagaggaagtagtacgcctttttaccctattaaagctcaattcatcatgaaagcaccataataatgagcttaccagatttgtctttctgaatagctttatcctcaaagtagcagaacattacctggaagcgatcaggatctgttgaacgcagtaccctaagaagaaaacagctttaaataaattttgaaaaatctgggccctccctatcacagatttgacactgcccataagtggtaaggatgtgaagaacatttgccctctgtcattcataagggtgcacactgaggtggactttttggagggtgaggtgcaccatctattatacattcccatatttttcactccagcagccccaccattaggatatatcttcagggttacatgcacaaggattctcctaacagcactgactgcattatccaaaatggaaagactctgaatgctcaccaacaggagactgggcagataagccaaagcatacccattcgatgacacatcatgcagccaccaaacgagaggcagctctctatgtgagctgttacaaaaaaagtctgagacatactattaacagaaaaaaggaaggtgcagggaacacatgtccagcatgaccccacttacaggtttcctaaaggtctgtctttgcatgtgtatgtgtaggctatgcatgcttgcctatgcacagaaaatttctagaggaaaattaagaggccattaacagtaggatagtagaaatgaagtattcacgtctacaaaagtgatacctgtattttttcatctttagtatcttctgtactattccagtgttttctcttctcttttttgttttatgcactctgtacatttttcttttatggtaaaaaaaatatctttaacctcagggggaaagggagaaaaaggaaaaagcgcatgcacttgtcccatgggtgctgtgaagggctgttcagagttccaggggctccactaaggcagcagcggctcggcaggccatgtcttttggcctctgcaccaacctgtcaagagttaagcctcaggagggcaggccaggtgactttcagcacacgcattcgagtgtgcacgtgcacacacctttaacttgatttcccaaattctccactttgtggttttaaagctctctcaatacccagtggctgggaacctgagccaggttcctgaataaaggctttgaggttgcctctctatgctaacagagtgctctcaagggcctggtaggcagcccgaggtggaaggtgggctcacaggagctgctatgggctgcgtcttagagtcttcctctgccagttaagagcccgtcctgagaacctgagaaaactactcaggggcatactcatgggaaaggcagaggtagctctgccttcaaaccacatgaggttgagagggtctggagatacctcttctagccgtacatgctgggatgaaagccatgtttttgctctgtttgggtctggcttgttttgttttggctgttttttctttgaaaatacattgtttagaaaaaagactacaaacagctatactaacaggctataggggatgacagtgaggtcagtgttttttctctctctacttattttgcaagattttgtataaatgttttgtttttataagacagggtcttttgcccaggctagagtgcagtggtttgatcatagctcactgcagcctcaacctcctaggcttaagcaacccccttgcctcagtctcctgagtagctgggactacaggcatgtgccaccacaactggctaggtttttttgcttttttttttggggggggggggggttagagacaagttcttgctctgttgcagaagctcaaaacttccgggctcaagtgatcctcccacccctcaaaatgctgggattagccatttgtttttttgagacagagtctcactctgtcgcccaggctgcagtgcagtggcaccatcttggctcactgcaacctccacctcctgggtcaagcaattctcctgcctcagcctcctcagtagctgggactacaggcatgcaccaccacatccagctaatttttatatttttagtagagacggggtttcaccatgttggtcagactggtctcgaactcctgacctcaggatctgcctgcctcggcctcccaaagtgttgggatgacaggagtgagccactgcaaccggccgtgcctagccatttttgtgcaatgttctttttttctttttttttttttgagacggagtctcgctctgtcgcccaggctggagtgcagtggcgcgatctcagctcactacaagctccacctcctgggttcatgccattctcctgcctcagcctcctgagtagctgggactataggcacccgccaccacatctggctaatttttgtatttttagtagagatggggtttcaccacgttggccaggctggtctcgaactactggcctcaggtgatccactcgccttggcctcctaaagtgctggggttacaggtgtgagccaccacatccagccaaaataaaagacacttacaatgaaaaaagaacaaagtcaacactcccttggctctgtgggacttggggagaatgcgtcactgatttccacatttggctgtgtgtggagccccgggctgagggcagggaggaggagactgagcaggagggtagggtgcattcccatgcaaccaaagcactctgcctttcttttatgtattgagctttcaaggactattttactagagggttggtggcaacaatgaaaggctaaaatagtgttttccaaatagcctttctctcaggaacactttctttttcaaatcatttgggaaagaaattattctacgacttatttgcatccctcccgacttaagctgagtgtaatttgaccttttcttgacaacaggaatcatcattttgtagccaatgtactcagctgctgtcccagggcgcctgaggcctcagcacagtgggtctgtatagcactgcctacctcacaagcatgtcggggagtgcgtaaacatgtgtaatgcagcacagtacctggtacagcacagacactcaatccaagcttacttctgaggtcaacatgataacagctgtagatcctaagtgtcactaccactgttaggactgctgtggccacagatgtgtcctgagcatcgggccacatgcaggactgttttggagccggccccaccccatgtcgcatttgctgtttgtactcaaccatggtcctgggaaacagctcagtgagtgtcctagacacgcactcagcgaggctgggtcctcagaagggcctcgctcagtccgtgggctgagttcacaacactgactgcaactgctcagaagcctgtttcctatcagagagaagatgatgcggagcttagatactgggaggtgttactatacgtggtgtctggtggtcatgaaggaggggcatacgagaaaagtagagggtgtttttgcttggtttttcagaaagtttgcatgtcttgggagaagttgaaaaaagtctcatgcttacgagggcacaaaaatgaaaaccctgctcaaatgtggatgtgcatgtgcatggtggtgaaggcacgtgtacctcatgtactccagccggtacacagagaggaggtaggtggacatggcgaagtccagcttgttgatgagtgcggacacctcgggaggggggtccagcaggttgatgatagtgctgcggagctcactcagctcagcctggagggagagaaacatccgagggctcatggggcatcccccaggacaaacaggtcccagtggctggcaacatgtgttaataatgacagtgaaaagatctgccctaattggcacagagagcatggtaaaaatgagatgtgaatccttacgggggtgaccgtgtcattcttcatggctgagttatactggaggacggaccgcagtggctccttgctgggaaaggtgagcaagggggacttagtggctatttcacagaccccctcgtaccattcttctggccagagtcctgcaataaagtgaacataaatgaggaaatcaccttggtcggaaagcactgcagtgaggttgactgacaatttctatagtcatgggtcctttgagacaattatcccaaaaactaggcacagaaacgaagtctgttacctgacttggacagacttttcctaaggtgtatggcattctcagcaccctaaactacatctggggacagtaacacttgctaatacttgcagaaagaagcagctgcatgtggactcatttaaacatgctcacattcataattacgtgggctctgacctcacctttaccttcactctgcactccgtcttcactgggagagagatgatccccctacctgagccctccacagcgaatcccatcagaacggaatacagccagaagtctcggaagagcttctgtaaccgaggcttagcttctttgatgggtggcagtcgtcgggtgagctgatgtgccaagaagagagggagaaaggaggttatttgctgaggaaaccctaagccctgtaggtgtaaaatcaaccacagattcattctctaagagcattctcagaaactcagactgggtaggaaaaggcacactgagcagtgatgattctgccaataagcattgtccatccactcatttactgagtccctagtgtgcaccaggtgctgtgccagggaggaaaaagccctgttcctgcacttgaaggacttcctgtctagtttggaggcaggtgagcaacagttacagtggggtggagttcccagagaaagtgtcatgggtctcagagttaacatttgaggaaaacttagccaggaaagaagagaaggcagcctgtccagccacaagagcattaggtcctaagcctggcactgtggagggtaacaaatgctcaggaaaggcaaacaatggatgcgagccagagcttgaggaagggatgccactggggaggcagggagagcacaagaactctcatgggccaggcagcacaaattttccaaacagtaatcttcggcagaatccccatatatgtaacaggtaaagcagagttgcttgggtgcaggtgaggggctattgtccttgtgttcctgctccaaatgctggggggaggcagggagagactcatcagtggtataaatggctaaacttggccaagcacggtggctcacgcctgtaatcccaacactttgggaggccgaggtgggcagatcacctgaggtcaggagttcaagaccagcctggccaacatggtgaaaccccatctctactaaaaatacaaaaaattagctgggcgtggtggcaggcacctgtaatcccagctactcgggagattgaggcaggagaactgcttgaacccaggagacagaggttgcagtgagccaagatcgcaccattgcactccagcctgggcaacaagggcgaaactccatctcaaaaaaccaaaaggtttaacttgtgcacgatgcccagctggacaggctgatccttacggaccccccagtggatgttgagctcccatcagtgatgttgagcctgtggtaagcgggggctttgctacccccaaacacttatgagcacctggtatgggccaggcactgggccgggagagaggtgggagagatgaagacaccatctcttgaggcaaggagggcacaatgggatgggctgtgacacatcatgcacagcaggcaggactgtaaactgtcacaacacttctttgaaagcaatttggtaatatgcatcagaaattctaaatatccccacatatttcacccaaaatcccatccctgagaaatctatccaaaaaatgttaaaaagctgatttaggcacaaaaatgttgcaacagcaaaataaatagaaacacactagatgtctacctgaaagggacatttaaataagtaatggtatattaaaagtataataaattggccgggcacagtggctcttgcctgtaatcccagcactttgggaggccgaggcaggtggatcacgaggtcaggagatcaagaccattctggctaacagggtgaaaccctgtctctactaaaaaatacaaaaacattagccgggcgtggtggcaggcgcctatagtcccagctactcaggaggctgaggcaggagaatggcgtgaacctgggaggttgagcttgcagtgagccaagatggcgctactgcactctagcctgggcgacagagcaagactctgtctcaaaaaaaaaaaaagtataataaattaattatttttgagatagggtctcactctgttacccaggctggagtgcagtggcacaatcatcactgcagcactgacctcgatctcccaggctcaagtgatcctcccacctcagccttcccagtagcagggaggacaggtgtgctccaccatgtccagctaattattattttatttatactttttgagatggagtcttgctctgtcgcccaggctggagtgccgaggcacaacctcagctcactgcaacctttgcctcccaggttaaagcaattctcctgcctcagcctcctgagtagctgggactacgggcatgcaccactatgctcagctaatttttgtatttttagtagagatgcggtttcaccatgttggccaggctggtctcaaactcctgacctcaagtgatctgcccgcctcagcctcctaaagtcctgggattacaggtgtgagccaccacacctggcctaattattattattattattattattattattattattattatttccaattcaaaaattttaatttaaaagtaaactttaatgtcaaaaatgcaaacttggggaggggagaaagatcacacgcaaagctgccacttcacacttgcagggctgcacggcagctaggcaaaggtgttcctcaattcccagacggtgcggcggccagacagaggtgctacttactcacttcccagatggggtggtggccaatgcccggcttaattattgtttttctttttttcatacaaacagacaccttactgactttttacatttttttgtagagaaaggctctcactatgttgcccagggtggtattaaactcctaggttcaagagatcctcccgtgttggcctccccaagtgttggaattacaggcgtgagccaccacactcagccaagaatcatattttctaagactatttggtgacacatgtagaactcacaatatgtcaagagaaaaaaatccaaaacgtataaataatatgatatagattttaaaaaatctaaatatatacatatagaacaaagatgggaaaaagcagccacatgttaagattatttctgggttgctagggatttcactcttcttctttaatgtctatatttcctggagctcttccatcaacatgttccttttacaatcaaagggagggtgcaggtgccggtccagggcttggcaacctgtgtggaagaaggctccacacctctgcttgagagccgccagggcactgtgtccttgggaagagtgggccaagacctgggggtgcagggcaggctctgggtaggtgctgaggaggtggggcactttggagagggctgtgtggagggcagcagcagacggaagcgacacagggcaggaaatctagagccacacaggatgtggccacaaaaggacagttgacaaggggcttccagttcagctagtggccaaggacagtgacagtaagaacacgcaactgtgggactgactgtctctgaagtgaccggcctcccaggataaggtcccaagtgatggtggagatatgaaggggtttccagactacagaattcaaggcctatgtggctaagaggttctggtaccttctaaagagaactagactttggtggttatggaaagggttgcgcttctagaatgcttccctctcaatgagaacagtagctccacgtggctgggaagttcaaagtggttttgacacagaaaagaggaagtaagtggactctatctttgatttgggatcctactcctgaccctgtgaacttcttggctccctcttgaggacgttggcttgaaagtggctctgtgggttctccctgctctctgacttctccgagcctgctggccactgtcttggctgagactgctctagtctccagaaaggagatctgctcactcctaagaagtatcaaggtcaggccaggtgtggtggctcacgcctgtaatcccagcactttgggaggccaagacaggcagatcaggaggtcaggagatcgagatcagcctggctaacacggtaaaaccccatctctactaaaaatacaaaaaattagccaggcgtggtggcacacacctgtagtcccaggtactcgggaggctgaagcaggagaatcgcttgaaaccaggaggccgaggttgcagtgagccaagattgcgccactgcactgcagcctgggcgacagagcgagacgccatttcaaaaaaaaaaaaaaatcaaggtcaggggggaagtgggaagactgaaatagataaaggattctaaagagatataacagtcaaatgcgacacatgaaaccctgaccagataaaaattaaaaacccataaaatacatgtttgaagtcatagagtaatctgacttggactagacatgtgatatatgtgaggcttgtgatcttcccaggagtgatggtagcacagcacagggcagagacccgtccatggaagaaacactggtgctagtgcccagggcagaagtgagtgatgtctttaagtggatatggaaaaatattaactattctacctaggttgtgggtgtatggatatttagtattcaattattccaatttctctgtgtatgtatacatattttttttagagacagggtctcactctgtcgaccacactggagtagggggtacaatcatagctcactgtacatactcaagtgatccttctgcctcagcctcctgagcagatgggactacaggtgtgcagcatcatggcccagtttttttttttttggtagagatgggttttgctagccgggagcagtggctcatgcctgtaatcctagcactttgggaggctgaggcgggcagatcatctgaggtcaggagttcaagaccagcctgggcaacatggtaaaaccctgtctctactaaaaacacaaaaattagccaggcatgatggcaggcgcctgtaatcccagctacttgggaggctgaggcaggagaatcgcttgaacccaggaggcagaggttgcagcaagctaagattgagccactgcactccagcctgggcaacagagcaaaaactccgtctcaaaaaaaaaaaaaaaaaaagagagagagagagatcggttttgctatgttgcccaagctggacacggacacacacacacacacacacacacacacacacacacacacacacacacacacaagctggacacagagacacacacagtgacagggcaaaggttccaaaattttaaacctggtaaatctgggtacgggtatacaggagttgttctactacactattctttcaacttttttgaaagtttgaagttatttcaaaagaaaaagttttccaaactttagtgatcctcctgcctcagcctcccaaagtgctgggatgataggcatgagccaccgtgcctgacccctctgtatatttttagaatttcatgttaaaagatggaaaagtctggatgaggtagttcacgcctgtcttcccagctctttgggaggccaaggtgggaagactgcttgaagccagacgttcaagaccaacttggccaacatagtgagaccccgcttttttctaactaaaaaaatttttttccaagttggaaaaaatatctagccataagacaaaccttgaaactgcaaaagaacaatggagtatgtgtgacaggaggtactgctctacagtggggttaaagccatacacaagctgtggtggctcacgcctgtaatcccagcactttgggaggccgatgcgggcggatcatgaggttaggagttcaagaccagcctggccagcatggtgaaacccgtctctactaaaaatacaaaacattagccagacgtggtggtgggcacctgtagtcccagctactagggaggctgaggcaggagaatggcgtgaacccaggaggcggagcttgcagtgagctgagattgcgccactgcactccagcctgggcgacagagcgagactctgtctcaaaaaaaaaaaagccatacacaagctgttaccactaaatgggaaaatgactgaaaaatgtcaatgtcaagagggactgaaatcaaatttttccaatagtgggttacatgatcagaaatccaaatagacaggaaatatgttggctttatttatttatttatttatttatttatttatttagacagagtctcactctgtcacccaggctggagtacagtggcatgaactcggctcactgcaaccttcacctcccaggttcaagcgattgtcctgcctcagcctcccgagtagctgggactacagatgtgtgccaccacacccagctaatttttgtatttttagtagggacggggttttaccatgttggtcaggctggtcttgaactcctgacctcaagtgatccacccgccttggcctctcaaagtgctgggattacaggtgtgagccaccacacctggccggtactggctttaaaaataacaaaagtaatacatacacatagaaaaaggtcaaacaaagaagtacatagaatgaaaaatgaatgctgtgtcccctcccagaccatttctgtgaataaatatgtaataccatgaaatgatgaggactaacattttctgaatgccaggcaccactctatgtgctttccacacattcattaacctcatttaattttctcatttaattaatgagataaattaatgtatctcatttaattttcacaacaacctcatgcagtaggtgtaactgtcaccctcatttcagagagcagaatactgagagctggaggccaaggggcaatttcagccagggtggctggtgacgcctcggtgaaaccaagagcgaacagtgagagcagcggccacctgctggtctgcagggatggtgtcctgggcagaaagaatagcaagtgccagggctgtgctggggccgggctttgcatgtgtgagaacaagacagagaatgagggaggtgggcccacgaggagtgtgggcacagacagcagcctctgcctgtggtgccacgctgaagactcagtattgtatgtgacagatgaaggctctaagaagacagctctgacaaaagctagagtgcaaaatcagactcagacacaaccaccggtctgtgtcctgaacacaatggacctttacactctggaatttctcaaacggagcaatgcacagacacccccatgggccccttgcacacccgcagattctcctaggagtcacattctctcttcagatagactctgggtgccgacactcccaaacatgctcttgaggagcagtctctgtgataagctgatcttccagacaatccagaatattcttaaaactttttagatcataaaatttaaaacacaaattaaaaaacaaattatcataaggccgggcacagtgactcatgcctgtaatcccagcactttgcaaggctgaagcaggaggatcacttgagcccaagagttcaagaccagcctaggcaacatagtgagaccctgtctctacaaaaaagtcaaaagttagctagacatggtggtgtgcacctgtattcccagctacttgcagggctgaggtgaggaggattgcttcagctcgggaggttgaggctgcagtgagccaagatcacgccactgcactccagcctgggtaacagagtgagaccctgtctcaaaaaacacatagggccaggcgtggtggctcacgcatgtaatcccagcactttgggaggccgagacgggaggatcacttcactccaggagttcaacaccagcctggccaacatagtgaaaccccgtctctactaaaaatacaaaaaattagttggacatggtggtgtgcgcctgtaatctcagccactcaggaggctgaggcaggagaacgcttgaacttgggagacagaggttgcagtgagctgagatcgcaccactgcactccagcatgggcagcagcgcgaaactctgtctcaaaacaaacaaacaaacaaacaaacacccataaacacaaaatgtatcacagcctcagagatccccacgaatgcctaagtggccctgaatttgggaggcactgctcagtaatagtcctatctgtcccacaacagacaggagtgctgggctgcacctactggcaacaaacacagcaacccttgactgaagaaaggtccatgccacaatccccttattctgtaagccactaattttgtcctctctcctccacctttcactgaggaacgagctcttggaaggacagggacacccgcctagtagctgagccagccacatcagtcctggagagcaggtggagggcagatgctgtgatcatcccagaagagaggacacagttggaggcagatgcatggtctctactttcagctaccctcaatgcagcctggtccccagaggcctgaagagcgccttgtttatgtggtgacctcaagaggggctgctcctgcaccaaggctatgtgtgcatgctaacacagtaaccgtcatatactcaaagtgtcagctctaagaactggagatgaggagctgcaagccactctacagttatcaaaggcacagctgagggggtttgtgctgaccaagctggttgcctggtgtttggattgggacttatttactttggaaaatatgcagcaacagcccagcaccaaagttcacatcaaaatcccactgatgaccttggctgctttcatctctgaagcgccacttctcagaaacacagaggtaagttgggtttctaatgtttctgctgattataaattatttttggtgtttacggataggcaactggttcatttttctagcaaactaagaattcagaagctttctacactgttttagaagtgggaaatggtttcatttttcagtgtgcctattataaaattgtgtcagttccattgttgggagagttgacaaacttagaataggagctgtggaatagatgaaaatattgtacttatattaaattaatcgaattggataactgtcctgtgattatgtatgagaatatccttgctcttgggtattttccctgaagtattagtattaaaggttagaggggccgggtgcagtggctcacgcctgtaatcccaacactttgggaggccgaggcgggtggatcacgaggtcaggagttcaagaccagcctgaccaacatggtgaagccaagtctctactaaaaatacaaaaattagctgggcgtggtggcacgcgcctgtaatcccagctactcaggaggctgaggcaggagaatcgcttaaacccgggaggcagaggttgcagtgagcggagatcgtgccactgcactccagcctggacaacagagttagactccgtcaaaaaaaaaaaaaaaaagaagaaaaaagaaaaaatgttagaggaacaagatataggagacctactctcaaatggtctagaagaaaaaatgtgtatgtgcatgcctgtgagaacacacacgtacgtacacacacacacagataatgacagggcaaaggttccaaaattttaaacctggtaaatctcggtacgggtatacaggagttgttctactacactattctttcaacatttttggaagtttgaacttacttcaaaataaaaagttttccaaactttaggcagttacttctctcccattctgcctgctctgttgggcctggagaccatacaccaggagggatgacggtttatcaagtgttatgctctgatgcgtgactgaaaaggccaacccagctctggcaattagcaagaaagcacaatatgaagttcccaggaaaaaaaaaaagcaaaacaaacttttgaatgatttatctttaaaatatattgtttctcttcaaacagtaatctggatttaatcacaacctagtgatagtttttaaacgtcttctacaatgtttgttatactaaatagcaaaacatcaggaagatttaccttcagatctttaatttcaatccataaaagatatcagagatattttctccttcctctggtaagggaatgacgaaaactatttttggctttttatcagataatgtgggaacagggtataagaagtttccaaatataacttctgaataccgggataaaacatgcatgtctttactctgccactctatctggcctcagatacgttttcctgaatgcttatttattcaagttggtttttgttttgttctttaaccttatttttatctgagaagaaaacattttccccctttgttccttcttcttttggctttcttttttaaaatagagatgaggtcttgctatgttgctccagctggtcttgaactcctgggctcaagcgatcctcctgccttggcctcccaagatgctaagattacaggtgtgagcccctatgcctggtcttcttcttcttgatcttagccaaaaggccaagaagtgataagaggaggacacttgaagtgtagttgggcaaggagccttctaccagctgcttactttctttgttcctgacttttaaaagtgtgttgctattgatacacagtctcctgatatgtaaaatgctgggaggatgaagctaagttactcaaagtgccattcagaaactgggcccagttctatttgcagctacatacattagaaatcatttctagaggctgagcatggtaactcatacctgtaattccagcactttgggaggccaaggcaggagaattgcctgagctcaggagtttgagacctgtctgggcaacatggtaaaaccccatctttaccaaaaacacaaaaaattaactgggtttggtggcacacacctgtggtcccagctacttcaaaaggctgaggtgggagggtctcttgagcctgagaggaacaggtggcagtgaaccaatattgtgccactgcactccagcctgggtgacagagtgagaccccgccgtctcaaaataaaaataaaaagaaatcgtttctagaaactgttttcccgtgtgtaaactagtggcactgcagcctgaggcaggtgctgagatggggacctggaaaaggcaacaggcattttgagtcagaaacaatgtgactttcctgctccaaaatgtgcaattcaaaagtctttcttagttgtgactaaaacaaactttgaacttactatttcaacagtattataaggggaagacccaaggaatgggactggcactgggaaaacagctaggaagctgctctgcacggccagggagtctggaagcatcctggtactccagagcgaacaaggctgagcgcttgatgtggggcttagaggcttaaccaacttggttcgaatctagccactgccacttattagtgacagtgacgaaaggctcagtctcctgatatataaaatgttgggaggatgaaactaagttacacgaagtgccttatacagcgtgtcaggcatccaacagaggccattatcaacattaaccacactgacagcatttcaagcagagtatccgaacagttaccccatcttcaggcctactgagttcaaatatttgcttaacaagagcagccagtaactcttacctggcctcaactggcagcagatattctgggcctcaaatatctatctaataggaaatggtcacagacacaaaataagcttaacaaaaggcagtttttttttgttttttttttgttttctgttttttgagataaggactcactctatcccccaggttggagtgcagtagtggcgtgatcacggctcactgcagactcaagtgatcctcctacttcagcctctcaagtagatgggaccacaggcgtgtgccatcacaccaggctaattatttttcttttcttttttttttttttgagacggagtttcgctctttttgcccaggctggagtgcaatggtgcgatcttggctcaccacaacctctgcctcctgaattcaaacgaatctcctgcctcagcctcctaagtatctgggattacaggcatgcgccaccacgccggctaatttttttgtattttttgtagagacagggtttctccatgttggccaggctggtctcgaactcccgacctcagatgatccgcccacctcggcctcccaaagtgctgggattactgacctgagccaccgcacccagcctatttatttaatttttcacagagatgaggtcttgctatgttgcccacactggtcttgagctcctgggctcaagtgatcttcctgccttggtctcccagtgttgggattataggcgtaagccacagcgcctggccggcagttctttctggggtgattagaagttgggaccatgtattacctgtctgagtcagcattataaacacctatggtcactgtcctggcaaaacatggaatcatcaaagctcatctaaccagagtgcagttaataaccaggaagtaagcaagagaaagacaaaggatttggcagtcaaaacagatttgacaggccaagtcagatcctcctctgaacgagtcagaggaacaaataaagacaggattgccataatgcctctgtgctaaaagcttatcttgtttacttaaataaagggagtgcccctcaggtcttgagtaagagcttgctgacatcaccctcacacagactttatctcttgtttctaaccctgtgttagaagcagtaacacagaagatttagttgctcctgacagcagtgggagctattgtctaagagatacaaaggagaaaaaagtatacctgcagcaagtgatatcacctctggggctgccaccacatcacctcactacgccctgagggggtctcagcactagacaagttccaaatcttttgcaaattaaacaaccccaggtcaggcgtggtggcttatgcctgtaatcccagcactttggggggctgaggtgggtggatcacctgaggtcaggagtttgagaccagcctggccaacagagcaaaaccccatctctactaaacaaaatacaaaaattaaccaggcgtagtggtgtgcacctgtagtcccagctacttgggaggctgaggcaagagaattgcttgagtccaggaggccgaagttgcagtaagccgagatcgcgccactgcactccagcctgggtgacagagtgagactccatttcaaaaaataaaaacaacaaaagccaattacaacaacaacaacaaaaaaacaacgaattaaacaaccccaaagattgcacaaatttcaagtatctttagaatatgttttcagaaagcctggcccatggacatttttcaacagcatctccattgcaaaggtggaatggtgtgagtcacacaggcatggctgagtcccactaatgcacatcccttctaggtactctccaatcaccagccccaggtgcccactcaagcccagctcttagtgaggtttccctgactctctgggcacttccactcctaccacacagggtagagccacacccctttccgtacccccatgtgctctggcagcattattttgagagccttcgctttactgcacgtctgtcccatctgtcccctgactggtccatgagcccctggtgggaactttgtctctggtaactaaacactgtctggaggtggtggacaaggtgtctggagaaaaacaaactcctccctgggatgcctgagctcccaggattctagaaggttagttttgcaaacctttaaagaagggattttcatcaaggggcccacagatccttcattgaggtttatgagtcccacatcaaaggttgggtgtctatctacatcagattctcttaaagtccatgatcctaaaacagttaagaactaatgctgtgagggcctcttcctgggtcaaagccacagggaacctgccatgtggatgctgcagcggggtgtggatcagccaggccgcctttcactgtgttctgttttccctcccagctttagctccgccaaaatgaaacactcattaaacgcacttctcattttcctcatcataacatctgcgtggggtgggagcaaaggcccgctggatcagctagagaaaggaggggaaactgctcagtctgcagatccccagtgggagcagttaaataacaaaaacctgagcatgcctcttctccctgccgacttccacaaggaaaacaccgtcaccaacgactggattccagagggggaggaggacgacgactatctggacctggagaagatattcagtgaagacgacgactacatcgacatcgtcgacagtctgtcagtttccccgacagactctgatgtgagtgctgggaacatcctccagctttttcatggcaagagccggatccagcgtcttaacatcctcaacgccaagttcgctttcaacctctaccgagtgctgaaagaccaggtcaacactttcgataacatcttcatagcacccgttggcatttctactgcgatgggtatgatttccttaggtctgaagggagagacccatgaacaagtgcactcgattttgcattttaaagactttgttaatgccagcagcaagtatgaaatcacgaccattcataatctcttccgtaagctgactcatcgcctcttcaggaggaattttgggtacacactgcggtcagtcaatgacctttatatccagaagcagtttccaatcctgcttgacttcaaaactaaagtaagagagtattactttgctgaggcccagatagctgacttctcagaccctgccttcatatcaaaaaccaacaaccacatcatgaagctcaccaagggcctcataaaagatgctctggagaatatagaccctgctacccagatgatgattctcaactgcatctacttcaaaggtaagaggcacctttacagttctcacagcaaacccacaacatactatttttgtatgtgggtagattgaatgccaagaactgtactgtagctataatttatccaggaaaactagacacaagattgactctggaacggggacagggaaggccaagctgaagtgacagtagcatctgacacttactgagccctaactctgtgctttaacacagccttgtgaggtcatcactgttattagcatccccattttacagaggaagccaccaacacatgaagtaaaaggatgggctgggcgcggtggctcacgcctgtaatcccagcactttgggaggccgaggcaggcagatcacttgaggtcaggagttcgagatcagcctgaccaacagaccaacatggtgaaaacctggctctactaaaaatacaaaaattagctgggcctggcggtgggtgcctgtactcccagctacttgggaggctgaggcaggagaatcacttgaacctggaaggcagagattgcagtgagccgagactgtgccactgcactctagcctggacgacagagtgagactccatctcaaaaaaaaaaaaaaaagaagtaaaacgatgctccaagggcacccagttattaaggggcagagccaaagctgaacccagggaggccaaccctagcaatctgttaaattggaagaaataatacaaaaactgttttagcatttggccagcctggatttgagttttctcttttcctttcccaattatcaataagcaggaatatagacaaaaggctaaagaaatgcacctgtgaactattcagcttgagcagctgacattgacacctacaagtgcttttcaggatacttttgaactactgggcaggtgggatggagaaataaattactatttccccagcaactgttctgggctgagcacaagggcactttttaaggaggtcaccccacacccatcacacacacataggacccctggaatcctaggaataaataagcatggatttgtaaaatccaaacctctcttttcaaatatcctcacctggaccagaccagaagaaacctctactttactctctaagctgagagtgtggaaggggaaacacgaggaatggttcggcttcaggactaattgcggtgacacacaaccacttctctttgccaccaaggactaccaggtacctgcaaagggcagtacttggaggccagtgctttctgctagttagctcccgtggttttatagcagcccaggcgaaggaaggagaccccccccagctcctggcttctgttcagggaaagggggccagagcccctcctgatctgtccacacacctgctctgtgccttggctgaggcccctgcagctctacaaggcaggcattctgctggataggccaagcagggtcactctgacacccaggtttccaccccaaggcatggcacaatgctggcctcctgtgggtggaatcaaaggctgagttctaacaggcttgcggcagacacacacacagagaccacatgtacatgatgaacacacatatccttttcattacaggttattagtacaagttttggaattgagcaaacaagagtctaagcgctggtttcaccacttctcgtttgtgtgacctcagacaagtcattcaacatctctatgactcagtttccttatctttatcacagagatgacacccactctgacagggccgagggaagaaccataagcgatggcaatgcaacagagtggcacatgacaagagctcagcgaatttgagggaatgaaactgtagattacaatactagtacaatatgataaacatatgatattgttagtgacatttattttacttctactagcaaataacctatgtttaggactgactttagaacaggctggcagaagcatttttggcagcatcaaagtcctccaacctactggtctgttggagccccccaagtacaccaaagagcctctgcattagccctggctgagggttcagggacaggcagagaagtacagcagtgagccatccctgcctgcatggaggtggagaaatgatcaggcatggtcagttgacaatctcctaaacacagtaacccgtgtcataccacagtgtaaacacacgtgcaaatgcttctgcttcctttccccatcatgagaatagtcactcaatgccgggcatcacaagggatcaaatgctaggagtacccaatcattcatggatgcttctcaaaggggacgagtgtctagaagtgtaattttaatttcacttaatttcatatggaatcatctccattactaattttgttctaattttaatgtgataatcactttgtaaagcacaataaacagaggcaggctctcatgaggaagtcagaaggaaagaatcccaagagacatgggacagctccatccaaactgaaagggccgtgattcccaaaagagcaattttgtccccaaggtctgaagacacttttggttgtcacaacctggggggttggagtaagcattactggtatctagaagggggaggctggggatgttgctaaacaccctaccatgcacagggcagcccacattgccacaaactattatgtggcccaaatgtcaaaaatgctgaggttgagaaaccctgggtgaggcagactcagggagaagggaatcgagcttcactcacaggcaggcaggagctgtctggtacttcaacctccaagacacctcctgctcatctcatcctggctgctctacccaccagctagaaaccttgaacaagttacttcacttctttgtgcctctgtttcctcatatgtaaaagagggataacaaaacgcacacaacttgcatgttgctaggagcagaaatgagataatacaggaaaggtgctgagaagaatgcccggcacatggccagttctcaactactagtcacccattactattagttactcacatcttagagctaacatagacatgggcttattcctggatacacagcactgtccccatatctacagtggtgatcctaagggcaacatggcatcacccaaatgtcttgttagtcactacagaatcacagtgtgagggatgaaggccatcaagacagagctgaggctggcagggtggctcatgcctataatcccagtgctttggaaggctgaggcaggaggattgcttgaggccaagggtttgagaccagcctaggtaacatagcaagaccccatctacaattaaaaaaaaaaaaaaaaagacagaaagaaaaaatagccaggcgtggcatgtgcttgtagtccaagctactggggagggaggctgaggcagaaggattccttgagcctgggagtgtgaggctgcagtgagctatgatggcatcgccgcactccagcctgcatgacacagtgagacctggtctcaaaaaccaaataataataacagtaataaaagctggaaagagctcaaagttactcatttgacagatgtgacagatgaagaaatagaagcgagttaggtgccttaccatggtcaaacaactagttcgtatcagaccctactccagaaactattccagtccgggtaacctctcgttaacctctcttgttagaaatgcaaatttctgcccaaatcaggcctcaggaatcaagagactgtggggtcggctctgcaggctatctgaatgaggcctccagggaaatcagattcactctcaagggtgagacgatttccctaaaggaaccttctcataacagcctcttcctgtggcctttacaggatcctgggtgaataaattcccagtggaaatgacacacaaccacaacttccggctgaatgagagagaggtagttaaggtttccatgatgcagaccaaggggaacttcctcgcagcaaatgaccaggagctggactgcgacatcctccagctggaatacgtggggggcatcagcatgctaattgtggtcccacacaagatgtctgggatgaagaccctcgaagcgcaactgacaccccgggtggtggagagatggcaaaaaagcatgacaaacaggtatttcacactgtgtgtttgttcttttgagctcccagatgctgggggtgtctgggaatactggaaaatggatcatttttttaaaaagggagaattatgtacaagtacccaagaacttccatacagggccactctgttaattcagccccaatttgttgcttgagataagagatgattagagagcattcataagggacacatctgccctctaggggccagtttcagaagttagaggcagatgacttagagacagcttggtgcttgctttgtggcttcgagtcccagcttcatcatccctaaaatgggtataattccattacttccccgggtcacttgagaaaataacagaatcagcgatgctgagcgcccctcccagtacttggaacctaggaggcactcaaaaaaagattggctcaactcttccctgcccaggaaattccaaggtcctcttagcctaccgaggacacatcattcatgatttcctctattattattcgttactttgtagttaaaactgcaggtgttaagtacttattgagattattattgggtcatggcagaaagaatggagaggtcttatttctgtcttactggatactggctaggcccatatgaagaagtgattctggtttgaacctccttataggacaagaatacaaacatatgcaaccaaactgagaaaagtaggctctcagaggaaggtatttgcccgggtagccagtcatcatgctctgtgaatttttccttaacaacgtcccttctgtacctgcctccttccattcctccctgcagcccggcagctcttgagaaagggactgcatcttttttttttttttttttttgagacagggtcttgttctgtcacccaggctggagtgcagtggcatcatcatggctcactgcagcctcaacctcctgaacttaagtgatcctctcacctcagcctcctgaatagttgagactacaggcgtgcaccttcatgcccagctaattaaactttttttggtagagatgaggtctcgctgtgttgcccaggctggtcttgaactcctggcctcaagcagtcctcctgccttggccttccaaagtgctgggattaacaggcgtgagccgctgtgcctggcccatttgacttttaattgagatcttacttggtgcaaggtatgagctaggtaaaagagtgaagaagatcaagccttcctgcccatccagctgggattgcaccttaaatctctttatcccctgcaaagtgccagactaactccacaggcactactgttgctatccgcccccttagggattgagtaagttgaggcaaagattgagaatattcagcattgtctagtatatacaggaaaggttctttttaaaagtacactaccagatattcgactccttaattacaaaaaaaaaaccaaatgcctaaaattgggaaaccaaaccagagaattattttagatgcctttttaaaccataaaccaggaaaagttctgctgctaaccttgaagataggaaacgaaccatacagtctcaaggaaataatcatgcaacagaaaacacacctcagttttcagtagcggaattacaaaggagtgtgcttcctaaaatcctcaactgacagtcccggaatataaattttaataagtgctatatcaattctgtgataaatataacccgtggccctttaaagggaaaatcatgattcttttgtaacttgtggttcaataaaactgggcccccctttccttttctgtctagaactcgagaagtgcttctgccgaaattcaagctggagaagaactacaatctagtggagtccctgaagttgatggggatcaggatgctgtttgacaaaaatggcaacatggcaggcatctcagaccaaaggatcgccatcgacctggtaaccactcccttgtccacccccgacccgtccccagggtctgcctcagcacagccccacctccacttgcccttcctacccaccccccaatctcatgtcccagcttggggtgctgagtctgctcttcggcctgggtgggatacacagaatgcctagtttcatggatgccagctggagagcacggcacctggcagacacttactgggcaggggggatcccaagagcagccatggggtgagccccactcccgctgacaccagagacaggggagacatgtgctgcggtctgggaaatagctacccccagccaaatcatgaaagagccattaaacaccgcactatacacatacttaacttaaaccaatcgggcgctcagcaaaagagagagaacaccagtccaaacagtgcagcagacccagttccccatcccggagaagtgcgcagcagtgtggggagctggagctggggtggctgtcctgcaccagcccccacgaccctcagaccacaggcactgccaagagggaacatgaacctagccggcctctaagtgcaacggctgcccctgacaggtggtgacagatattttcaagagtgactctgaccagctgtgatttccaccttacatgttgtctttggatcctttccctgaatgatatgagattgtgctgggaactctagccctctgtgtgctgacctccagaatctgacaactttcctttccaaacagttcaagcaccaaggcacgatcacagtgaacgaggaaggcacccaagccaccactgtgaccacggtggggttcatgccgctgtccacccaagtccgcttcactgtcgaccgcccctttcttttcctcatctacgagcatcgcaccagctgcctgctcttcatgggaagagtggccaaccccagcaggtcctagaggtggaggtctaggtgtctgaagtgccttgggggcaccctcattttgtttccattccaacaacgagaacagagatgttctggcatcatttacgtagtttacgctaccaatctgaattcgaggcccatatgagaggagcttagaaacgaccaagaagagaggcttgttggaatcaattctgcacaatagcccatgctgtaagctcatagaagtcactgtaactgtagtgtgtctgctgttacctagagggtctcacctccccactcttcacagcaaacctgagcagcgcgtcctaagcacctcccgctccggtgaccccatccttgcacacctgactctgtcactcaagcctttctccaccaggcccctcatctgaataccaagcacagaaatgagtggtgtgactaattccttacctctcccaaggagggtacacaactagcaccattcttgatgtccagggaagaagccacctcaagacatatgaggggtgccctgggctaatgttagggcttaattttctcaaagcctgacctttcaaatccatgatgaatgccatcagtccctcctgctgttgcctccctgtgacctggaggacagtgtgtgccatgtctcccatactagagataaataaatgtagccacatttactgtgtatctgttataattctctattttttgaagctcaaatatcaaaagccaaatccaaattcctggataactccaggtatgataaaggctgagaggaagtcacttgagcaccacaatgtgccacagcagggcatgttctcaggacaggacaggtgtgtgctgaatcctggggagggtctgtgcagtaccccagaactgtggggtgctaagtggcacacaagccccagggctcccacagtctatgccaggctgctgcagctttcatccctcatacctggtcctgcagtgggtctggtttgacagagcagatgacacctgaggaatatgtttctggatccttcaatccctgggtaagacaagtgaaatccacagaggctgttcagcacgcaagagtgccagtgctctttcagtgaggggatgactgacggtcacaggtgctgtgtgtgcaggtgtctaactgtaacccccacagcctggcagatgaggaagacaagggttggaagagttctgaaacctgtccaagatgctgaagtagtggggctgggttcaagtgcaggttggctggactccagggaccacacaaggagtcctgtcacaggcttctgaccccatgagaccaataccagtaagaagagtggtaaaagggagtagggacggaaggggaacgtcactgccctttgtaggcatgcctgtgggttatctcacagagtctccttaccctcaatccctagggggctggcactgttacccctcctttttacagctgcagaagcaatttcagctcacagaagggaaggcctctgcctgaggcctgaatccacacccaggcagggggaccctgcagccctgctttcccctgctcccttcctgacttcccacactgggctctgcctccttactctgctgagagcagatggtgcaggggctggatgaattgccccaagccatcctctcggcttcctggtgaaccctgatgctgcggatggcccactccttcaattcattctccaatctgcttcacccctcttcttttctgtcattctccaaactgcttcaccactcttcttttctgtcattctccaacctgcttcaccactcttcttttctggtgcctgtcctatatttctcatcttgctgcagcttccttttggctcttctcatttctaaatgtaataatctcaaaaaacccttttagtcctttgccatgtctgtcccatacccagaaaggcagtggtcacttctgctcacccagcgccctctctgctacagccggtgtggagtcctccacactcttgagcatccagacacccccgtttcaatgccttttgttcatgtacacccactcagaatctctcagatcccctcttacagaaactagcccatctgttactcaaagcaggagagtactcattcagaacacaggctctgagccaggctgcctggtttgaatcctggctctgccatctagtagctatgaaactctagtagcaggttctgtgcctcagtatcctcatctgtaaaatggggagaccagcagcacttaccttgagggattgctgtgaggattaatcaaattaatgtctagaaagcatttatttatttatttatttattcatttattttatttttttgagacggagtctcgctctgttgcccaggctggagtgcaatggcacaatcctggctcactgcaacctccgcctcctgggttcaagcaattctcctgcctaagcctcccgagtagctgggactacaggcacgtgccaccacgcttggctaatttttgtatttttagcagagatgaggtttcaccatgttggacaggctggtctcgaactcctgacctcaggtgatctgcccaccttggcctcccaaagtgttgggattacaggtgtaagccaccatgcctggtctggaaagcatttagatcactgcttggttttagcaagaactaggaaaggttgtcacattattctcaatctaagagagtacataagccaggccttcttaactggggagccttgggtagattgcttccatttaacttcctgaggttacatgcaaaatcttgagagtaataaggatttccatggacagagagtgcacagttttcgaaaaggttctctgtgacctaaaacatgttaatccacacacacctggttttgcaggcactgagaaaataagtaaaccttccaaggccacaaaagtgactggtgacacaagtaaacttgctctcagtgaaatacatgaatgtttttccagaaggaggtgcatcttattaaatcactattatatgacagtggaacaactaagtctctaagcattagataccattcaaaacgtttaactaacaagctaagtaacaactgaagtaatttaatcaatgatatctctgaagaaatattattcacaaagttgcggtacaaagatcaccaaatctagccaggaaggagcctcagagattgtatgacccagcttcctagcaactccctcaaagtcactgagaacagctgcattagggccaaaacccaggcttcctgccccaaatccactggtacttccattcaacagagtaatctgagacactgtgtcatcaaaggtcacagaatatactctatatacaaaatagagtatatctttcttttaaaaaataaaataagtaggccaggagtggtggctcacacctgtaatcccagcactttgggaggctgaggcaggtggatcacttgaaaccaggagtttgagaccagcctggtgaacatggcaaaaactgatttctactaaaaatacaaaaattagccgtgcatggtggtgcacacctgtaattccagctgcttggaaggctgaggcaggagaatagcttgaacccaggagatggaagttgcagtgagccaaaatcacgccactgcactccagtctgggtgacagagtgagactctgtctcaaaaataaaaataaaaataaaaaaatttaaaaaaaacaaacacacacacacacacacacacacacacacacacacacacacaacaaaaaaaaccacctctggaaattagtttcttccagaaggtccaaggggtaaccataaagtaaatgcaaggacccatgatctctgtgctctttgttgagcaataaaatcaaatatttgtttcctcctccataatataaccattaactttcactaaaaatacacttattcttctcatgtaagaggtcacatcaggggagtatttaaatgagcatgtgctaagctatcacagataacagttctgcctgtaccacccaccccagcagcccggagaggcgcaggctcacacacgatcccacatgtaggaccaggagtccaacctggaaccctgtgaccctcaaatttgtgtaatttcaaccaacctcaccactcactgcttccctaaagtgcaaagtgcccgacagatttccactatgcatatattaagctctaaatgacaactgctcaacatatttgaaagttcacaagaatacaggtcatcaagttctgatggtcaaagatcctggaactcactgattttagtgttgccctaagcatcctccctatctgcctaaaacttgctctcctgcagagcctgctgccaacagagtggcttgggcttcatgccccttacttttccctccaggccacataaaaggcccacatacaacagcactttaaacacacaagcatacactactcaacattagctacacagtgggaaaatttctgttttgaaaaatcaaccaatggggccaggcatggtggttcacgcctgtaatcccagcactaagggaggctgaagtggggcagatcacttgagctcagaagttcgagacaagcctgggcaacatggcaaaaccctatctctacaaaaaaatagaaaaagtagctgagaatggtgatgtgcacctgtagtcccagctacttggaaggctgaggtgggaagattgcttgagctccagaggtccaggctgcagtgggctgatactctgccactgcactccaatctaggtgccagaatgagaccctgtctcaaaaacaataaaaataaaaataaatcaaccaatgggggtgtccatgaaaaataccatggcaggccgggcgcggcagctcatacctgtaataccagcactttgggaggccaaggcgggtggatcacttgaggccaggagttcgagaccagcctggccaacatggtgaaaccccatctctactaaaaatacaaaaattagccatgcgtggtagggcgtgcttgtaatcccaggtactcgggagactgaggcatgacaactgcttgaacccaggaggtggagactgcagttagccaaggtcgcaccactgcattccagcctgggtgacagagtgagaatctgtctcaaaaataaaaaataaaatacaatataataaaaaataaaaataaataaataacatgcgacatatgacattttactactaaagataaataatggcaaaccagtcagttactatttttcatctacctcggccagccaaaactggacaccctagaagtccccaggttgggaataatgatgaacactcagatggtgtgagcaggggaacgacttcaatgagaccaggagaggtgcctctctgtgcctgcaatgccacctgtctgcctgacctccacgtccctaggctgccctagcagttctgccaccaggcccacccctctggtgtacaaggtgaaggggacacatgcaagtgctcaagactcaaactactatggggtgaggaggagggaaggcactgtaaggcagacacaagggatggcctagaaggttggttaaatggaagggagagaatatggaatgaaaataaatactggaacataggtgctgggcttaggacttgcagctaggagtgacgaagaaagggaaaaacaacttctacaagtcatttgggaagaagcggacccaagctgggacaggacaggatggaaacaggctctccaacacgatggtgccacacaggaggcagggactgtgcccgccatgccaacaacgtcccctgaaggagactggggccatagctccgaggcctgagcgccgacaagaggcttccaggcctgcacttgtgggaaggagccaaggaagggatggaagcagggagctggcccagcatcagtcacaagggcatgagacacaggatgaaagtggagtcagatttaggacctgggagccacccggcagggaaccaaagcaagtgcccttgtcaattggttgagggggttcgggcaggtcatggagaaagggagtgaaggatgtgccatggtggacacacctatggggctgtcatggaaaagctggtgatggctgcagcagtcacatctagaggcataggggcctcaacactgcacctttctaaggaatttactgtgcgtcaccaggcaacacttaaagcatgaacacagtatctgcagtttttatcattcaattaatgaatactcaccacagctattacaggaatgagtactcccaagttccctgcactgctagaagcctagaaaagaacagaattattgtcattaacgagtatgtgtttcttttattaaaaaaaaaaaacacaagatacaacatagtgttatgtaaacctggaatgtcttaatctaagagaaatgatgagagatatgcagagagaggcagagagatgctcatccagcataattttaatagcaaaaaatgaaaacaaatgtgaaaaataaaccatggttacataaatgattacataaatcatggtacttctgcataattagatatgacacagctatttaaaatacaactttctgaaaagcatttagtcaccatggaaagagcccacagcacatgtcaaatgaaaaaaaaatcaagatttaagactatgctatgattcaatcccaattatgtaataaatacatatgcataaaaaagctaggaagaaatctgtcaaagtgttagtaatgattatatatctgagtcaagggataagtgctttttactttactatttataggcttctgtatcttttctaaaataaacatatattcttcccaagttagggaaatttggggggttacttaataaaagatagactctctggctagacacacaaatgtagctaatcttcagtacacactgattagtaaaaattctggaagcactggcctaagccgacttgatttatgctcttaatctataataacagcagctgaagaccttgagcatacactgcggccaggcactgtgctcagtgcttcgcatgcactaacttctgggacgattcatgggaggtctcagtagcttgccaaggccacacagcacctcagtggtggggacagaatgccaagctgtaaacatatacacctactatgtactcacaaaaatttttttgaaaatttaaaaagaatgccaagctgttttccctgggctgggggccacaagggtggccctgcctggtcccctctgggaaaccgatagcctaagggatgcgtgatgatggagaacaacccacagaccttagtttaatttataattatagctccttgtcctccacaaggtggggcactgaggtccaatttccaggggagagcaggctcctgaaacgcccctcagacaggttacagcctctgctttctcaggtgctcagcaccaccttgtatcatcagtaccccactcttatcctgatgcctaaggtcccgctagacacgcgggacacacttctctcctgtgcactgaggtggtcccagctgtgtaccccactgggagacttgggaagttagtcagccacatgactgtcggagggcccggcatagcaaggctgaattagggacaagagtcttaggatccctgcttgcatcggccactctctcttggctgagactttcacagggggactccttcatgcagttgtcatctcaaatgccactcttcagagaagccttctcaaccagcccaatctaaagtgcccctcaccaccctgccctgtttcactctcccactcagcgccacaggcagagaggaccctgtctgtctcgttcacttctgtaacaccctcatctagagcaagggctggtaaactatggcccatgaaccaaatccaacccaacacctgttcttgcaaatacaattttataggagcacagtcacgcctgttcgttcatagacaggtgaccacagaagagttgagttgagcagttacaacagaagctgtatggcctgcaaagcgtaaaatatttacactctggccctttacagaaaaagtgggctgacccctgacctaggacagtagctggcacagagtaggtgaacaataactgtctgggggaaggggaaggaagaaatggaagagagaggaaatgacaaaacagggtggaagtagagatatggttgtgggatacattggggtttttctttaaataatctgatcaatcttttattttttaatttatagtacccccgactttttcttttttttcctttttgcctttattaaatgcctaaacacgcctcagtaccaagtgttatcaacaccaactcatattcctttccttatttaaaaaaaaaaactttctagctcattacaaacacccccttcccctttctctccactttcttttacatacccaccctatctaaaaaaatcaaatgtttagccaaccaaaattagtttaaattatatgacccaaccccagccaataaaaaaaatacaaaaacaaaacttgagtcaaaaataaaaattctcgtgccctttattcaaatatgctcttataacagctagcccaaaagacacccctctacgcaaaaataaaattgctttactaaaactcttctgttcaaatattcaatttccttaaaattttaagggttattcctaacatggtagagcgactagtgcccacgtgacatgctactggggagttacgaaggaagaggcctcacctgcctcggccccaccatgaatgtatttggggattcaagacatgacgtttatctcagtagacctgtcttccttgggaggcctgagattaggtgaaatctggcccttctcatgttgccactgtgttctgatgatgggcccttaaagtcctcctaggcccagctaccacccctgggcttcatgataaaggcaaggacagagagaggtgcccgtggggagctgaggctagactgttgtcatgtcaccaccctaggatgggtcgggcagcttttatgagctggatataacccagtgagaaaactgccctctcccctgatccccaccagcatccttgagaaagaaccccaccccttcttacttgcattccaggcacatttaaatcattcacaaagaaagtgccatattccaaccaagatggtgcctgaagactaagccttggccagcagggataggacactgatggggaaggcatagccatcctccttcctacctttagggcagggcccttctcgcttgccctctcgctggctcgcttcccctccagccccagctgcacaaacaactccaacaggttcatgagcagctcatccaccaggtgctcgtcttggatgttggccgcgatgttggccagggcattaatcactgccagggagcaatgcctgaagaagaaggagtgaaataacagccactgccaggccctcaaccgtccccaagggacggcactgcaggggtgaggcgagctgagcgggccaggcccagcctgccttaccacactcctcccagtgtctgtaaaccaaagaactctcaagtggagaagaacatgtcatcttcgtgaaaaacaacctgtagaataaagccaactgatgcagaaatgactgcaatcctctctcctgaaatgtagtaaggacctccaggagactaagttctaggcatctgcaacactgggtacctgtgagggtctcaggacacttccctcagggctgaaaatgaaagggcccatgcccaggcattccaggttggatcttgcttcccccctacaaatcacaaagagccttaaagcatcatttaccacccacagaactttcacctcatgaccagcttctccctaacgctgcctccaccttggagctgatgtcagtattttttcacatccaatgctcagcaagtgttccagggtcctgcctcaggatcttggctggcccaatgtaaaccccggatgtgaagctgacattgcccctttggccagaaacctgaaaccactgaggccaaccaggcttctgtggccctggagactgccagactctgtcatgtccaagcggcacgaccctgggtaagtctctttaagtctttgagcctcagtttcttcctaagtaaaacaaggatgataatttctcttcgtaggatcacgggaagagtgaaacaccacgtgaagcactaagcatgtcgtctgctccactaagaaatcccagagcaacggcagccacggcaaaaggcactgcagttaagtaatacctggtaggtcaagggcaaacaaagggcagtaaatgcttccactggtgaggaagacgacaaatcatttttggtgacaatatgagaaaaggctttatggaaggagaggcaagctgagccagaactgaagaactggaaggatgaagactggcaggtgctacagacacagggtaaggcatggcagaacacctaggaggggtggaagcaaaggaaaccggggaggcagctggcgaggcagctggggacactcctggagaaagggcccagcagtcacataggcgcaaggaagcaatgtgttggcctgtgtgcaggttccatggcagagaatgggacagaggaaggaaggaaaggagagcctgaccccatccccaatccagtcttcaggctgttctagtagcctgggctcatgacggtggcagcaagaaggcaatgaagtagtatcgatgcgagagacagctctattgattgggagctttcacatatgcaatctcattcccaactgcaggcaggttctcatttggcagatgaggaaactgaggcacagaggttcagcattttctgaggtcatgcagctacatggcatggctccacagctgcactcccacccactaaactgacatggagagaatccagaggaaggcctggacttcacagtcagaagggaggagcccggaggtcaagaagagtaacgcctgcaaaggggctctcttcttccctccccaccctcctgtcctcatctgacttcacctctccccttccctctcttccaaacacggatgaacatgtccctgtcctcaaggcattcctagaggagggtaaggaatagccaagaagcatctctcaatctgtcagggaaaactggtcagactttatacaagtatcaaatgttcaaggacgtttaacgcctacttccttggacccaaaatcctacttctctgaatctaacccacagaaagcatcaaagatgctcagagatatgtagctgttaggctgtcaatgctgcatttattagtgggaaaactggaaaacaccctaacatccaagctagagactggctggttaaatcttggttctactataggataggacgctccacaacctctaaaggcaacctgcgcaggatcattcatggtgtggctgatgtgctgccccataaaaaagcaggtcagctgcatgtgcagcatgggcccaatcagaaggagagaaaggagctgagacctcgtgcgctgagatgctcagtggtcacctccaggtgggggccacattgggttttcacttccccccttatgtgtgcactgatctgtagcatatagttttcttgcaagaagagtttatttaagagacaaattcacaaacctcacatttttaaagtaagttaaatactgtcatgataaaaaagtgacaatgaggtccagttacctatagccgtggtccttgtaatctttggtggctgagtatacaacggagctggccttcacactgatctgctggaagaggttccacacttcctgatagatgtattgctgggagagagcaagatgcactgtcaccatgcaggatgccctcatgaggcccctcctgtcatcacctagagagaaagctctggaatcctggggcacaacagcccaaagactatcagcccaaagatcatccatttctaaagctttaatcaaacctcaaattaaaagctaaaagggacatggcttagattcaaatcttctgttataatacactgacaagaaattaaacctctttttccccagcactcacagcatcttacactattcttactactccgcattaaaaccgttgtcagcatttagctcatctgcaaggtatatttaatctgtatttgtacatcccttatagtcaagagtttaacgtagcttgcacagggttagtggtgttctggctctggcctcccttacatttccggtgataaccaggcagcccagctggtcaataatcagcacatcgaggggggagggtggctggcagaatttctgctgtaggatctgcagaatgggctccatgaccttcggggtgtccctcaaggccaccgcaatgtgtcccaaggctcggattgtgtggtcgggaatcaagtgagcgtccctacagaaggaagaacagaagcgccctagcaacagtccctccagcatgcagtagtgaaacagtacccagagactacgatctagaccttaatttcataacagtcttgatgcagtgttcatctgaaactgacagcccaggattttaaccacgggcagaaacataagccccaggcactagtctggatgacaaagatctttctcgacttccacacagtggtccaggaagtacaatccaaggtgggcttcaccttaaatcttgtgacaaccctgatacatgcctatgctctgagacaaggagataaggacagaggcatgcatacgcacaatgccaggtgccccacacgagcctgctgagaacaatgggctgcctctgagagacaggaataggggcgtacttgtcgctctcctgagagatgtagagccggttggacaggctggccaagaacgcctccacaatcactgggtccaccgtcaatccagccttcaggcacctgaggagcaagaaaacccatgtggcactgaggcatcaaaccaagataggttttttgttttttaatttttccttccttaggcctacaaagtttaaagaactgctctgaattttcttccccccaaattggaggtcataacacagaatgaattcaaagaattactccagattttgcccacttgataaatgtctcagtcggaaacaataatttcattattttgcccagaacagtttcctttggaatatcatgctcaccctaattccaatttcaatcccttgtactgtttcttaaggtcacagtgactgattccaaagacaaacggtcccaagatagcatagtaaacatcacaattatataccaaggttttcatggtaaggagaaacatttacgttacagagaaaaggggaaaaatttaaagcccctaaaaacataaaatcttgtaagatgtcctagctctccacatctgtttggctcctgggccagagtttggaaaacagtttgagtctgacagacaagctgccatcttgatttagcttctaagggcaaggaaccagaatccagggaaagaagtatttgcatggaaatcagactgtatgtagctctcaagttggaagaacaagagtccacagtgcaggagtctgggcagcaaggggtacctaatcatattttaaaacctcacatttatattaaacattccacagaaaacaaggtaaagaaaatatgatgatacgttactctggatgttgagctaatggataatccttctctttttacttttctatacattacaatttttctctagtaagaatttcttagccaggcacggtggctcacacctgtaatcccagcactttgggaggcacaggtgggcggatcacaaggtcaggagatcaagatcatcctggctaacatggtgaaaccccatctctactaaaaaaaaaaaaaaaatacaaaaaaattagctgggcatggtggcgggcacctgtagtcccagctactccagaggctgaggcaggagaatggcgtgaacccaggaggcggagcttgcagtgagctgagatcgcgccactgcactccagcctgggcgacaaagcaagactctgtctcaaaaaaaaaaaaggaagaatttctttttttttttgagacggagttttgctcttgttgcccaggctggagtgcaatggtacaatctcggctcaccgcaacctccgcctcccgggttcaagtgattctcctgcctcagcctcccgagtagctgggattacaggcacgtgccaccacgcccggctaattttttgtatttgtagtagagacagggtttcaccatattggccaggctggtctcgaactcctgacctcatgatccacctgcctcggcctcccaagtagctgggattacaggcttgagccaccacaccaggcctcttattatgtttatgatcaggaaaagaaaagaagtaacaagaaataattcctctttatagatcaagtgtaggtttaaaataatcagaaacaagctttaaaaaagtataaatgcagccaggcacggtggctcacgcttgtaatcccagcactttgggaggctgaggcaggcggatcacgaggtcacaagtttgagaccagtctggccaacatagtgaaatcccatctctactaaaaatataaaaaattagccaagaatggtggtgtgtgcctgtaatcccagctacctgggaggctgaggcaggagaattgcatgaacccaggaggcagaggttgctgtgagctgagattgcgccattgcactcccgccccaggcaacagtgcaagactgtataaaaaaaaatgtataaatggggtgggtgcagtggctcacacctgtaatcccagcactttgggagaccaaggcaggtggatcacctgaggtcaggagttcgagaccagcctggccaacgtggtgcaaccccatctctactaaaaatacaaaaattagctgggcgtggtggtgggcgcctgtaatcccagctactcgggggaggctgaggcaggaaaatagcttgaacccaggaggcagaggtagcagtgagccgagattgtgccactgcattccagcctgggcaacagagcgagactcaatctcaaaaaagaagtataaatgtctcttattttgtaataacccgcttgtctggagcactgctgtctactcgccacttgcccagcttcccacctgcagatgttgtcaatagcgatgtctcggagctgctcgtacatggagggctggctcttcttacccgacatgacgttcagggttgactcggaatgctcattggtcacactgatttttatatcattgccagcaactgaaagtaaaaaattcaaatatatacctagttaggcctatcattttccatcaccttctttgtaattcaaaaaccaagataatatgctgatcatttataaaagcaaaatgatcactctaaaaacatctgaccaaatatttcagaaagagaagagtctaagagcaacaggaaataatatgtttaaatcaaaaggaagaatattcaagttagaaagtgataaatacagaaaactaccaatttctcaatcaactgttcaaaagtactgatgaccaaccaccaaaggcagctctgagggcgactgaggcatggccctgtgcttggagttacctcactaatatgtacaaagcctggtgagggttagggatgcttgcgggagcaggggccttagagcctgagagaaccctccccactacggggttcagggaagtcttgttttttgtttgtttttgagatagggtcttgctctgtcacccaggccggaatgcagtggcgctatcacagctcactgcatcctcaacctcctgggctcaagccatcctacaacttcagcctcctgagtagctaggactacaggtgagcgccatcacgcctggctaaatctttaaactgctctgactttaagtcttcatctgaaggggaagataaaaacagccaccttcatgagactgtgggtaagagggtgatactacatcagagacactagcacacagcaggtgtttaattaattaatgttaattattgtttcatcatatgtggaaacatcataatccattctcgcaggggtagcagggactgggcccctggctaagtgtttggggcacacaggatttgcatttcagacttccacagtgaaagatgtcaaaaagaaaacaggacttgaaggggcctttggtgtaacaggaatacaggatgagagaaggccggggaagaaaggcctggagcttggaggggacgcaaagggaaagacagaaggaaaggtgtggcgaaggaatgcacccaggtacagtcatgaaacctgtgtgaggctcacacacagtcacagagcccctttctcagggcctgaagggcacatagtctgttattacctgtgtggtactgactgtggtacttgtagagcttcaccagaactggggacgggatgaccaggaagtctcgcaaggacggtgtcacagagtgcaccaccaccgggaacctctcgcacaggcggcccaaaccctgcaacacaccatcaacctgtcacatggcctgtggtatgggaccatctgagtaggccctgagcagggaggtgctcaacccttcagtacccaagtctgacccaaaacttcgaaggtcaaagctcccacaggccacctgcccaggacataaaaagatggaagcgatggtgctgactctcctccacctataggggacatcaactactatttttttgttttgtttttgagacagggtctcgctgtcgcccaggctggagtgcagtggcacgatcatggcttactgcagccttgacttactgggcttaagcaatcctcccacctcagcctcctgagtagctgggactgtaggcacacaccatcatccctaactaattctaattttttaaattttttgtgcagacggagtctcactatgttgcccaggttgggctcaagcgatcctcccacctctgcctcccaaagtatcgggattacaggagtgagcaaccgtacctggccaggggatatagattgttaaagtgtgctcatctcttttggaagcatactaaagaagaaagggacaaaatataatttttaaacaatggcaggtgtggagtcagtgggattgtgacaaggttaagagtctcggcagagcagagctagcactgtgggtgtcaggagacatccccttgcgtggccccatggcacatgtccacagtccttcccccacaggccttgggaatggcccccagcctcacaacaacggagaactgaagccagctgcacccatatgccactgacagaaagccctggcatcctgcagggggcagcccacactcagtgatgaactgtgcacagcacgcactggttaaagctcctaaagacagaaccggcagggtctccgctgctggtgtgcccaccacagcctgaacagcaacagcgtgacaagagggaggccctacaggtgggatctgagcctctctgggttcagggagactgacctgcagacagcagatcagcaggggcaagtgagcaataatgactttgctggacgtcttggactgcagcttctcagatagcttgatgcaaaggttttctgcaccttaattcaaaaccagaagaggagatgagtgatcagcacaggccagtctttctaacacacttatccaccaagtaagcacagaatttaataaaaccccagagacatactttaggcagggcttattcatactgagaggtcacacagtgtgtgacactctctctctcttctccgctggccctaagcccccttgtccccgcagtgttcattccacagaaaacttcccattctactcctcccccagaaaaacacttcacctgaaggcactgagcttccatgtcaccacagaaaagcctaaagaaccagcaagatgcagcagagagcatacacaggccctgaggccacgggcatccccatcctcccaggtccagtgccctccatgcaggacaggacaccagacgtgcagagcacagcaggggctaatgctccactctgcacgtgcccaggaggcctactgcaactgcctgtgctggtaacagagccaagtgttctagaagtagtttggggaaacttgtggcaagaaagcctctgggtcatgcctggagctcacatgagaggcaaggcagtctgtctcaccctgctcgtccttcacagcccacaccatgaggtccacacaggcagcattcgcctgacagcgcagtttgagggggctcagctcattgtggatccggtctgcgtcatgtagaatcttctggagctccccctggctcgtgttgaactgctccagcacaaaatcatggatctccttcacaaaagaggtcgggaggtctgtaggaaagagtgtggcatcacagctgggaacaaaactacagtagaacacaggcagtgctagcagcggctacagtcttccccttttaacaaaaaccccagaaaagtagcatttgctactggccactgtgggtcctagaatgcccactggaaagaagttggataggaattgcacagctgtcctccacgtgcacacaacctggcaatcagaggaaatgatcatttcccagggatgttacagccatgctttgttttaagcagtcaacgtactaaaacctgaatacatgaaacatataaattgggaagtatcgttgctggaactacttccactgacaatatgagatacttctgtgatttttttttcttttaagaaagaggttgtcagggccaggcgcggtggctcacgcctgtaatctcagcaacttgggaggccgaggcgggcagatcatgaggtcaggagatcgagaccatcctggctaacacggtgaaaccccatctctaataaaaatacaaaaaattagccgggcgtggtggtgggcgcctgtagtcccagctactcgggaggctgaggcaggagaatggcgtcaacccgggaggcggagcttgcagtgagccaagatcgtgccactgcattccagcgtgggcgacagagcgagactcccatctcaaaaaaaaaaaaaaaaagaaagaaaaaggttgtcagataagggcaaaaactggttgcagccttgagaagagaattatctggatcttcagagcactcaccctgagtttgagagacttttcaaactctcatccccagggcctggaaaattcaggagaaccaccatgatgcacgcacaagtcagcccagccaaggcagccagcaacacacagcaggggtggtggggagggcaggggtaatccctgatgccccttcttagggagtttcaacccttgccgtggcccagatgactcagcttctgaggaatgttcagaatcagattaggaaagtggttactaaattttggtataccttcctgacaaaatattatgtgctcatcaaaacttaagcttacgaagaacactcaacagtgtgaggggagagcataggaaaaacattttgtaaaatgcataaaagattgtttcctcacttctgggaaaaacaaaattcatgaaagagggactagaagaaaatgctaaattgttgtgtgtgcatgttaactattaagctattgtctcaggttgggtgcagtggctaacacctgtaatcccagcactttgggaggccaaggtgggtggatcatttgaggccaggagttcaagaccagcctggccaacatggtaaaaccccatctctactaaaaatacaaaaattaggcagacgtggtggcacatgcctgtaatcccagctacttgggaggctgaggcacgagagaattgcttgagcctgggaggcagaagttgcagtgaccccagatcatgccaatgcactccagcctgggcgacagggaaagactctgtctgaaaaaaaaagctagtacctctacattaacagattacatgtattacaagtacttcattttcttttttttaatgtttttgagatggagtcttactctgtcacataggctggagtgcagtggcacgatctgggctcactgcaacctccgcctcccaagttcaagcgattctcctgcctcagcctcctgtgtagctgggattacaggtgcatgccactgcgcctggctaatttcttttgtatttttagtagagacagggtttcaccctgtttggcaaggctggtctcgaactcctgaccttaagtgatcagcccaccttgtcctcccaaagtgctgggattatacgcataagccactgtgcctggcctcttttttaattttttaaactatctaaatggatatgtaaaactgtatctgtccttaggacaatataacatgcacattttagataaacaccttaggaaataaactcagcaaaggagccatcatcgatggtaccggggttgcaggatcatggacagattttttaaatttgcttttttcccaaaatttcagtaacatgaccactttgctcatatgtgtttttcagtggccccagcagaaagtgagtaccagtctgcaaccactagcatgcgacagtggcctgggagccagtcttgctgtactcacaaacacatgggcaaactgtcctcacccttcatgtagtacagagtgtcacgcagcatcttgaacatggtcaggtagagagggtcactgaaggaagtgtagtagagatcagcactggggttggcctgcagggaaggcagacacacatgactatagaacagaaatgcccttctgcccaccctttgccttcacagcaaggcccagcggaatggtgattcgtgacttagcattctaaatgaagcaactgtttatcatgactcatcacttggacactctactgtcttcatcctcttaagcatcagaccaaggaaaacaggaggctcatgcagtccagagatgcctgcgggggagcagccatctgcaccctagtaggaagaacctccttgctgtggctgaagctcaccatctttggccatcattggcccagacagggacatgggaagtggtgaaggaggaagactgacaaaggccaccagagtaagggatccacactgtccatcatcccaaggatacaaattacagccaggacaccttcagatacaacttatgttttgtaattaaaactcattttaaattattctttaggaatctatttgaaatgtagcactattcttcttctgaaaaaaaaaaaaaaattcacacaaggtctaatgagttaagaaagataatagtccagcccgggtgtggtggctcacgcctgtaatcccagcatttggggaggccaaggagggtggatcacctgaggtcgggagtttgagaccagcctgaccaacatggagaaaccctgtctctactaaaaatacaaaattagctgggcgtggtggtacatgactgtaatcccagctacttgggaggctgaggcaggagaattgcttgaacctgaaaggcagaggttgtggtgagcagagatcgcgccattgcactccagcctgggcaacaagaacaaaactctgtctcaaaaaaaaaaaaaggctgggtgcagtggctctcgcctgtaatcccagcactttgggaggccaaggcgggtggatcacgagatcaggagttcaggagttcaagaccagcctgtccaacatggtgacaccctgtctcttctaaaaatacaaaaaattagccgggcgtggtggcgtgcacctgtaatcccagctactaaggaggctgaggcagaattgctttgacctgggaggcggagcttgcagtgagccaagatcacgccactgcactccagcctgggtgacagagtgagactccgtctcaaaaaaaaaaaaaaaaagataacagtccttaacttctatatactcctagttgagtaggatggaaaattatggtttatcataactcgtttttttcatttttttttttagagatagggtctcactctgtaccccaggctggaatgcagtggtatgatcacagctcactgcagccttgaactcctgggctcaagtgatcctcctgcctcagcctcctgagtagcagggactacaggcatgtaccaccatgcccagctaatattataattcttgacaagtataaaagtggtctgcaaatatagcaaatctttaaggcgccagaagttggccagagtgggatagggcatgcagtgtgaggttgacagagggtgagtgagcaggtggagaaaaaaagaatcatgtggagagtgtgagagtcatgccaattcccaggaggacactgacaggaagagctgtggttgacagcactgcaatgatggctttacagacaacgtctggtggtcctcacagggcagaaatggagaaatgagactgggagaggttaaagcagttcagggctttgactctgggagtccagacaacacgagtgttaaactttggagccttggagaccaaccatcttacaagcccacagcccagctccatcactcacgagctatgtaaataaagttcctgagctaagcctcagtttccccatatgtaaactggggattgttgtgagattcaaggagtgagtgagtaaagttctggcacataataagcatgtaataattggtagtggttattacactgattatggatactgagtaatatattgcagactctaggtcaagattacaagaaacttttttttttttagctatgaaactgtttcttcaaatggatgtttatgctaaagaacaaattacaaaacaaaaaataccagaaactgccctggttcaatgagaaggagggtcccagaggtggagtgcaggcccactaagtctccacttgtctaactgcccagcccagctctcgccctggtcctcctggtctgccctcagtcacaaatgatcaaacacttatgatggaaaaccaaaggtctctgagaccacaagctcagtctatagtgagtgagtgagagagttaaagctcaggccaatgggcagaacgacaacctgaaaaagggttggagacaaggtaggaactgcccagatgcaacttggggagttataagaactctgttacttaaccaagaaccaacccagaccaaaccacggccagcacatacatctcacatctgcaatagctcgttggcaggggtacgaagcaggaagagacatggtctacagcacatgaagggccctggtagttccttccctgcttcatacctgagccccaggtacagtggtatcaggcactgtgtgtcttaaaatcaggtgagagaaggaacaccaggcttcaataaggaatctgggtcagggacatacccatggtaataattagcctggcaaatgacaacctgtctgcatcctaaccctcaagaggggcctgacccaaatgttccccgagatttttgagacctcccagcaccaatgtaatgatttcataaataatgctgtaggccttggttccaaatacattaaagacaagagttccagccgggcatggtggctcacgcctgtaatcccagcactttgggaggcagaggcaggcagatcacgaggtcaggagattgagaccatcctggctaacacggtaaaacccagtctctactaaaaaatacaaaaaaagttagctgggtgtggtggagggtgcctgtagtcccagctacttaggaagcggaggtaggagaatggcgtgaacctgggaggcagagcttgcagtgagccgagattgcgccactgcactccagcctgggcgacagagcgagactccatctcaaaaaaaaaaaaaaagttccctagttacgcaccccttacacttaaaaaccaggacttgcatacgcctagaaaagtgtagctctgagcccagaggagcagctttggaagcaccaaaggagtgaggaagataaaagagtaggagagacccaggccagactcccagctcccacagtaactatgtgatgtgggcacgttagtgagttctcactaaaactctatcttctgtctgtaatgccaccagtcagaggcaccctgaggtgacgtatttaaaagagcatgcaacggtacctaccacagaccaagccctccgcggcaggtggattgttaccacatgaacaaggaaagtgaaaacactgcaaaaccccttccactccagcccccgctcaaactcttcctgctttctctacacacgtttaagtcaggctgatctcatggtaatgccctcagaagcgacatacctccatcacactggctacaatggcatccaaagatttgagaacagcctcctcaacgatcttcttcacctaccaaggaaacagaacctcatgaagcaactgacatacacagagacaggaatgctagctccttctaccgaaaacccatgacaaactcacatggtgaaaaatgtgatgcagataaaggccaataaatacaaattatggctatgtatcaaactatatgcacaaaatgcctttaattctgaagtcacttgggactgcttttctaccttagatagcaatgacataaaaacaaaggaaaaaggccaaactccctcagatttgttgacctgagatttctgtttccaggatgtgcagacctcaggccttgctgccatttcacccactcatggttaacaggcacagttgtgtgacatcctcttgcaatcccctcccagacatcaaggacaccctcacagccagtccttggagctcatggcacctccttcctctccgggccaggtgcactggctcttctacaactgcttaggtactcaaactagagctcatattttaaattttcaatagaagcaattattttcaccagttatctgtacagtatttagtgtaggaatgaattgttctgtcaactgcagaaccacaaaaaaaaaaaaaaaactgcccacatccacaattgtagtatttgatgaaagtcatttccaaaatgtatagataatgataaacatcctaggaaaagaaatgaaaaaccgcctaaaagaaaacctaggccagccgtggtggctcacgcctgtaatcccagcactttaggaggccgaggcaggcggataatgaggtcaggagatcgagaccatcctggctaacaaggtgaaaccctgtttctactaaaaatacaaaaacttagccgggcgtggtggtggtcacctggagtcccagctactcaggaggctgagggaggagaatggcgtgaacctgggaggcggagcttgcagtgagccgagatcgtgccactgcactccagcttgggcgacagggcgagactccatctcaaaaaaaaaaaaaaaaaaaagaaaacctaaacttgaagaaagttaaaagttaaaatatactgcaaaaaataataccccaagaaaggatgtgaaacagtcagtcttcagttagaatttctgacatggtactgggaacagccatctgtgaaggtcatggctctaccaggccaccattctatctggggcactgacactgagaagcagtttaggtagttttccttcttgacagcaacttcaaaaacatcctagcctatttagtaattcattatggttccatcctcattaattattacctatgttgtaatgtcttcttacatcttcagcctgaagccattctctgagggatttctattcacactccacacagcagggaggtggccactcctcagcacatgctccatgctatccaaattgttctcatttccaagacagcaagcccaatcttgagagtctggccttgatgacatcatcacccgtacctattcaaatctgtcttgaaccatcctagcttgattgtaacaacttcagggcccctggatctttattttgtaattttttttgagatggagtctcactctgttgcccaggctggagtgcagtgctgcgatgttgactactgcaacctccacctccaaggttcaagcgatcctcctaactctgcctcctgagtagctgggattacagggatccactaccatgtacagctaaagttttgtgttttttagtagagatgggatttcaccatgttggccaggctagtctcgaactcctgacctcaagtgatccgcccactttggcctcccaaagttgggattactggcatgagccacggcgtccaaccagggtccctgaatctgaccaaagctctggccatttaaggaatcgaacaatggccctggtgttttctctggtatcaccctcaatgtcatccaaaggtacccaaatatgaaaaagtcaggttttgttattaacccaaatagagccaccccttagaggaagtcaagcccaggaaaagcactggacttggagtcagaatccctggactggatgcagcccagctgctggcctacatatccatgacgtgtttgacaccgatttcctgacctccaaatggggatgcatgggtgcctccccaacatggttgctcaagaatgaaatgagaaaccagtatacaatgattccatgaatgttactctacttccttcattaatctgcaagtttatgactattaaattgtactttgaaatactggtactctgagtttttcttttaaaaatacaagtttcaccactagcaattttactgacatatccatggtctgttcatccatcagttctttgcttaccaggtttaagagttcccgaagcatttccaatggaatgttaaactccttatatgtgacaccgttgaaaaggggagagactgagaagctggagctgatggttgaaaagtagtactcaggctctagggcagtcccatcgggcaagcaggaggctggtgggagataaagctggaaactcagccgtggtgacaggcaactagggtacttcctcaagctgactcccccaataaccaacaaaggtgcagattttgcctttatttatatcccaattctctgcatgtttttaaattaacaactacagggtagattgcaaatccttggggactgatgcccctcacctgtgtctttcaggtcaaagactcagatatgatggtcctaatatttccatcttagacaatataacttagtatgtgggaagtgaaaaaagaattgtatcttttttatttttatttttatttttttgagacagagtctcgctctgttgcccaggctggagtgcagcagtgtgatctcagctcactgcaacctctgcctcccaggttcaagcaattctcctgcctcagccttccgagtagctggaataacagatgcccgtcgccacacctaggtaattttcgtatttttagtagagatggcgtttcgccatgttggccaggctagtctcgaactcctgacctcaagtgatccacctgtctcggcctcccaaagtgctgggattacaggcgtgagccaccatgcccagcagaaatacacctttttaaaggtgaagagatatgaaagcttggggtccacagggcctcagagatattttctcaccaaaattagaaaaaaaaatgcacactactagaagtttcaaagtcagagcaactaagtgaaatacacctgtcactaaaagacaaatactgtacgatcccacttattagaggaacttaaatcatacatagaggtagaatggtagctatcagtgactgggggaaggggaaatggggaataattgatgtatagtttcagtttcacgagatgaaaagagtttttgagatgaattgtagtgatagttgcacaatattataaatgtattcaatactactaaactatacactttaaaataattaaggccaagcatggtggctcatgcctataaacccagagttttcgaaggctgaggtgggaggattgcttgagtccaggaattcaagaccagcctgggcaatatagggagatcctgtctctacaaaaaataaaaattagccggatacagcaccatgggcctatagtcccagctactcaggaagctggagcaggagggttgcttgagcctgggaggtcgaggctacagtggagctatgaatttgtcactgcactccagtctgggtaacagagtaaaatcctgtattaaaaaaaaaaaatgacatagcaaattttatgttatgtgtattttaccacaataaaaaaaaaagaaggaaaaaaatcaacaaaaataaagtcattcagtcatttgacatttaataaatataaacccagacccaatgcagtggctcacacatgtaatcccagcactttgggaggctgaggtgggaagatcgcctcatcccaggagtttgagaccagcctgggcaacacgacgagaccctgtctctacataaataaaattattttaaattaaaatagaaatatagtaaataggaacccaaaagcatataattgtttgaaaatccattatttagaaactataatagaaaactatgaggccaggtgtggtggctcacgcctgtaatcccagtactttgggaggccgaggcgggtggatcacaaggtcaagagattgagaccatcctggcaaacatggtgaaacgctgtccctactaaaaatacaaaaattagctgggcgtggtggcacgtgcctgtaatcccagctacttgggaggctgaggcaggaaaactgcttaagcccgggaggctgaggttgcagtgagccaagattgcaccactgcactccattctggtgacagtaggagactgcgtctcaaaaaaaaaaaaaaaaaaaaacaaatcaaaacaaacaaacaaaaaactatgattgaaaaacagatgaatttgtaatattttcataagacagtatcaattcataaagaagtgaatactaaattttatgactttttcaagcactagagaacagactcaaagagtttagtttagctccagttgtgtcaaagctggtatctcacagctggcagcacactgccaatctgtctaaagaggacgcaaaccagcaacttacagcagaaaggatgggcaacaataccactgggagctgagacgccaagaggccaacataagaaatggccactgaaagagggaacaagtaaggaaagaagggagggagaaacagccggattaaaaagggtagatgagggagaagggaaggttgtgattatcgggcacttctcagaaagacaccatgaaatatgggctaagtcctgtgtggctgaaccccacagaggacacagatgatggcaaacgacaggggctgcaggaactagggacctaacatttgggatttacgcagggggtgtcattgaaacttcttttttttttttcctgtgagacaagagtctcactctgttgcccaggctgcagtgcagtgtcacgatgtctgctcaccgcaacctgcgtctcccaggttcaagtgattctcatgtctcagtctcctgagtagctgggattataggtgtgagccactgcacccggctaatttttgtatttttagtagagatcgggttttgccatgttggccaggctggtctcgaactcctagtctcaagtgatccacctgtcccaaagtgctgggattacaggtgtcagccactgtgcccaacctgaaagtttttaagcaggaaaagaagtgatcaaatttgcgctattaaaaataattcttatttattttttattttatttagtttttaagggtctcactatgttgcccaggctagtctcaaactcctaggctcaagcaatcctcctacatgggcctcccaaggtgctgtgattacaggcgtgagccacatctcctggcctaaaaacaattcttaaaaactaaattcttacagcagtttggaagagggcctgggaagggagatagaaggaccggctgtaagaaaagtcttagtatgtggtgttgtatacctgaagtcccagctacttgaaagggcaaggccagaggatcattatgactgcacccctgcactccagcctgggtgacagagcaggaccccaactcaaaaaaaagaaaaagtccaagtaaaacaggtagtttgagaggaaactcagaaggcacagggtctgctgctgtctgtcctacagtgaggcatttcagagagcagggctcgcttgtctcgtcaccactacaggcaaagtgggcggcagccaagtctgatggagtgatacgtggggatctcgcagtcagccacattagtgtgctcccatctgccacttactggatgtgctcaaagtggggcagcggtcatggagaggagccctcaccacagagggtggacaatgagctgtttaccaggaaaagggaagcctccaagggcacatcatggccatcctaaaatgccccaaaggcaggcaggtggcagtgagattttcagagcctggaggaatacattctatacttaaacaaggagttgtctctaagaggtgcgattctgagtggctgaaattagctcttatattctaacacatatatagaatgtaacctgttacattctcacagatctaagagatggaaagcttcctacatttatgtaagcccagatattccctttttccttcaaaattcccctcacatctctcgaaactgtcttgagacatgctcttttaacaaatagcattattcaaaaaaggagagactatactgaagcatggaattctgccttccccatttgctgtcccttaatctgggtcttacttccatcaagtaaggtagaaataattttaacatgtgtctgacatggcacagggtagtcacatgaatccaattcagtaaattatgtaaaagtactttgtgaacagcagagctctataaaaagtagtaatgggctgggtatggtggttcacggctgtaatcctagcactttgagagaccaaggcaggcgttcccttgagcctaggagttccggaccagcctgggcaacatggcaaaaccccatctctacaaaaaatacacaagttagtgggcgttgtggagggtgcctatagtcctagctacttgggaggctgaggtgggaggatcacttgagcccagaaggttgaagctgcggtgagccatgatcatgccgctgcactccagcctgggtggcagagtgagactctctctccaaaaaaaaaaaaaaaaaaaaaaaaaaaaaaaaaaaaaagtagtaacagtagtattactacattctttaatattatctacatacttaatgtcattaaaaaaaaatgtccagccaggtgtggtggctcatgcatgtaatcctagcactctggaaggaagaaatgggtggatcacttgaggtcaggagttcaagacaagcctggccaccatggtgaaaccctgtctctactaaaaatacaaaaattagctgagcatgctggtgtgtgcctgtaatcccagctacttgggaggctgaggcaagagaattgcttgaacccaggaggcagggcctgcagtgagccgagactacaccactgcgctccaacctgggcaacagagccagactctatctcagaaaaagaaaagaaatatccaccattagtacttccacctgaaaagaacttttacaagttaaagtgcaaaaattctgatggcaggtatataggggtctgtaagttattttctgtacttttctctctaaataaaatatttgaaaattaaatgtacttttctctatatataaaatatttgaaaattaaattttaagaaacttaaatgaaaacagaaaataaatgcttcctaaaagcttggcactctaggtccatccatgacaacagagttagtatcagcatccttaatatcacgagaagtcactgtgagcctgttctccaagtattacgtcaaaatattcttcggaaaggtgaagcccaccttcaaagtagtgaaaggcagatcctccaggggaactgggagggggcatgccgcgttcagggctgacctgaaacacacaaccacagttacatatcagaaaagaccagtgagacctccatcagatttgtcttagacaaggtcctctctgccagcccaatgtttgtacttcaagttctggttgaagcctcatttccttcctaaagcccatcacagctacagcattctctactacatgctatatcactaaattctttgtgtttagccgtatatttgacacttgattactgagctgaattgtcctcagtgttttgtgtttttgtcttttctccatgagtcaattatatacttcttaagggcaccaactgtcttccaggcaaaatagcatttggcacccaactgctatgaaacatatactttatgactatgaaatcacttataaatcttatgttggggactagcctcaacaccacctgtagggtatttgatgtttggtggcgacaaaggaatgagaagaaacaggttaagagtttataaaggcgggagccaggggaccagagcaaatcagaggccgcaaaggcctagagttttggtttttacactatttattgagtataatcacttagatttaagaagcagatgtttagggcgaaacggtgaaagggaggcagtgtgtcatatgtgtaatctatagtagcggcagtttaaatgaattttttttgtgtttaaacagtatattttcaacttattggacagcagttagtgggagcaggcttaactaggagtctgtatgtttggccatattttcatgttttaaaggagtggtttttttttttttaacacagtgtttatggataagagagtaagtcttgctcagagtatgggaacataatggcgataaggctttttttttagaggccttttgtggctttttacacctcattgttttatatttttatggccagtttatatgtgcactctataagcccttccccccaacatcttaagagggacaagacaagtctttgtattaaagagaattctagtgaaacatttcacgttacttaagtttactccaactacaaagaagagggattttcttcgcaggggagcttaacagggtctttctcctctgctctttccccagtagcccaggcccacctgagagatgctggacacactgctggttttcctcttcagggtaccctcctgacagacagtcagcagattgctggggaggatggagcggaagtcattaaaggaacgccttcgaacaccttcaagctcttccaggacacggagggaatgaggagggattttgggaaagagctttgagaggagagactcttccatgttgctgtaacgcccaaatgctcgcgagattcctatcaggcatgggatagcatacttgcaaaggtattctagaagatcaagtgaaaacgttacaatataagaaagtatcctgatagagtcatatagtaagtactaacttgtaacattgactaagatttcacaacccacccactaataactgtgaaggttcacaataagccacaataatggggtccaccccaagggctgacaagtgatatcttcaacctgtcattaacaacttcagactatgacttcaatacacccagctgccctgcttggaaggtcttcatctattcatggcacacccaaatcaataaaatagctaggccatattatcaagtaccttatacatttattcctcttaggagcatattggtagcctcacaacacagaaaaaatgacctttggaagtcaactaatctacccacagatgttacaggtgaagaaactggggcccagaagggtgaagttacttgtccaaggtgacccagcgtctatgtagcagagcaatgcacatgaccccatgtggcctctgaggatactaacacacaacaaatcaaactaaaataggaaggttttctcccatcatatatattaggtacccaacaacagaaaagactggagaaaagcaagggaaagagtaaccacaaaaccattttaagaaaaaccttaaggatactcgtacctttgtcttgaatctccaaggcctggcacatccccaagaggacatgcaaaacctgcaaaagcacctctaaaatctgtaacagtcaaggaaacaagaaaaaaaaaacataaacaaaattaggtaaatatcacgaaactaagtcagaattagaaggcacttcagacattatcttaaccaaccccatatatgatacatccctccacaacgactgtgccaagtggccaaccagctgactttccagggacaaaaccctcactctctgggctggttccgagttcctcccaatactgggccaatgttgtcctcctggggcttgtacctaccagcccttggggctgctttttcctctattaacatattctgtaaacaggtgatgggtccccaaatcttctcttttcatgggtaaacgccctagcgcttttcaaccgtattcttcatgatcataaatcctttgtaatgctaattgccagcttctgattttacggtagtccagttttctgtctggaagtgtagtgctcagaataaaatacattaacatctgggatgctggaactcacccagcatactcaccaaactcatcacagattctacacttctatgtatgtgacattagcttttctgcagccacttcacactgcttatgtgaagctcatctcaatgagcttatacataatttttaaattttttttatttgtttgagacgaagtttcgctcttgttgcccaggctggagtgcagtggcatgatcttggcttactgcaacctccacctcccaggttcaagcgattctcctgactcagtctcctgagtagctaagattacaggtgcatgccaccatgcctggctaattttttgtatttttagtacagacagggtttcaccatgttagccgggctggtctcgaactcctgacctcaggtgatccacctgccttggcctcgcaaagtgctgagattataggcgtgagccactgcgcccagtccataattatttaagttaagaaatttttttttgttcctggaagggtggcttatgcctataatcccagcacttttgtttgtttgtttgttttgaggcgcggtttcactcttgttgcccaggctgcagtgcaatggcatgtctcggctcaccacaacctccgcctcctgggttcaagcgattctcctgcctcagcctccttagcagctgggattgcaggcatgcaccaccacgcctggctaattttttatttttagtagagacggggtttctccatgttggttagtctggtctcaaactcccaacctcaggtgatcgatccacccacctcggcctcccaaggtactgggattataggcatgagccactgtgcccagccaatcccagcactttgggaggctgaagcgggtggatcagttgagctcaggagttcagacctgcctgggcaaagtagcaaaaccctgtctctacaaaacatacaaaaattagccaggtgtggtggtgcgtgcctgtggtcaggaggctgacgtgtgagggtcacttgagcccaggaggccgaggatatagtgagccaagaacagtgcaggggttcaatgatagctcactgtagcctcaaactcctggactcaagcaatcctcctgcctcagcctcctaagtagctgggattacaggcatgtgtcactatgcccagctaatttttatttttatttttgtagggataggttttgctatgctgcccaagctagtctcaaattcccgggctcaagtgatcctcctgcctcagcctcccagaatgttgggattacaggcgtgagccaccatccatgacaataagcttatagatgaggaagatacctaagtcttctttcgcacctgcttctcctgaactatgtaatctctactaacgtagttggtattttttatctttcatctacccctacaaaaactcatggtattagctttagctcactgtacaaatctgtgattcccagctttgtgccttctccaaatgaaatcaacttgctttccagatcttcattcacagcactagcttgttttgctccaatgacaggagggtcctgctaggccgatacctcactgatcaccctttgggacagtccttcaggcagttctgcaaaccctccaaaccatttggccctcagcccatataactggtccaggatgtcaggaaaggtgcttgtccaaagcatttatgaagatccactagaatgcagcaacttcatttctctcaaccattcttcttagaaaacccaggcaaagaaaaaatgaagttggtgtgacatgacttgttcataaccaagtcaaatctcttacattttcctaatattaagtaatgctgaataatctacaaaagcttgaaaagcaatagtttttccattttatttatttattttgagaccgagtctcactctgttatccaggctggagtgcaatggcatgatctcagctcactgcaacctctgcctcccaggttcaagtgattctcatgcctcagcctcccgagtagctaggattacaggctcctgccaccacgcccggctaatttttatatttttagtagagatggggtttcttcatgttggccaggctggtctcaaactcctgacctcaggtgatccacccgcctcagcatcccaaagtgctaggattacaagcctgagccaccgcacccagccactttttccattttatatgttaaagtcatgttatcacctttggtgttgacctctttattctgataaattttattcatagaaaaaagcccttaatgtccaactttttaataaaaacacattattctaacatatttaagtatttctttagccaacctacaaataaatgaagaatctaaattagtcaaaatacatcactaactgggaacatttagaatgcagacaagcaactaggcactgtttggaagaacctaggaacagcagcatacaaaaactaactttctaagcgataaatttaagaaaaagttgtatgattacattctttgtttaaagaacaggaaagtatgaaatacatgtttgtaacatttctatcaaaattaacaaaatctaaagaaagtctgtgcccttaaagataaaagcttcagctacctagaagattctcttctagctgggcacagtggctcacacctataatcccagcactctgggaggtcgaggcagaaggatcacttgaggcccggagttcaagaccagcctgggcaacatggcgaaaccttgtctctacaaaaaatacaaaacaaattagctggcatgatggtgcacgcctatagtctcagctacttgggagtcttaggagggaggctggcttgaggtggacggcagaggttgcagtgagccaagattgcaccactgcactccagcctggatgacagagcaagactgcctcaaaaaaagaaaagaaaatgatcttctatgaatgacttcaatccccaacaaagagcaagaaaaatgagctgcctctgcctttttctgccgcctaccttaaaggactttctgaaaagctgaaagggatagtgctgctcatgtctctgcagcccctgcccttcattagaaaaaagaaaaaaaaaaaaagaaaagtttaataagataagactcgagatcctaaagagtagtgaaagacctaagcatgtcttaggtctgctgtcaacaggatgaaatagataaatatcaacaaacaattcaatcacatttcacgtttttaaaatcttttcatcactttgggactctattcaatctaatagaaatgcataccaaatcaaccaacacatgcttacctcatccctaagtgaaggatccctataggccacatcagacagcagagttaccaagcagaagctgaagctctctgcaaccgggagggcacctggaagatgtaaaaacataaatcagataaccaggaaccagatactgggtcacacctctggccatccaattcaatatgttccctctcaccatgacctgccaagggaccagtttacagcagctgccctccttgagacgagtctcaaaagaacagctatgggcccaatgagtttgctgagaaacacccttacctttcctttaagtaaatgttttggttcaataaacttaaatgtttcctgagccaatagctagtgtgagataacaaagcctctcaacatgacagattcaattttttattccctaagtaaatgtgataaatcacacacacacacacacacacacacacacacacacacacacacacacaaaacactcggctgggcgaagtggctcaagtctgtaatcccagcacttttggggggccaaggcagacggatcacctgaggtcgagttcaagaccagcctggccaacatggtgaaaccccgtctctactaaaaatacaaaaattagctgggtgtggtggcgcacacctgtaatcccagccacttgggaggctgagacaggagaatagctcgaagccaggaagtggaggttccagtgagccgagatcgcaccactgtactccagcctgggtgacagaatgagacgccatctcaaaaaaaaaaaaaaaaatcaattttgaatattgaatgttgaatcaaggaaaaaagagtatccactatttaatagctatattcatagtacatgacagaagacttacatttctactccagcacttaaaattttaaagtgcagctctaggctgttctcaaacttgaatgtgcccatgcccggcctaaaatttgaccttttagtaatgatgctctatttaatttgtagtccatcaaattgcaggacagactgggtgcagtggctcatgcctatagtcctagcactttaggaggccaaagcaggcagatcacttgaggccaggagttcaagaccagcccagccaacatggcaaaatactatctctaccgaaaatacaaaaattagccaggcatggtgatgcatgcctgtaatcccaggtacttgggaggctgaggcacgagaattgcttgaacccaggaggtggaggttgcagtgaaccgaggtcaggccactgcactacagcttggagtgcagacagagtgagactgtctcaaaaaaacaaaaaacaaacaaaatcctaacaaattgcaggtacatgcataatttgggatctgtcagttttaggcatgttaccagaaatgatgaaaacccaaaggttaagaggaatactggcacaaacagaatgttttttaatttttatttcaggttcaggggtacatacgcagttttgttatacaggtaaactgcatgttacgggggtttggtgtacagattatttcatcatccccgtaataagcatagtacccagaaagtagttttcccatcctcaccttcctcctattctccactcttaagtaggccccagtgtctgctgttcccttctgtgttcatatgtactcgaagtttagctcccacttacaagtgagaacatgcagcgtttggtttcctgttgctgtgctaattctcccataacggtctccagctccatccatgttgctacaaaagacgtgatcttggccaggtatggtggcctcacacttgtaatcccagcactttgggaggctgaggcaggcaaataacttgaggccaggagttcgagaccagcctagccaacacggcaaaactccatctccactataaatataaaaattagccgggtgtagtggcacatgcctataatcccagctacttgggaggctgagacaggagaatcgctcgaacctgggaggcgagggttgcagtgagcagagatcgcaccactgcactccaagctgggtgacagagcgagatcgtctcaaaaaaagataaaataaaataaaaaataaaaggacataatctttttctttttttatggctacacagtactccacggtacacatacgacattttctttatccagtcttccactgatgggcatttaggttgattccttatctttgttattgtgaatactgctgtaataaacatacttacgcatgcatctttacagtagaatgatttacattcctttgagtatatacccaataatgggattgctgggtcaaatggtaatcctgttttaaattctttcagaaattgccaaactgcattccacaatggctgaactaatttacattcacaccagcagtgtgtaagtgttcccttttctctacaacctcaccagcatctgttatttcttgactttttaataatagccattctgactggtgtgagatggtatctcattgcaattttgatttgcatttctctgattattagcatcagatgatgagcatatttttcatatatttttggccacttgtatgtcttcttttgagaagtatctattcgtccttggctcaccttttaacggggttttttttttgtttgtaaatttaagttcctcatagattctggactttagacctttgcatagtttgcaaatattttctttcattcagtagggtggctgtttactctcttgacagtttattttactgtgcagaagctctttagtttaattaggtcccatttgtcaatttttgtttttgctgcaattgcttttggcatctttgtcattaaatttttgccattaaatctttgccagggtctatgtccagagtggtatttcctagtatcttccagggtgtttatagtttaaggttttacatctagatctttaatccatcttcagttgatttttgtataaggtgtaagtaaggggtctagttccaatcttccgaatatagctagccagttatcctagcgccatttattgagcagggagtcctttccccattacttgttttgttgactctgttgaagatcagatggttccaggtgtgcagcattatttctgggctctctattctatttgtctatgtgctattttttttaccagtaccatgctgttttggttactgtagccctgtagtagaggtgaagtttgaagttgggtaatgtgatgtctccagctttactctttttcagactaccttagttattcaggctcttttttggttccataaaaattttaaaatagtttttttctaattctgtgaagaatgtcattggtagtttgataggaatagcactgaatccataaattgctctgggtagtatggccatgttaacaatattgattcttcctatctatgagcatgggatgtttttccatttgtttgtgtaagctctgatttctttcagcagtattttgtaattcttgctatagagatttttcacctccctggttagctgtattccaaggtattttatcttttcttttttttgagatggagtctcactctgtcgcccaggctggagggcagtggcacaatcgcggctcactgcaacctccgcctcccaggttcaagcgattctcctgcctcagcctcccaagtagctgggattacaggcgtgcactaccatgcccagctaatttttgtgtttttagcagagatgggtttcaccatgttggccaggctggtgtcgaactcctgacctcaagtgatccacctgcctcggcctcccaaagtgctgggattacagtcgtgagccactatgcccgactggtattttattatttttgtgaatattgtgaatgggactgtgttcttgatttggctctcagcttggatgttgttggtgtataggaatgcttctgatttttgtacattgattttgtatcctgaaactttgctgaagttgtttatcagatcaaggggctttgggcagagactatagggttttctaggtataaaatcatataatctatgaaaagagatcgtttgacttcctctcttcctatctggatgccttttatttctttctcttgcctgattgctctggccaggacttccagaactatgctggataggagaggtgagagagggcatctttgtcttgttctggttttcaaggggaatgcttcgagcttttgaccatacagtataatgatggctatgggtttgtcatagatggctattattactttgaagtatgttccttcaatgcctagagtttgttgtggatttttttggggtttttttttgagacagagtcttgctctgttgccagattggagtgcggtggcgtgatctcggctcactgcaacctctgcctcccgggttcaagcgattctcctgcctcagcctcccgagtagctgggactacagatgcctgccaccatgcctggctaattttttgtatttcaggagagacaggatttcaccatgttggccaggatggtctcaatctcctgacctcgtaatccgcccacctcggcctcccaaagtgctgggattacaggcgtgagccaccacgcctggcctgttgaggatttttaacatgaagggatattgaattttatgaaaagcctcttctgtatctattaagataatcacatggtttttgtttttagttctgtttctgccatgaatcacattaattgatttgcatacattgtatcgatcctgtatcccagggataaagcctacttgacctggtggattagcattttgatgtgctgctagattcagttacctagtattttgttgaggatgtttgcatctatgttcatctattggcctgaagttttctttttttgttgtgtctctgccaggttttggtatcagcatgatgctaccctcatagaattagggaggagtccctcctccttaattttttgtaatagtttcagtaggagtggtaccagctcttctttatgcatctggtagaattcagctgtgaatccatctggtcctaggctttcttcagctggcagactttttactactgactcaatttcggaacttgttatttgtctgttcagggattcaatttcttctgggtttagtcttggtaggttgtatatgtccaggaatttatccatttcttctaggttttctggcttgtaggcatagaggtgtttgtctctctgggttgggtttttttattattattatttctgtggagtcactggtaatgtcccctttatcaatttctggttgtgtctatttggaccttttctctttttttctttgtaagtctagctagtgatctttttttttttattcaaaaaaccaactcctggatttgttgatcttctgtatggttttcatatctcatttccttcagctcagctttggttttagttatttcttatcttctgctagctttggggttagtttgttcttatttctttagttcctctagttgtgatgttaggttgttaatttgagatctaacttttcaacgtcagcattcatgctataaacttccctcttaattctgccttagctgtgtcccagagattctggtatgttgtatcttcattctcattaatttcaaataatttcttgatttctgccttaatttcatcatttacccgaaggtcattcaggagcaggttatttaattttcatgtaattatatgctttcagtgattttcttagtatttaattctatttttattgtgctgtggccctatgagttcagtttttctgaatttgctgaggcttgttttatgtcttatagtgtggttgattttagagtatgttgcatgtgcagatgagaagaatgtatattctgctgctttcgagtggagtgttctgtagatatctattaggtccatttggtcaagtgtcgagtttaaatcctgaatatctttaacagttttctgccctgatgatctgtctaacactgtcagtggggtgttgaagtgtcccagttattatgtggttacctaagcctcttcataggtctctaagaacttgctttatgaatgtggttgcttccgtgttcgatatgtataaatttgctcccgtgttggatatagtcaaatcttgctgaatcaagccttttaccattatgtaatgcctttctttgtcttttgtgatcttcgttggttggaagtctattttgtctgaaatcagaatagcaatccctgctcttttttccattttccatttgcttggcagatttttttcatccttttactttgaatgtatgggtgtcactgtatgtgggattggtctcttaaagacagcataccattgggtcttgcttctttatccaatttgccacaatgtgtcttttaaagggatatttagtccatttacattcataatattgatatgtgtggctctgttcctgtcaccatattgttagctggttattatgtaggcttgtttgtgtggttgctttatagtgtcactagtctaggtacttaggtgtgttttgttattgttgttgtttgttctttttttgagacagagtttcattcctgttgcccaggctggagtgcagtgatgcgactgtggctcactgtaacctccacctcctgggttcaagtgattctcctgcctcagcctcctgagtagctgggactacaggcatctgccaccatgctcagctaattttttgtctttttagtggaaacggggtttcaccatgttggccagcctggtctcaaactcctgacctcaggtgttccatccgccttagactcccaaagtgctgggattacaggtgtgagctactgtgcccagcccttaggtgtgtttctgtagtggttggtaataatctttcccttccatgtttagcattcccttcaagaccctgtaaggcaggtggtggtaaagaaatcccttagcatgtgcttgtctcaaaaagatcttatttctccttcactcataaagcttagtttgaccggatatgaaattcttcgttgcaaattcttttctttaacaatgctgaatatgagccaggcccagaggctcatgcctgcaatcccagcacctttgtgaggctgaggagtgggggtcacttgaggccaggagttcaagaccagcctagtcaacatggcaaaaccctgtctctactaaaaatacaaaaattagctgggcatggtggtgtgtgcctgtagtccccagttactcaggaggctgaggcatgagaattgcttgaacctgggaggcggaggttgtagtgacccaagatcgcaccactgcactccagcctgagtgatggagtgagactctttctcaaaacacaaacaaaaacaaaaacaaaaacaaaaacaaaaacaaaaacaaaacaaaacaaaaaggctgaatgtaggcctccattctcttctggcttgtagagtttctgctaaaaggtctgctgttagcctggtgggactccctttgaaggtgacctgtcccttctctctagctgcctttaacattttttttctttcatttagaccttggagaatctgatgactatgtgccttggggatggtcttcttgtgtagtatttcataggggttctctgcatttcctgaatttgaattttggcctctctagtgagattgggaaaatactcatggataatatcctgaaatacgttttccaagttgcttattttctctctccctatctttcagggacaccaatgagttgtatatttggtctctacataatcccatatttctcagaggtgttcattctttattttctttatttttgtctgagttattttggagagctggtctttgagctctgggattctttcctcagtttggtcaattctgttgtttattttgaaattctttttttttttttttttgagatggagtcttgctctgttgcccaggctggagtgcagtggcgcgatctcggctcactgttgcctctgcctcccgggttcaagcgattctcctgtctcagcctcccaagtagctgggatttacaggcgtgcgccaccacacccagccgatttttgtatttttggtaaagatggggtttcatcaccttggcaaggctggtcttgaactcctgaccttgtgatccacctgccttggcctcccaaagtgttgggattacaggtatgagccactgcgcccagccgaaattcttgaagtgagtttttcagctccatcagctcagtttggttgttttctttttgagacggagtctcactctgttacccaggctgaagtgcagtggcatgatctcagctcactgcaacctctacctcccaggttcaagcgattctcctgcctcagccacgcaagtagctgggattataggaacctgccaccacacctggctaattttttgtatttttagtagagatggggtttcaccatgttggccaagctggtctcgaactcctgacctcaagtgatctacccaccttggcctcccaaagtgcagagattacaggtgtgagccactgtgcccggccggttttttcttaaaatggccatttcatcttacatctcctatatcgttttattgtatcctttacagtctttggattgggtttcaactttctcctgaatgttgatgatcttcgttcctatccatattctgaattctatttctgtcattttggcttggttaagaaccactgctggggaactagtgcagtcaacttagcagcaagaagacactggcttttggagatgccagagttcctgtgctggctctttcttatcttcattggctaatgttctttcaatctttgaagctgctgtcctttggatggatttttttgggggtggtgcttttatcttctttgatgtctttgggggtttgattgggttcagtcaactggcttcatttctgacagatttttgggggactaaggctcagctcagcactcctgggctatgtcctccaacactggggggctggtattgggcactcagctttgttctctggctctctgaggttgagaacatgcagcactggaggggttgaggtgttcttgggccacagccacaacactctgaagggtagtgccagccaaagcactctgtcggatagtggcagcctatttgcttgtgacagcagcaccagcagtgcaatggggtgcatgctcattggctgaggcagggtgctaggaggcctggggctgcctgcctctatgtgggcattggcagtagcagtggtgcacggccgctggggtctgtgtgcacatttgcaccaatggcagtggtagcacagagttagagctggtgacctctgtgcatgcgttcatgcctgtggcggtggtgttgcggggcccagaatgttaatgagaacagcaaaacccatctttagcagactgggacatgttgcccagactagttttggtttgtttttgtttttttttttttttttttttgagacggagtctcgtgctgtcgcccaggctggagtgcagtagcatatctcggctcactgcaacctctgcctcctgggttcaagcaattcttctgcctcagcctcccgagtagctgggactacaggcacacaccaccatgcccggctaatttttgtacttttagtagagatagagtttcaccatattggccaggctggtcttgaactcctgacctcgtgatacacccgcctcggcctcccaaagtgctgggattacaggtatgagccaccacgcccggccgacccagactagtcttaaactcctgagttcaaacaatctgcccacctcggcctcccagagtgctagaattacaggagtgagccaccataccagccaatttattccgtttctaaaggtgcaaagtttaactggaacttagaaacaaagtgatgaaactatttacagtgaacattgctgttgggtctccaacctccatctcaccctttttgagcagcagcaatataatctggaaaactgacctcactccaggagtgagcctataaattctaagggtaacagtgactgatttggggacgggcagatgacccaattctggccaatgagacatgagaaaaggttcttgaaggtctcaacgttcttgctcactctcagaagaatgcaatggaaagctggcctacccaggcctaccttctccccaactcatccatgggctgtggccaacacatggatgtaagctcagcccacaatgctgcaggcagttgtttcccagccaggagggagacaagatgcatctgatgtgtcagtatgaataaacacttgatcctacagacactgaacatgtgtattttctcttatattcagggaaaacattatatacaattacctctgcctttccgagctgtgctttcttctacccaatacacttttggaagacctttgagaagtcgaagaaggtaaggaaccacacaatctttgtgctaaaaaataataagaagaataataaattagatttaataaaataagtgattggcagctttttagcccagattaagcccaaagcaaagcatatccacatcctaatcatctcagagattctccagggataatgtaaagtgcatgtaaattcacatggcatcactccattcctgttttcacactgcagagtccagaggctgtcctatcaacctgtaccacaggagcctaaggaagggttcgcacctgccttctggagctgagggtccagcctgctcaggcctcttctgggggctgggcctctccaggaggtacacgtgtgtacacactcaaagctgtcttcagtgagaatggtttagagccccaaaacccatccatgagccccagaataagatcctggggatggagagaagctcacaatgcgggcatctcaactgggtgatgcttttttctgttcatgtcccttgtccattttccttgtgttttttttttttaattttctacttcatgtttcctcttgttcttctcaagttgagcatcagactttatagccaactttagcccagtgaaaaattttactttcctctaatttctgaactagccaatcaacaccaatatatagcttcgtaatcttccatcattggcttttggagctatttccctatttacagatgttccagttaaggattagatgtgctccagagaagaagtgtgctctagagaagaggagtactatttgatgttttgaaatgctgacaaaccacatggtagttttaaaaacatggctgcagccaggcatagtggctcatagtggctcacacccgtaatcccagcactttgggagacccaggcaggtgaatcacttgagctcaggaatttgagacccagctggccaacatggcaaaaccctgtctctactaaaaatacaagtattagctgggtgcagtgggacgtgcctgtagtcccagctacttgggaggctggggtgggaggatcgcttgagcatgggaggtgaagactgcagtaagtcaagattgtgccactgcactccagcctgcgcaagagagtgaaatcctgtctcgaaaaaaattaaaacataaaagcatggcagaaggtggccgggtgcggtggctcacacctgtaatcccagcactttgggaggctgaggcaggcggatcacgaggtcaggagatcgagaccatcctggccaatatggtgaaaccccttctctactaaaaatacaaaaaattagccaggcatggtggtgggcacctgtagtctcagctacttgggaggctgaggcatgataatggcataagtaaacccaggaggcggagcttgcagtgagcctagatggcaccactgcactccagcctgggcgacagagagagactccatttcaaaaaaacaaaacaaaacaaaacaaaacaaaacaaaaaacaacaaaaaaacatggcagaaggcatgcagcttccacctggctctttttcaggacatttgccctggaacctagacactatgctgtgataagacccatgaatgagacttcaggtgattcctgcccccagcttttgagccaccccaaccgatgctaaatggagtcagttgagccctgtctaaattgcagattcacgaatcaaacaaaatgatgtattaagcactaagtctggggggactttgttataccataatagataactaaaaacaaagaactttatcaaaaacaaaagttttttctctaaaccataaaaaggaactggctaagacatctgtcgaggatcctagtgtacagacaggaacaaaactccataaggcctgaaccacatggcctcctgcagaggaagtggctccaggtggctctttcctatataaactgtgatgacattagcagcacagggtgagtaaaaccacctcagctcctctggccacagctgctaccatggcagcccactgctgggacctgaaggaggtcaatgcacagcccatcctggagggaagcaaggaatataagcaccaggtaaaaaccaaggtggtccctagggctttctcagggggctggcaaagcatgctaggcttctctcctagtatatgcaaggccggtgggctgccctggacatacaggcaaactctatggtccaagggacaacatcacatgccacctgggaccctgctagtccttacccagaacctgaatgacacttgtgctcatctatttgttgtcatcttaagaagtctaatacaagtacaacactttcaggacttacaggtaaatctatcaagaaacgtgtttgccaaagatattatcaagtaatccacatttgaacaacaatagtttcttataaatttttttaaaattattttttgccctttataattcattttatatttatgtaggatatggtaaacagaaaaaaaaaatggttttctttcttttcacatttataaataaacaggcaagctgggtatggtggcacatgcctgtaatcccagcactttgggaggcctaggcacgaggatcacttgagaccagggttggagatcaacctgggcaacctagcaagaccctcatttctacagaaaattaaaaaatcatgccaatgcctataatcccagctgctcaggaggctgagatgggagaatcccttgagcccaggagttcaaggctgcattaaataatgactgtgccactgcactccagcctaggcgatagagtgacactctaagaataaataaataaatagcagaagaaaggccaaaatgtagcttatgtatctaattttggttttttatgtaaccttgatcaggtaacctatttaattattaaaatactgctctataattaaaattcttatttgtttccaatgtacaaatactgttaaaatattaatgcttattagagcaaaatttccaggagatggaagcaacctgttctagataaatattcaaatatctaacatctttatttacctaacacagcataattaacttggaatttagaaatagtatctagtaatgataaaaataaataaataaataaaagattcaatatccaatgatcaatcatttgtttcaaatagctttggtaaatataaaaatacacatacacaacagtcacactatttttttgttggagctacagggctagattttaagtccctattaaaaggtacactgaggccaggcatgatggctcacacgtggttcacgcctgtaatcctaacactttgggaggcagaggcaggcggattacctgaggtcaggagtttgagaccagcctgcccaacatggagaaaccccgtctctactaaaaatacaaaaaaattagccaggagtggtggctggtgcctgtaatcccagctactcaggaggctgaggcaggagaatcacttgaaccctggaggcagaggttgcagtgagccgagattgcaccactgcactccagcctgggtgacaaagcaagactccatctcaaaaaaaaaaaaaacaagatacactgatacatactctaaaagtttatatacataatcgcaattttgaaaaagatgatattatatcaaaattacctaaaatgattttgtccttttggaaggagaaatacaatacccctgagtctgactgataagcattttacctgagcttgaaaaccaaacctaccctggaaggcacacaattacttctcaaagcattttaacttactctgtggcacataataacaaacaaacaaaaatacactttttttacaacataatatatgcacacaattctaaaaaactcaaattttctaagaaggtttacattaggaagtttcattcccaccttgtcctaccctctccactaaccactttgattaggttcaaatgtattcttctactattgctttaggtaaatataagcagatacaaacttaaacgctcactacacccccttttacaatgaagaaacttttaatttcatgaagacttacctgaagatcagattcaatcagaaaaatgcccaatgcaatcactgcatctctccgtctttcatctaactggaagatcccatggaaatccactggacacatgcaaagaagcttttggacctagaaaatgagacccccccaaaaacagctctacaaaatagaaaaccacattcaaaataaagcaagctgagtgcagtgtcatatgcctgcagtaccagctattcaggaggctgaggtgggaggataacttgagttgggagtttgagactagcctggccaacatagtgagaccctatctcttaaataaataaaaataaaaaataggccaggtgcagtggctcacacctgtaatcccaaccctttgggaggccaatacaggtggatcacctgaggtcaggagttcaagaccagcctggccaacatggtgaaaccccatctctactaaaaatacaaaaattagccaggcgtggtggcgcacacctatcgtcccagctacttgggaggctgaggcagaagtatcacttgaacccaggagacagaggttgtagtgagccaagatcgtgccactgcactccagcctgggtgacacaacaagactctgtctcaaaaacaaacaaacaaacaaaaccactaccataaaccccaaagagtccatgtaaccaataagtcatagttttttttcagttaaaagatcacaggacatctccagctgctgaaacaattgtacacgtgcccctcaaaacacataaactctgagtaatatgagctgaaggttaaaactgtgtatactcagagggggtaagacacaatggctaaagtttgcattttggtgttaggacagtctaagtgggtgtccccaccccttgaccacgaacaggttacccaaaccaacctgcattaacaatgcctcactgactcttttaaaaaatcaaatgcatggccaggagcggtggctcacgcctgtaatcccagcactttggtaggccgaggcaggcggatcacgaggtcagaagtttgagaccagcttggccaatacggtgaaaccccgtctctactagaaatacaaaatgtagccaggcatggtggcgagcggctgtaatcccagctactcaggaggctgaggcaggagaattgcttgaacccggaaggcggaggttgcagagagccgagatggcaccactgcactctccagcctgggcgacagagcaagactccgtctcaaaaaaaaaaatcaaatgtgtgaagcagttgggactgagcacagcatatagtaaatgctcaataaacattatctattgttattggatatactataatagtggctagtggaaggcaaaagcagacaatgagattcaaagaatgctgattaatgagtcaatcactgaagcacagggaagaactggccctatcaaagcctatgtactttgctctgtcctatgcaatactttatcaataccctgcactaaaacacagaagatacattccactacaaacctggcagatgaaactaatgtgctagaagacagcacgaagacttgaaaactcatcaaaattggcataacatcattatttctccaacaatagtgcctgaaagacaacttttgataatgtgatcagggagggcctctctaagatggttccttaaattgggatctgatcaagaaggaagccaggacaaatcaggaaaggctgctgctgcagcagcacagtggaaaagaagaagcaaggaggcccaggagttcaggtccagacagagaaggtccccagagggccccacaggccaggtcagaagcctgaattgtatcctaataacaaacacatagaggccttagggcatcaagtttagaactgaagtctagaagaatccctctggctgatacacagaaaatggattttggaggacaagagtgaaaacagagacaggtgaggagactcctgcagcagctgaggagactcctgcagcagctgaggcgaagatgttagcatggtagcaatcaacgagtagagacagaaacagaccagttcaggatgtgttttgaaggaagagttaagaggacttgatgatggacaggatatgggagagattactttagttgcctctttaccacactagaaagtatccaggccaggtgcaaggctcatgcctgtaatcccagcactttggaaggccgaggcaggaggatcacttgagcccaggagtttgagaccagcctgggcaacacagtaagaccctgtccctacaaaaaaataacaaaattaatcagctattgtcagaggcgtgtgaaccagagcaactccatcctgaataggggctgggtaaaatgaggctgagacctactgggctacattcccaggcagttcaggcattctaagtcacagggtgagacaggaagtcaacacaagatacaagtcataaagaccttgctgataaaacaggctgcagtaaagaagccagctaaaacccaccaaaaccaagatgtctggtctcgaactccttatctcaggtgatacgcccacctcggcctcccagagcgctgagattacaggcatgagccatcgcaccctgccaccaaggctttcttttttacataaagcataagaatggatttcctctctcaggccaggtgctctgggttgggctctaacaatatcccaggatcagaattcagcatcatcaacacagtttagccatactgccagtgcagcggtcaccccacccagtagaaagaactgaaggcagcattttttaccatcctcaattcctctggactgccagggcctcctctctttcaaatgcccagaggggctctggggtactctgacttcagaccttcctcccctatccccactcaactaaaaacatttaaatagaaataatctgtgaccattcagaaattactttaaaagccaggcatagctttaaatgtgaagtgaagataccaaaaagaacaactcagagatccatgtaatgattccatgatttatgcactacactggcatgtcaggcagaataatggcacctcaaagatgtccacaccctcaatcccctggaagctgtgaatatgttactttacatggcaaaagagaccttccagatctaattaaattaagaaccttgaaatggagggatatcctggattatttagataggcccagggcaatcacaaaggtcattaaaaggagaagagagaggcagaagagggagtcagagtgatgtgagatgggggcttggccaaccattgctccctttgaaaatgaaggaaggggccagaaatcaaggaatgtgggcagctctaggagctgtaaaaggcttggaaatgatggctgggtgcggtggctcatacctgtaattccagcactttgggaggctgaagtgggtggatcacctgaggttaggagttcaagactagcctagccaacattgtgaaaccccatctctactaaaaatacaaaaattagccgggcatggtggcaggccccgtggcaggtgcctgtagtcccagctactcgggatgctgaggcaggagaattgcttgaacccgggaggcagaggttgcagtgagctgagattgcgccactgcactccagcctgggcaacagagcaagactccatctcaatatatacatattaaaaaaaaatgaaaaaggcttggaaatgagttctcccctagagtctctaaaaagatacacagccctgccatcaccttgatttcagtccagtgaaacacaggttgtgtttctaatctacagaactgtaaaattataaacgtgttattctaacaacaagtctgtggcaatttatttacagtagtaataggaaactaatgtaattggtcactggtaattaaacaaaactcaaagcctactggactgcctatcaagaaaagtatcaaactgagtaatcagattacaggcaataggccgggcaccgtggctcacacctgtaatcccagcactttgggaggttgaggtgggcggatcacatgaggccaggagttcgagactatcctggccaacatggcaaaactccatctctactaaaaatacaaaaatcagccaggtgtggtggcctgggcctataatcccagctactcgggaggctgaggcacaagaattgcttgaacccaggagccggagatagcagtgagccgagattgtgccactgcactctccagcctgggccacagagcaagactctgtctcaaaaaaaaaaaaaaggccgggcgcagtggctcacgcctgtaatcccagcactttgggaggccgaggtgggcggatcacgagatcaggagatcgagaccacagtgaaaccccgtctctactaaaaatacaaaaaattagccaggcgtggcggcatgcgtctatagtcccagctacttgggaggctgaggcaggagaatggcgtgaacccgggaggcagagcttgtagtgagccgagactgcgccactgcactccagcctgggcgacagagcgagactccgtctcaaaaaaaaaaaaaaaaaattacagacaatatttagttccttctttattattttctgtatttcccatattttctataaaaaatattgataactttagaatcagaaaaaaatacggccaggcatgggcttacgcttgtaatcccagcaatttggaaggctgaggcaggagggctgcttgagcccaggagttcaagaccaggctgggcaacatggcaagaccctgtctctacaaaaaatttaataattagccaggcacggtggcatgcccctgtagtcctagatgctcggggatccgaggagggaagattgctagaggatcgcttgagcctagcaggttaaggctgcagtgagctgtgatcacactactacactccagcttgggtggcaaagcaagaccctatctccaaacaaaaaaagaaaaagaaaagaaatacagaatataccgaagttcatgtgctgcactgatatgcttacctgaactgcaggcctaaggatcactgacaactcccaaacatatgaagaagtgtaggtctaaggtcaggagaggttgcacagatgcaaccagcaaacgttcactttcaggcaggccatgtgttatcctattcctgttttacaggttaggcaactaggtccagataagttaagtgcacctgaggcaacaggttcctaactacatcttccttctcattttgtctcttcctactccaatatttccacttctggttcatataccttcaatggttccccattgcccaatgaacactcagtgcacactcccagccccaaaacttctctcataaacccaggccgctatgtatcaattctcatttctccctgcctggcctcttccatggttttgacccatctgaaacattttgtccaacctgccctatctcccctataaaaattcaacccatccttccaagatccatctcaactgtctcaaaactctcaaacattttccagaccccagcaacttgatgtaatatctcccatcatatctctcaatagctcacatagaactctgtatttctcaagataattaccttcctgatgtcttacagttacttgtatacttatcctctcactgcagagaggcctgtgacctcctcatcactccactgcaccctacacatttcagaactttaacaactacttaatgggactaaagcggccaaggtcacagacatttgataaggtgaggaggaaagaaaagaggtacagggctactagaaagcagggtttaactacactgtgataattgtcatatagtcagtaccaggcacagtgctggcatgcagttgacactgaacaagtatctgctgccttactgaatgaatggagggacggatggaagaactctcaaatgaagtaatatataatgtacagtcactccctcatgagcgttacaatccagcaggagttacaaaactaataaaaataatacaactagcaaataacacaagtcagaaactaaacgacagagggccctgaaagcctggagcaaaatgctcttggaaactgggactcttattagaaagacatctgaaaacttgaacctgggtcctacagaaaccatcacacccagttctggtgggtgccattctccaaataatgacagctaacacatattgaacatttatcatgtgttcatctatattatcttatttaatcctcacaacagctcattaggtagctattattaatcatcccccttttacatatgatgaaacagacacagagaggtcaaagtcctaatgcaggataaagcattaaccctctagtctttgaaaaaatgaaaagaaaaataacatcaaatggcttttcagaatcagaattttacaataaactagcaagttgtttgtttttaggggtcttagggggagtgggtcattataaaaagtcattaagcccaaaatctgaccacgatggccagggttattcccatttacaaaaaggatccagagggcttctacccaccactttcaaaaggttgttaagtcaatggaccacagggaggcaacaaatatgactgacttagactttgataagaactcttggcaatactttaacccaaggatattaaaagacaggtatctcaaagatgtgaattttgactgccaaggtaaggaaatgctaaaccaaggagaaaataagattcaaggagaaagtaagtctggatgactgggcagaaaattgcagatgagaatcaaccataacagagggtatttgtaaggtatttaggtcaaaataaagctacaataatagcattataaaagttggataattaaatgatttttttaaaagagtactacttgttatttaaaacctctgggaattgtcttcctggagaaacaaaattctctgagaacaaaagactaagatttaagtattaatggtatatttttctgttaaaaccatttgtaattgtctttctcaaatgtaccatcccctcagacaaaaaatattgaatataagctgatattttcgaagtgactcagagctatcatgataaacaaaggtgactgtgacatgatacacatggacctacaaatgtaaatggaacagcacctgatcctacaagcaccctggatcagagtttcattagagatgcgcttttgagctgagcgcggtgggaagtgcctgtaatcccagctgcttgggaagctgaggtgggagtactgcttgagcctaggagttagaggctgcagtaagctatgatcgtgccactgcactccagcctgggcaacagagcagaatcctgtctccaaaaatacaaaataaaaaagatgctctttggtcatctgtagacagattcatgaccttctaacaaacaaattcagcaaggttacaggacacaagattaagatacgaaaatcagccgggcgctgtggctcacgcctgtaatcccaacactttgggaggccgaggcgggcggatcaggaggtcaggagattgagacaccatcctggccaacacagtgaaaccctgcctctactaaaaaaaaatacaaaaaaattaggcaggcttggtggcgggtgcctgtagtcccagctacttgggaggctgaggcaggagaatggcatgaacccgggaggcagagcttgcagtgagccaagatcgcgccactgcactccagcctgggcaacagaacaagactctatctcaaaaaaaaaaaaaaaaaaaagaaaagaagaaaagaaaataaattgtatttctacaacgcagcaatgagcaaattaagaaaactattccatggttaattttatgttatatgaactttatctcaattattaaaaaaaaataataaagaaaaacactaacgcaggaacagaaaaccaaatactgcacgttctcaattataagtgggagctgaatgatgagaacacaggaacacacagtggggggaacaacgcacgctggggcctgtgaggtgggggagggagaatatcaggaaaaatagctgtcaggcacagtggcccatgcctgtaatcccagcactttgggaggccaaggcgggtggatcactttaggtcaggagttcaagatcagcctggtcaatatggtgaaaccccatctctactaaaaatacaaaaattagccaggcgtgggggcaagcgtctgtagtcccagctaatcaggaggctgaggcaagagaatcactagaacctgggaagcagagattgcagtgaactgagatcaccacagtgcattccagcatgggcaatagtgcaggctcaaaaaaaaaaaaaaaaaaaaaagggtggggggccaggtgcggtggctcatgcctgtaatcccagcactttgggaagccgaagtgggtggatcatgagatcaggagttcgagaccagcctgaccaacatgatgaaaccccgtctctactaaaaatacaaaaaaattagctgggtgtggtgcaacgcgcctgtaatcccagccactcagaaggctgaggcaggagaatcacttgaaccgaggaggtggaggttgcagtgagccgagatcacgccactgcactccagactgggcaacagagcaagactccatctcaaaaaaaaaaaaaaaaagtaatagctaatggatgctgggcttaatacacaggtgatgagaagatctgtgcagcaaaccaccatggcacacatttaacaaacctgcacatcctgcacatgaacctaaaataaaagttgaagaaaaatgaataaataaaaatgtaaaaagaaaaacaactgtaataatcccagcactttgggaggccaaggcaggaggattgcttgaacccaggagtttgagaccagtctgggcaacatagtgagtctctaaaaaaaattttagaaattaaccaggaggctgggtgcagtggctcacgcctgtaatctcaacactttgggaggctgaggcgggtggatctcttgagcccaggaattcaagaccagcctggggtacatggtgaaacccaagaccaacctggagtacatggtgaaacccagtttctacaaaaactagccaggccatggtggcttgtgcctgtagtcccagctacttcagagactgaggtgggaggactgcttaagcctgggaggtccaggctatagtaagctgtgataataccactgcataccactgctctccagcctgagtgatagtgagaccctgtttcaaaaaaaaaaacaaaaaaaaccagtagaacaatttcatttaaaatagcatcaaaaagaaaaagtacttatgaataaaaacaaaagaagtgcaaaactaagaaacattacaacattgctaaaagtaaagaaaacctaaataaatggaaagacatcccatgttcatagatcaaaacagttactattgtttagatggcaatacaggccgagcacagtggctcacgcctataatcccagaactttgaggggccagggtgggtggatcacctgaggtcaagagttcgagaccagcctggccaacatggcaaaaccctgtctctgctaaaaatacaaaaattagccgggcatggttgtgcacacctgtagtcccagctacctgggaggcagaggcaggagaattgcttgaacccaggaggcggaggttgcagtgagctgagattgtgccactgcactccagcctgggtgacagagcgagactccatctcaaaaaaaaaaaaaaaaaaaaaaagggacaatatagcaatacagtccaaactaacctacaaattcaacaccatccctgtcaaaaccctaggtgagttctttgcagaaactaacatgctaaccctaaaatttccatggtaattcaagggacccagaataacaaaaacaatcttgaaaaggaaggacaaaattggaggactcattcttcccaatttcaaaacttactacaaagctaaagtaatcaagacagtatactagccaacatcaggaaagacatacagaccaaataaaccctcacacttacagtcaactgatttttgacaagggttccaggacccctcaatggaaaaaagaatagtctttccaagaaatcgtgctgagacaactggatattcacatgcaaaagaatgaaactggacccccatctcatatcacataaaatcttaactcaaaatggatcaaaaactcaaatgtaagagctaaactataaaactgctaacaaaaaacacaggtgtaagtctttgtgaccttgaaattagacagtggtttcttagatacaacacaaaaagcacaagggacaaaagaaaaaaaaaatgacaaaatggacatcatcaaaatttaaaacttttgtacttcaaagaacaccatgaagaaagtgaaaaagcccacagaatgggagaaaatatttgcaaatcatatatcttattaagaaacttttatctaaaataaagaactattacaacttaattaaaaaaatactacaatttaaaattgggcaaagaatctgaatagatatatctccaaagaagatctacaaataccccaaaagagtggctgttctaggatagaataggctggctcaacatcattaaccatcaggcaaatgcatatcaacaacagaataataagatcccacttcacatccactaggatggctataactggaaagacagacaatacagagtgttggtgacaatgtaaagaaaacaagccctctgtacaccgttggtgggaatgtaaatggtgtagtaactttggaaaacagtctggagttcctctaaaggttaaacctagagttattgtatggcccagcaattccacatctagttaaagacccaagagaaatgaaaatatgtctacagaaacacttgtacgtgaatttccatagcagcgttatttataatagtcaaaatgtagaaacaatccaaacatccacctactaatgaatggataaaatatggtatatgcatacaaatattatttagtaataaaaatgaagtaatgagatgctacaacatggatgaaccttgaaaatacgccaagtaaaaaccatcatggcaggtgcagtggctcacacctgtaatcccagcactttgggaggccgaggcaggtggatcacaacaaggtcaggagatcaagaccatccggctaacacgatgaaaccctgcctctactaaaaatacaaaaaattagccgggcgcagtggcgggcgcctgtagtcccagctactcgggagtctgaggcagaagaatggtgtgaacctgggaggcagagcttgcagtgagccgagatcgcgccactgcactctagcctgggctccagagcgaaactctgtctcaaaaaaaaataaaaataaaaataagccaccacaaaaaaccacatcttatagaattctatttctacaaaatgttcagaataaatctacagagacagaaagtaaactagtggttgtctagggatggggctggtagggctgcagggtaacagcaaggtttcttttgagggcaatgaaaatgacctaaaattgatcatggtgatggatggacaactctgtgaatacactaaatatgatgaactgtacattttaaatgggtaaattttgtggtatgtgaattatatctcaagaaagcactattgaaaaacctagcctatgaaggatcaaatcaaaccacaagcaactgccgaccagaacaaagcccaacattccctaaagtaacacaacaaaaatctaaacactcaagccaggcacggtggctcgcctgttaacaccagcactttgggaggccaaggcaggtggatcacttgaggccaggagttcaagactagcctggaaccccgtctctactaaaatacaaaaaattagctgactgtggtggcgcatgctaaaggagtccccataggtctctgggactataaatactcatttaaaaaaaaatttttttttttgagacggtgtcttgctctgtcacccaggctggagtgcagtggcgtgatctcagctcactgcaagctccgcctcccaggttcatgccattctcctgcctcagcctccccagtagctgggactacaggccaccacgcccagctaattttttgtatttttagtagagacggggtttcaccgtgttagccaggatggtctggatttcctgacctcgtgatccgcccgcctcggcctcccaaagtgctgggattacaggtgtgagccaccgcgcccggcctactaaaattttttaaaattttcgctgggtacagtgactcaagcctataatctcagcactttgagaggctgaggtgagtggatcacttgagcccacggtttgagctaagcctgggcaagatagtaagaccccatctctaaaaaaatttttctttttttacttagccaggtacaatgtgcgtgcctgtagtcccaactacttgggaggctgaggcaggaggatccctcaaaccaaggaattcaaggtggtagtaagttatgatcatgccactgcactccagcctgagtgaaaaagcaaaactgtctccaaaaaaatgtaatttctatttttaaaaatgtctaggccaggcacagtggctcatgcctataatcccagcactttgcgaggccgaagtgggcagacggcttgagccctggaatttgagaccagcttgggcaacacagtgagaccctatctattttttttttaatgtctatttatccacccctctaataccagggcctagcacagtgcctgcaacacagcaaacccccaaagatttatcatatgaacggatggtgccatcttttgctttcataatagtatagccttgggttttttttgttgttgttgttgttttttgtgtgacggagtcttgctctgtcgcccaggctggagtgccgtggtgcaatctcagctcaccacaccacctcccgggttcaagcaattctcctgtcttagcctcccaagtagctgggcttacaggcgcacaccaccacgccctgctaatttttgtatttttagtagagacagggttgcaccatgttggccaggctggtctcgaactcctgacctcaggtgatgtgcctgcctcagcctcccaaagtgctgggattacaggcgtgagccactgtgcccggctgcgttggttatcctgaatccaggcttccagataagctttaaacacagaaaaacattcaggaaaagagaatggcttctgcagcagagacagagcctctcaggactcaataaacaaatgcaagtgagacctgaggatttctgcctcaactctgtatttatttgtcagtttaccacacaaatgaaagtagcgttctggccaacttggcaatgttcatgaaaggccaagcttttctccagcatgccaacatatacaacaaaagcaaatacaaaaataaaaatataaataagccatcctggctaacacagtgaaaccctgtctctactaaaaatacaaaaaattagccgggcgtggtggcgggcgcctgtagtcccagctactcgggaggctgaagcaggagaatggcatgaacccaggaggcagagcttgcagtgagcagagatcacgccactgcactccagcctgggtgacagagcaagactccatctcaaaaagtaaataaataaataaacaaataagcaatcaggaagataaaatgcataaatttcagcaactgacgtcaatgatggaaatagctgctggtgggaaagattagaggcaaccacacctccaatgagtgcaaactgcaaacacagacagcagaaaagagaatctgcagtaaggagtgagaaatagaacatttctgccccctggggagacaaacagctggtgacacaggagggcactgagggaaggctacgtgaaggcagagggagaaagtggcctcggaagaaatcaacattgctgacaccttcatcttgaacttctaacttccagaatgaggaggaaatatatctgtgttgtttaagccagtctgtggtactttgttatggcagcctagcaaactaatagttaatatggcatggttacaggtaaagattttttcttcttccaatttcttcttaaaatattttctagttgatttaataacaatgattctggcaccgcgtataccctccgctgaccctcattatctctctcctctcgctctacggatggctcttcttaacatagcctcacaaagcaaagggaaagaggataggaaattcttggcttcatgatactggaaaaacgccaacactatgatttttactccatggcagaccactctaaagtacagactgaataaccatgaactccagaaagcccactaccctaagcaccaagccacatattctcccaactacagattagaattaactcatcttatggagcacatatgtccaccaaggagggttcagcctgtccctaatgccgcagtgccatttaaacatcagatcgggctgggtgcagcagctcacacctgtaatcccagcactttgggcggccaagaaaagagaatcacttgagcccagaaatctgagaccagcctgggcaaaatggtgagactccgtctctattttctttcaaaaaccagatcaatagttagctacgacacctcaggattctggcattctaactgaagaaaacaaagagaacattttaggacatggaaaaagggctctgatcaaagcctcctgagggtggggagaggaatagaaggacaaggaatgctatctactttgcagctctgcccatgactctcggtatcccaggatcgagggcccactggtttaatacaggcctatagaggagagacacaaacaggccactgaacttccctgacaaaggaagattaaccaggcagggccaggaggaagcttagtaggggtggctcagcaacattctgaagacaggtgagaaccaggaaagcagaacaagactagcgggcagatagaaatcaggaaggaggagtctggaagccaactgtatatggagatcccaatgttgaaaagcctcactttctttcttgcctatttttttcttcttatctttctcccagagggagagggctgaggactgggtaggatttggttcaaagggcttcacagacagagtgtcctctgaggtgggttccaatcctgggggtgggaccccagtctaaagcacagcctagcaggaaaagctcaaagctcagccatggatcagaacagatgctcaagggtcttggctttggctatgggaacatggcaggagtctagtcaccagacctgaaatatgagagtagaatgggatcttggtcaggttggggtagctcacacctgtaatcccagcactttgggaggcgaaggcaggaggatcccttaagccctggaatttgagaccagcttgggcaagatggtgagacccccatctctaattaaataaaaaaaaaaaagtagatgggatttatggtatttcattggttcattaaaggaaagagaaaaaaaaaaaagagtagacgggaaacttgtagcaaggctgacttgctgctgttcacctgagcaatcaaattaacactgcttctgatttacctggggcctagcacataccaaggagcagcaggagctcaataaatgttttctgaaagtaattttgttttttttgagacagagtctccgtttgtcgcccaagccagaatgcagtggtgagatctcggcttactgcaacctcagcctcctgggttccagtgattctctggcctcagcctcccaagtagctgggattacaggcgtccgccaccacgcctggctaatttttgtatttttagtagagacggggtttcaccatgttggccaggctggtctcaaactcctgacctcaagcgatcagcctgcctcagcctcccaaagtgctgggattacaggcgtgagtcactgtgcccagcctaaggtaatttttttttttaagtaaagtccacagagcagtaataggcttggtttcatggactgggattagagtgagtgactagagtaagtaaacacaactgtggcatgtagagagacaaaggtagggaaggttatgtcattaatgtacctcaagtgtcactaaaaccatgtcagggctgcctgagttaccaatgtctgagctgagatgtgaggtctggttctgcaaacttagccttcgccaggtcaaccctatctagatcaagccccacgcagtcctccaatctctcaggaagaaagaagagaaaaaaatagaagcaaagagaaggggaagagggaagagagaaggggagggattgggttttaaatactcatctccccctataagtctccatctttattatctcaggtgcgtactctaaaattcctttactcttaagaacaagaaacttggccgggcgtggtggctcacgcctgcaatcctggcactttgggaggccgaggtgggcggatcacctgaggtcaggagtttgagaccagcctggccaacacggcgaaaccccatctctactaaaaatacaaaaattagctgggtgtggtggcaggtgcctgtagtcccagctactcaggagactgaggcaggagaatcgcttgaacccgggaggtggaggttgcagtgaaccgagatcatgccactgcactccagcctgggcaacaagagtgaaactgtctcaaaaaaaaaaaaaaaagaacaagaaacttttccttgggaatgctaagggctttttgtcaattgcttcaaaaggaggaatgtagtaaaacacatattataggactacatattttatatatatatatttttattatactttaagttcaagggtacatgtgcacaacatgcaggtttgttacatatgtatacatgtgccagggactacatattaacaatgatccctagcataatcaagtcgcaagatcttagataaggatgagaggaattcacatatatttaatggggtcagccacttacagaagcctcctctatgaaataaggtgcttcaggggtccccagactgcccacatgtatatagttgtactcatggctaaattttttacagtgaatggatatcagcaataggaaaggacctcaagtgtcactaaaagcatgtcagggctgcctgtagaaacccatgcacaggcttccttatgttctctccctcctgtgaggatatacatcaagcttgctccttgctacagcagcaaaatattcaatacatgtgtgcagtttgtgcccaggaaagtccattagagaatcagcaccctaagtttttaatttatgcaccaccagcctagccatcagattcccagaaggaaagcaggtattcaacataaatcatagtttgtaaaaaggatctaggcatagtgaaccatctttattactaatagttacaggattgaggaaagcattcaagtgcttatttcccagatgccagccaaaggccaactttgtaagcaggctcttgtaaaaacagcagccccagtgctgctctattcactcttcttcacagaagtgattagtaatagctaggcacagtggctcatgcctgtaatcccggcactttgggagaccaaggcgggtggattacttgaagtcaggagttcaagaccagcctggccaatagggtgaaaccccgtctccactaaatactaaatactaaaccccgtctctactaaatactaaaaaatttgcccggggtggtggcacacgcctgtagtcccagctactcaggaggctacagtggaaaaatagcttgaaactgagaggcagaggttgcagtgagccgagatctcaccactgcactccagcctgggcaacagagcgagactccctctcaaaaaaaccaaaaaagtgattggtaaatgttgccaatgagactgaagtacttcctaaagtaagtggcattagggagctgccaacctgtggctatggctgtgttccttgtaaaatataatctttttcttttttttttttttttgagacagttttgctcttgtcacccaggctgaagtgcaatggcgcaatcttggctcactgcaacctctgcctctcaggttcaagcgattctcctgcctcagcctcccaagtagctgggattagaggcacgtgccaccacacctggctaatgttgggtttttagcagagacagggtttcaccatgttggccaggctggtctcaaactccgacctcaagtgatctgcctgtctcagcctcccaaagtgctgggattacaggcatgagccaccgtgccccatcataaaatataatcttgacaactgaagcagttattactacaaagctaagaatgttgcaattacagaatgttctcgtgactagtgaacatggctgaagaagcaaattgagctcaaggtgcccttttctgagttactgagtggaaagggtgctaccactgctggagctgcaggaccagcttcttaaagatcatccaattcactgcattctcttctctctcctcccagaatccagcaatcagtcataagatatatttgttggctctcctgctaagaagcgaatgtgctgactagctagcatgagtttgattcaataaaacagcactacactccattagtcagactatctaatgataacagtgctcatacattaggtacccacgtgcctttttgttgctcttcacaatactcctatgaagtactaccttgtatttgacagaagatagcaaagtatcagagaagggaactgacctgtctagagtcacactagtgaaagcaagtgatacaggatttaaattcagaggttccattttccaaactcatgtcctttccattgcattgtactccctctttagctagaagtcaggttagcaccaatctgccgggaccttctcaccccgaaggtgcatgataaaatcaaatatgagaaccgacaaggccaaggaccaggtcactctgccaaaagtgcctaaaacagcctttcagcttcatccatcagcagacagccacaaaaccactcccaactgcagcaggctggtctccggtcaccactgtcttatcttgtcggaaaacatcctctctccatgtgccaaaaagttgagtgggaaaataattccatcctttcagagctaaacactgtgctgagtctcatcgcacacgggtgggcaaagaaagttgacatttactgctcacccactctgtgccttgacctgtgcaagatgctttatgctagaactcatttaattctcaagaacaacctcattttacagataaggatacagaggctctaagagttaaatttacccaagaggacatggtaagtaagtgccagtgcagggaacaaattcaggtcccactctaaaatctgtctctttccagatctcaaggcacaccactgagttgcctttcacctttctcccaagatgaggattgctctggcatgacttcacctttctcttctgaagcaattccaagttcacttctctgcccactgacagttcactctcctttccctgccactgtcccttctgcaaacgcacaatcttttacccaacctaacgcccccagcctcgtagaataacactgcgcagttggtttacagtcacaaagcactttcaagacagtgtttcgtctcctggtcaccacagtccggtgaagccggcaaagcagataaaagcatccccattttacaagaaagccatcttcccaaggtcgcggaataaaaagcaggtgaaatcggaagcagaaccccaggtcttgacccctggtcctcggctcatcccactgctccgcacagccgcccacgatccagcctccacctccgcgatgtcacaagatgctccctgggccagcagctcacatcccccacccccatcccacaaccacccacctgcagcggccctgcaggccccgccgacccttcccccacggtccctctctcttcaccagcccctcccactagggcctccttcccccgctagatccctccgctcaggcgccccctcccgcacaggctgccggcgagcccagcctcggcctcccacagaccctcgtcccgcctccacgcttcgtcaccccagcccctcctcctgtcagcccgcggcccagcccgccgacgttaccttctccaaggatgctggtctctgcaccgccagggagcgggccagtgacaggaccgtgttgaaatagaagccccgcgaggcgctggagccggagccggagcagccgccgccgcctccgcctccgcctccgcctccccgggccggggccgccgccatcacctcacgagccgcggcgctgcccgccggctccccgctcctggcccgcgagcgcccgacctcagggcgcaggcgtaggtgcatccggctttcccgccacgtgacctctcagttgctgacactagatagggcgtggctgcggggcgggcccaccgctgcaggggagagaggggatggacagtaggctgcggttgcgcgcgccggatgtgggccccccccagccgacctgcgcgatggtcggctccgagggcggggccacctgcgcgcgacgcgcggaaggagttcgcgcgacgaccgcggggtcggcgggcggggcgaggccctggacggcggcggcagtggggctcctccttctgtttcccagaccgagagccgcgccggcaccatgtcagcttaccctaaaagctacaatccgttcgacgacgacggggaggacgaaggcgcccggccggccccttggagggacgcccgagacctccccgacgggcccgacgcgcccgcggacaggcagcagtacttgcggcaggaggtcctccgcagggctgaggccacggccgccagcaccagcaggtccctggccctcatgtacgagtccgagaaggttggggtcgcctcttccgaggtgagcctggggcagggctggtgtggactcgccggtctctgtgctgtcaaacggagacgagaaatgttttgctcacaatcttttgagaattctcaagttgcctagcatagattcttgcaccttagtgactcgatggtggtaacaatctgttaactatgtaaaggtatgtgcatctggagtacttgaagagggcagtttaccccagaaatcttccttagctattagtctgcttcgttgattttttttttcttacgcctagctcacggggaaacgccagattattttctgtccaggtgagtaaaaattctgaacagcaggtcctaggtttgggaaatggagagtccgtttcttcgacattatttcctgtgcaaaatctggcacagggttttggccattccttccggagtgagccagaaagagaggactatgtgcctgcgagtgtcaggtgataccctgaagcatcagggcaggtggtccacgagttcttcccgcatcattgacatctccacctaaccaaccaatagaggtattgaagtcccttcagcccagacagctgcctagttgaccaaagcctgggtttgattgagtccagggtcttacctttacttcccaaatcctagacaaatagtgtgcgggttaagagtttgttgctccaactcatcttcatcagttcttcccatccttagatttcagagagtagtaccttcaataacaattattctggccgagcgcagtgactcacgcctgtaatcccagcactttgggaggcctaggcgtcggatcgcctgagctcaggagttcgagacccgcctgggcaacatggtgaaaccctgtctccactaaaattaaaaaaaaaaaaaaactagccgggtgtggcggtgcgcctgtagtcgcagctactcaggaggctgaggtaggagaatcgcttgtacccgggaggcagaggttgcagttagctgagatcgtgctgctgcactccagcatgggcaacagaccgagatcctggagggtctttttctttttcttttttttttttttttgagatggaatctcgctctgtcgcccttgcttgggtacagtggcatgatctgggctcactgcaacttccgcctccgggattcagacgattctcctgcctcagcctcccgagtagctgggactacaggtgcgccgccacacccggctaattttttttgtatttgtagtggagacagggttttgccccgttggccaggctggtctggaactcctgacctcaggcagtccgcccgctttggcctcccaaagggctgggattacaggcgtgagccaccataccggtcgagaatgattctttattgtacaccacagtctctcttcagcctgctaatgaaacagttttgtttggacagagaaaaaaaaaggtttaaaaaaatgtataagccaggcgcggttgtacttctgtaatcccaacaatttgtaaggctgaggtaggcagatcattttagcccaggagtttgagaccagcaggggtaactgcgtctctacaaaatttgaaaaattagccaggcatggtggcacacacatgtgagtgcagctactgaggaggctgaggcaggaggaccgcttgagcccaggatgtcaaggttgcagtgagccatgttcataccactgcactccagcttgggcgacagagcaacacgctatcatttccccttgctgttttcttgggttaattcccttccccacctctctctgttcatgtatccctcattgatccacctccctgtggttttttttttttttttttgagacagattctcgctctgtcaccagactggagtgcagtggcaccaacttggctcactacagcctccgcctcctgggttcaagtgattctcctgcctcagcctcctgagtagctgggactaaggcgtgcactaccacacccagctaattttggtattaatagagttggggttttgccatgttggccaggatggtctcgatctcttgacctcgtgatccaccacctcggcctcccaaagtcctgggattataggcgtgagccactgcacctagcccacctccctgtgtttaactgttggttttttatttttgttttgtttgagacaaagtcttactctgtcacccaggctggagtgcgatggtgtgatctcggctcactgcaacctccacctccccagttcaaatgattctcctgcctcaacctcccaagtagctgggattagaggcacctgctacaacacctggctaatttttttgtttttgtttttgtttttgtttttttggtgttttttgtttttgagacggagtcttgctctgtctcccaggctagagttcagtggcgcgatctcagctcactgctacctctgcctcccaggtcaagcgattctcctgcctcaacctcctgagtagctgggcttacaggcacccgccgccatgcccagctaatttttgtatttttagtagagacggggtttcactgtgttggtccggctggtcttgaactcctgacctcatgatccacctgccttggcctcccaaagtgttgggattacaggcgtgagcgaccacacctggcctctgatttttgtatttttagtagagacaggtttcgccatgttgggcaggctggtctcaaacgcctgaccttaggtgatctgcccacctcagcctcccaaagtgctgggattacagatgtgagccactgcgcccggtcctaaccttgttagggaggttttgcctgtagttcttacatctcatacctactggattcctatgttccattctaaatgggaagtcttggcttagatttgagaggattgcctgaggttttagggccctggtgaatgggtcacatgattgaggatctcaagcccaaggaattcaactaacaactatttaaggagacatctttgtaaactgagaacaaatgaagtagggaatcaatgattcaaagtagggcattgtggcagaggataaacttgaatctagcttttaaggctgaggtttacacaagaggagtgagaatgagggatgttcttagggaagacaggaaaatatgcaaatgcactggcccagcaacagagctcctgggtccagaggagggacatgatagactgggtgtgttagaggacaggggatggaggaggtagcttaggagcccttggaggtcatagggaaagttctggtctcatagcgcaggagaggcaaaaatgtaatagtggtgagtttgatatagattgtgatgacatgccccgtgctgcccccaaaggtctttctatgcagtggggacagtgagagctgaggcagagtggcacttcaggcatatcaggcttggccaggccaggcattgctgtgagaagtacagtgtggtcatgactgggcaggtgacaggtgctcttgtcagtgagacaacatgttggaattttccaggattgggtcagttctcaattatgagaagccctgggagtcagggatgacctacatctccaccacacccagtgttctccaagctgtctttgtttttgtgttttgttttgggggaggttttttgagatgggggtctcactctgtcaaccaggctagagtgccgtggtgcaatcttggctcactgcagcctctgcctccaggtgcaagtgatcctcctgccacagcctcccaagtagccaagactacaggtgcacgccaccacactcgactaatttttggtatttttggtggagatgggctttcgccatgttacccaggctagtctcgaattcctgagctcagatgatctgcacaccttggcctcccagtgctggattacaggctccaagctgtctttgaatcactctaatcactctttcattccctttggtgttgggatgggaacagaggagtatgagctcttccaaccctcagtgcacagtgtggcttccagcaaattccagcataccctgctaatcacccaacttaggtgcctggttaccccagcactgtgaaacatgccaacacatgacagatttatgtcaaagatgaggactttacaaattatattaggttgggaagattataattcagtcccagcttggcaggaaaatggcttagttaagtcacctctagcaaagagagctgcccttctcctactgtgaaacctggcaaggattgtttctcacaaaggctcaggccacaggctatgaccacaaaagaacagaggagaagtagtgggagcagggcggtttccccaggccgacctggtaggcgctttgtagaactacagggagacttgtaagccactcgtctctttccctgtttagtaagcatgatttcttcttttttttttcctaaggtttaatttttatgaagagagattccaatcacatggttcaaaatttcaaaacatacaaaagggtgtagtcttctcccacttccctccctatcatccctctgcccctaaggcagccaggcactttccctccttcagtgttttggggagataatgccgtggataaaaatgggtttttttttttaagtgaagtattgtatacattctggtctgcatgtgcttaatagaatggagtttgttccacactagtatgtaatgagctgggctttctttttggctgtgttgtattccattgaacaaatgacttctatttatgcagcctgtcccctaatgatgagcattgaggttgtttacaccttttggtgagtctatttgcatcctacttggacatggtttttgtacaccttttcatcactccagtggaggagactcacctgcccaggacactctgcttcccctcttgtagctgaacttaactccactgaggttttctggggcccgagatctcggttcaggggagtccagcaacaaacattagaccagggttggaacggctggcacagtaacatcaatggaaagggacagagtttgagagttcaaacgtgatgcactcagcagccaccgccagcacatcctccacaccgtctcgtgcaggggcccacccatctctgtgtctttccagcacacaacagtcacccacactgggcattccattcagaggtgggagagaggaggacacccctcctggcccaggagcagaggccatcaaggtgtccccggaacttagagtagatacattgccaaaaggtgatatcctcattctcagggattctggtcttggagcagcccactccaaatgaggggccgtacagaccaaagtcacccctctgaggcagcgtgtggtgatactgatgcagccagagttcttagcaaaagttgatggatggggacaagcagctgctagattaagtaattcctcaaatttgtaaatgtcagcagtggaagaggagcagtctcttacccatctcttgctcaactttctacccccacgcttctcagcacaatgtccttaagcgttattggcgctcccaaaatagttgccaaatgaataagtgacctggggaaggaaaggaaggagggagggaacagaagattgcctgaaaaaggaggagagagttgggtggaaagaatgcattgagctgtgtgccttggttgcaatgcctgtcctgtgaccagaaaatgcatcccaacacatgtcaggctgtgtctagcaggtgggagggagtctggtggagaaatggcattggaccacatactcaccgctaggtctgttcgggatttatttttaattaatttttggtaaactatcaatgattgaatttgaccattgatggccaggtgtggtggctcacacctgtaatcctagcacttggggaggctgaggcaggtggatcccttgaacccaggagttcaagatcagcctggggaatgtggtaaaaccctggctctacaaaaaatacaaaaattacctgggcatggcggtgcatgcctgtagttccagctactcagaaggctgaggtaggaggatctcttgaaccagggaggtcaaggctgcagtgagctgaggtcatgccactgtattccagcctgggtgacaaagtgagaccctgtctcaaaaaaaaaaaagaattagaccattgatcccaggccaatttgctggcttgttggctgtaacaggatgccttctgaggatgggctggttgttcgagcttctggcttctccttcctgggcacatccactcacagctgccacattgtcccaaggaaccttgctttgctgaccaggaaacatgctgtgacaagctgagcggccatctgctatacagctttctgcctctgaggtgttcttagagtgggaagtgttgtagggaggtgtttgggggttcccaagactaccctcaacttcactgattcactggaaggatgcacagaactgttacacgtatggtgatggtttcttacaatgaaaagatgctgattaaaaccatcaaatgaaaaaagtgcatagggcagcgtccaggggaaaccaggcacaagcttccagttgtcctctccccatggagtcatgtggacaacacttctccaagcagtgcgtgacaacacacacagagtattgtcaaccaaggaccctcacttaagcctgggtgtccagagttttttggggagtctgtcacataggcatggctgagtatagtctccaaccccaccagaggtcaagctgataacgtgtagcccaaggccaccatcatatatcacattgttagcatagtctgtctgacctggtctaagcttaggctcacttgagcaaggacactcttatcaggcaggatattccaaaaacaaggaaccaggctagggccacacctctctttggaatgtggagtgtatggacaacccagagctgctgagctagccttttgctcagccccaggttggcctgcacacagacggcgaggggcaccagcactaccgcctttgcccttggtggtttttcctgcaccctaagacccgatttgtctctgaatccaccccatactccagctgccacagtcagagccccgggtttgagcatctgccatgggtgctcacgtatccctgccaaggcttgtgcctgtgcacactcccttgggaagggagagatggaacaaagataaatttcagatttctagattcagctcactgactccagattggcctccgtctacttatgatgaacctcatttatcagaacctgagtttacgagctcagtatgagaaacacagtattgatgcccttccgtcaggaacctggggaggtctcggtcacggaagcccacctgatgttataagatgtgttggctgcgagttgcagttgagatctgttggtcactgctgccctttgaaggccttagtgacatcctgtgggtgttccctgccgagtcctgtgggtagccccgctcactccccacacggttcctctgcccctgcacaagctgcaccctctgcctggtgcccttgccccaccccaactcttcgttgtgatttgtttttaggaaaactaagtccaaatggacaggacccccaactttctgactgcctaacttctcagtctctcctccagcctcaacagggagcctctctgacccccaccttaagctaaacaaagagtctgcagggagaggtgactctgtgtgtgtatgtgtttgtgtgcacgcgtgcagtagctttagtttctgcctcccccacaggactgtaagctcagtgaagcaaggactcatctgcctttcttggattccgagcattgcaatgttgtcaacaaatgaaaagctgagattgaacctcactcatcttgctctctgttagactgtaaacaccatcaggacagagacttgggattgtttcgtggacaaagagagaactcttgttggggttcaagggagtaagaagggcatcacctgtaatgcttagtaatcactgaaacaaggaagcactttgcatgtgcgtcctttacactgagggcacctgcggagctcactcccctagcagccacccaagtccgttcagggacctcattctcccacgggaagttggagaagatgggccgtggctctgcggaggggggtgtggacctgcctcggtacctggagcggttgaggcctgtcttggtggtggctggggcacaggtgtctgcctggcctgtccttacagactgtcagtgttctctttcctggtattttggtgtttgctctgtcaaacccttcttcctcattggttggaactaggtcacaagcacattaagtccggtcatttcctctgccttctgggggtggattttagcagaagaaacaactcctcccttgctggcctcatgacctctggtgaacactagctttcagcaaacagaaacttccagaggccagagcagcactcagtcgcctggccttccagcctcacaggcaagataagccaccctcacagacttctctgtgctcccatctaaacatctaaatcagccatctggtttccttaacagtagcacagactctgggagtttgagagaatgtgtctcttgtgaataagagaaaataagtccatactggggaaggtagctctccaaattgagatgaggaggtcagggtgggagggtgagtggtcgtgggttggccctgatgggaggagctcaccatcagggaagctgaggacctccctcctaatgtgacagcagagtcttggccacctcttcattccccagtccccaacctggctgctctgagtgtctttccagctactggaaagcttcttctgcagcctgcaaagctagctggaactggactgtcagaaaaacatgtagatgctggagaaaatctgttaatcctaacgtatagctctgccttattccagagaagaccgcagtgtggacatgaagatgataaacttgaggtgatggaaggagcagaaatgccagatacattagcagctcttttttcttttgaaaactagcccttgcaagatttgcttgacatactgagtgacactatccagaaaacatcttttttttacttaaaaaaggctgatggtttgttcagacatctcttgtgaactagtgaaaaacataaacgttgaaagctgtaaaattcagcagttctaagtttatttccagcaagagttaaacaaagtttaatagtaaattcaaccaaccagtgttttagctttttgcctatacattatgtttttaaatttcacccattaaacaaggactcaggttacacattgattccttaaggactttaaggaagccacaaccatttatttatagttgcattttgctcttcaggtttccaggatgtttaaaattttttttgactttgtttttaggcatcaagagagaatatatctaaaaaacatttgcatagttagtgtaattgctaagccacagggtgatgggtggatagattcagaggaaggcagctgagggcagaggctgcctgacagagcaggaaaaatgaagctcgagagccttctggctggaaaggcagctcacagatgggccgcagctgtagatcagttctgaactagggactgaagcaagtttgtcgtaaataaaggaaagtggtagtgttgatgttgtgaatgtatatccacaaccagaaccatcagctctggagggaccatcaggctgccactgtggccacagagcatcactcacgtctccattgggcagatttgcagagactcagcagtgaacagagcaagtccctgcctcgtggagctcatatgctgtgagcggtggctcatgcctgtaatcccagcactttgggaggccgaggcgggtggttcgagaccagccgggccaacatggtgaaaccccgtctctaccaaaaatacaaaaaactagccaggcatggtggcaggcgcctggaatcccagctactcaggagactgaggcaggagaatcgcttgaacacaggaggcagaagttgcagtgagctaatatcacgccactgcactccagcctgggtgacagagcaagactccatctcaaaacagaaaaggaggtggagaagaggggtagtggttggaagaaggaattctcctttagggaagatgtctgggaaggcctctctgagagagtggcctttgaaaggagaccctaattggatgagggatgagaggctgagccatgtaagtatctggatggaaaacattacaggcggagacagtggtgtgtgcaaaggccctgggacagggtcacccgtgttaacaggttttaaagctggaattgtggatgggctagagtcagacactaatagggcccagaggggacactggtccttgaaatagaatttgaggatttgaccatggccaggaggctcaggtggcccagtgggaactccttaaatgggaacttcctaaaggaagaatataagaaccaaagtccagggggcagtgccaggcccaacctgtgagggttcccagagttggagggctagagagaatctgcttccagttcaggccatagactctgaacctcacaggcacattgccatccatctcccctcacccccaaccgagacggagtcttgctctgtcgcccaggctggagtacattggcaccatcttggctcactgcaacctctgccttcagggttgaagcaattctcctgcctcagccccccgagtagctgggattacaggtgcccgccacaacacctggctactttttgtatttttagtagagagggggtttcaccatgttggccaggctggtcttgaactcctgacctcatgatctgcccgcctcagcctcccaaaatgctgggattacgggtgtgaatcactgcgccaccctctgccatccatcttaacatggcgccatgagccagcctctcaggaaaagggtctcatgaacaaatgaggaaagcaagtagaggtagggcagggagggagaggcaaaggaatgtgttgttggaaagggtagtgtgcccctcacagatgacagtacccgtctccagatgtgcccactgagagtttatgaaggggctgctccatgtggtccttgactgccctgggggagagtcacagaaagctataatgccactgcctctcggtttccccaggagctcgcccgtcagcgaggagtcctggagcgcacagagaagatggtggacaagatggaccaagatttgaagatcagccagaaacacatcaatagcattaagagcgtgtttggggggctggtcaattacttcaaatccaaaccagtagagaccccacctgaacagaatggcaccctcacctcccagcccaacaacaggtgagtgcatcttctaccatctgggtataaaggagcagaagtggggattagtgcaaatgaccaagactttcagtccacgtcagtgccatgaagggatccaacaaccctttaagttactcatcaggggatatttgtcctcaaacattgtgaaaccaggaactgttcttccctgatcccatgttcacttgattgacatctagtctgtcaatagcttctccaataattgtgaccccactactttgaaagagagggtgttcacctcagcgtaatctgtacaaatgtgactcacttcacataatttttgctttaaaaaatctttagggctgggtgcagtggctcacacctgtaatcccgacacttcaggatgccaaggtgggtagattgcttaagcccaggagctcgagaccagcctgggcaacatagtgggaacccagtctttacaaaaattacccaggcattgtggtgcacacctgtagtcccagctcctcaggaggctgaggtaagaggatctcatgaggcctggagatcaaggctgcagtgagctgtaatggtgcactccaacctgggctacagagggaggccctgtctcaagaaaaaaaaaaaaaaaagtctttatgtctaaatttgtcatatctaatccaattcgcccattgatttttatttgaaaattataaggctgggctcagtggcttatctgtaaaatcccatgctttcagaggctaaggtaggaggattgtttgagaccagcctagacaacatagcaaagacccgtctctataaaaactaaaaaaaaaaaaaaattagccagacatgatggcacgtgcctatattcctagctacaggggagactgaggtggaaggattgctttagcccaggtgttagagactagagttaagctatgatggtgccactgcactacagcatcagtgacagagtctccctgtctctaaaaaaaaaaaaaaaaaaaaaaagatttaaagctaaataattaaaatcaaaaaaataaagttagaagttgctttcctcaggttttggctcgaaatataaaatcatacatgagactgggggccaggcacggtggctcacgcctataatcctagcacttggggaggccgaggcgggtggatcaccaagtcaggaaatcaagaccatcctggctaacatggtgaaaccctgtctctattaaaaatacaaaaaattagctgggcgtgatggcgggcgcccgtagtcccagctactcgggaggctgaggcaggagaatggtgtgaacccgggaggtggagcttgcagtgagctgagatcatgccactgcactgcagcctgggcgacagagcaagactccgtctcaaaaaaaaaaaaattcatgagattttggtagacttcagtgttacatgttcaaggataaaggaatggagtttctgctgaagtagattactattgtttgtatttcagatcactgtgtctgtttttattacaaaaacaacatggccacattacagacaatctatactttacctaccgcaacacaaaaacagaaaatttcattttccccttattcagtattttcatagttgtaaccatagtattcttttggtttgatagcctttttcttccatttaacccagaaaaactgcttgatattatgtgataactcaggttccataaccatctctctctctctcttttatttatttattttttattttatttatttattttttttgagatggagtttcacccttgttgcccaggctggagtgcaaagacgtgatctcagctcactgcaacctctgccttccaggttaaagcgattctcctgcctcagcctcccaagtagctgggatcacaggtgcccacaccatgcctggctaattctttttttttgagacggagtctcactctgtcacccaggctggagtgcagtggtgcgatctcggctcactgcaagctccgcctcccgggttcatgccgttctcctgcctcagcctcccgagtagctgggactacaggcgcctgccaccatgcctggctaattttttgtatttttagtagagacggggtttcaccgtgttagccaggatggtctcgacctcctgacttcgtgatccatccgcctccgccttccaaagtgctgggattacaggcgtgagccaccacatccggcctaatttttgtatttttagtagagatggggtttcaccatgttggccagtctggtctcaaactcctgacctcaggtgatccacctgcctcagcctcctagagtgccgagccaccacgccaggctttttttttttttttttttttttttttgagacagagtctcactctgttgcccaggctggagtgcagtggcaccatctcagctcactgaaacctctgtctcccaggttcaagcaattctcttgcctcagcctcctgagtagctgggattacaggcatgtgtcaccatgcctggttaatttttgtatttttaggagagatggggtttctccatgttggccaggatagtctcgaactcttgatctcagatgatccgcccgcctcagccttccaaagtgctaggattatgggcgtgagccaccacacctggcctctctctttgttttaattctgtaatgtggagcttttctttttcattttatttatttattttttaagagatgaggtcttgctgtgttggccaggttggtcttgaactcctggcctcaagcagtcctcccacctcggcctcccaaagtgctaggattacaggcatgagccaccacacctaactgcagagccgttttttttaatgcatcactaaggtacagtaaaatatgtgcatcttaagtggagagccagtgactgtgaacctgtgtacactagtgtggccaccacccagatcaagatgtagggtgtggcagggaggaaattagataactacttcaaactcagagtggggctggggagaaaccagtgtaggtaacaaagctggtggtgatggcagaaagaacaggcaggcgaagccatcaagagttatggagaggttcaggcatggtggctcatgcctgtaatcccagcaatttgggagactgaggcaggaggatcacttgatcccagcctgagcaacatgacaaaaccccgtctctacagaaaaacacaaaaatgaagttgggcatggtggttcaggcctgtaatcccagcactttgggaggccgaggcgggtgcatcgtttgaggtcaggagtgtgagaccaggccagccaacatggtgaaacccagtgtctcctaaaaatacaaaaatcagccaggcatggtggtgcctgcctgtagccccagctacttgggaggctgaggaggagaatcccttaagcctgggaggcagaggttgtagtgagcggagattgcaccactgcacctcagcctgggtaacagtgagactctgtctcaaaaaaaaaaaaaaaaaaaaaaaaaaaaaggccgggcatggtgagtcacgcctgtaatcccagcactttgggaggccaaggccaacggagcacgaggtcaggagattgagaccatcctggctaacacggtgaaaccccgtctctactaaaaatacaaaatattatccgggtgtggtggcgggcgcctgtggtcccagctactcgggagggtgagaaatgtgtatggcgtgaacccaggaggcggagcttacagtgagctgagatcacgccactgcaacagtgagctgagatcacgccactgcactccagcctgggcgacagagcaagactctgacacacacagacacacacagacacacacacacacacacacacgaaaattagccacacacacacacacacacacacacacacacacacacacacacacacgaaaattagccggacatggtggtacgtgcttgtggtcccagctactgaggtggctgaggtggacccgaccttttggcttaggtgggaggatcacctgaacccagggaggttgagcctacaatgagctatgattgtaccagtctactccagcctgggtgacagagtgagaccctatctcaaaaaaaaaaaaaaaaaaagtactgcaggagggacctgcagagttggccctgggaacctgccggcctcagtgagtgccctggggaggcactagctaaggttatgagggttggttggtttttttggctcagccataatcaccattctgggttctccagctcaaccctaattttaaacatccgccatttccctccagttctagtcgttgcttgttttttgttgtttttttttcaatatacatatcagaaagatgttttatatcctaatctttggccacatttaattgccataggagaaggtaggatgttcatttgttttggtctaagacatcctccatgtacaaactcaggagcagagtgagcccttggaggagtgggaagctggcaagtttgtgactagcaccctttcacacccttccacatcctacatacctcttcacaaaggctgcttctggggctcttggaggcccctgcatccctgaacatagctatgaaagccatggaagtcctgtggctccaggggcagttttctttttttggagcatcatgaaaactcaggggcttcccagcaaaggcttccatcagtgaggcagccatagttatttcagtgaggtgggctttgtctcttgggaagtcctgtttgtccttgctgacagctttccaagctgcttgttctcatttccacttaaagctgatgcgttcccgtcaaggtccccaaagtcatgtaccctgcctggcctgcccctagattagccccaatcagttgtagcattcttgccatctcttagtaaattcaagaaagcaaaactttcacccacactctgcagttctgtgggagcagaagctgcaggaatgcagtctgtctgttggaagatatgggggaggcagacagtccacagggatgcagtggggacccagaggagagggaggttggccctgggaacagaggaaggctgcacaaaggacctgactttttgcagaaggtgaaggttttgagggaacccaccaattgaaggaggggttggtgcaggcacatggcagtaaaagcacaggggaagccgggatgaaggaagttgttggccatttcaagggcccagcagggccagacacagtggctcatgcctgttatcccaacattttataaggccaaggcaggacaatcacttggggccaggagttgaagatcagcctgggcaacatagcaagattctgtctctacaaacataaaaaatttttaaagctgggcatggtgatacaggcctgtagtcatatttacatggacgaccaaaaaaaaaaatgggggggcggctgggtgcagtggctcacgcctgtaatcccagcacttttgggaggctaaggtgggcggatcacgaggtcaggagatcgagaccatcctagctaacacggtgaaaccccgtctctactaaaaatacaaaaaattagccaggggtgatggtgggcacctgtagtcccagctgcttgggaggctgaggcaggagaatggcatgaacccgggaggtggaggttgcagtgagccaagatcaagccactgcagtccagcctgggcgacagagactccatctcaaaaaaaaaaaatgcaataaattgtgagtaaaatttttgtgatcctgtcaaaacctttaatccataaatgcaggaatactgtcacttaaaaactttgccttttttttttttttttttttaagacaatgtctcgctctgtcgcccaggctggagtgcagtggtgcagtctctgctcactgtatcctccacctcccaggatccagcaaccctcccacctctgcctcccaagtagctgggactacatgcatgggccaccatgcactgctaattttcgtattttttgtagaaacaaggtctcactttgtctcccaggctgatctcaaccacctgggctcaactgatcttcccgcctcagcctcccaaagtgctaggattgcaggcatgagccactgtgcctggcccacttaaaagctttttttttttttttttgagatggaatctcgctctgtcacccaggctggagtgcagtggcgtgatctcggctcactgcaagctccgtctcccacgttcacgccattctcctgcctcagcttcccaagcagctgggactacaggcacccgccaccacgcccggctaaattttttttgtatttttagtagagatggggtttcaccatgttagccaggatggtctcgatctcctgacctagtgatctgcccgcctcggcctcaaaagcttttaaaataagtttctcctatcaaacttctgttcagtcatgcatttcctgtgtacatcattatcacacaaacccttcggccttctctgaagttttgtctcttgggaagccctgtttgtccttgctgacagctttccaagctgcttgttctcatttccacttacagctcatgcgttcctgtcacatatgcacccttaatttgaaattctctaacttatttaagacttggtttctgaccaggaaccaccctctcttaaacctctactgtcttatcacttttctcagtctccctagaaattggctttcttggctgagcgtggtggctcacgcctataatcccagcactttggaggttgaggtgggcggatcacaaagtcaggtgttcaagaccagcctagccaacatgatgaaaccctgtctctactaaaaatacaaaaatcaggcctggcacggtggctcacgcctgtaatcccagcactttgggaggccaaggagggtggatcacctgaggtcaggagttcgagaccagcctcaccaacatggagaaaccctgtctctactaaaaatacaaaatgagccaagcaaggtggcacacacctgtaatctcagctacttgggaggctgaggcaggagaatcgcttgaaccagggaggcagaggttgcagtaagccaagatcgcaccattgtaccccagcctgggcaacaagagcagaactccctctaaaaaaaaaaattagccgggcgtagtggcgctcacctataatcccagctactcaggaggctgaagcaggagaatctcttgaaccagggaggtggaggttgcagtgagccgaggtcatgcccctgcactccagcctgggagacagagctagactccgtctcaaaaaaagaaaaagaaaaaaattggctttctttgtgggggagccatttttcacaaagaaaccattgttttcctcatttatgtattaccagtatatatgtgatggcacatagaaagaataaagccagcgttgagatgtgcaggctgaaaggtggccaggcagactcagaagccaagtgtctcttcctactcccagcatggcaatgcactgcccacagtggtgcttagaggagccagttctgtgttctagactttcagtcacagcttccgtggggtgaaatcctggagtgttaaatccttccattcaccaggctctgctgcattctacccatagctggagccctgggcctgcaaaacccttagcttgcgggagtctggacttgctcttgcaagttgggagtcattaaagactttaactgaagaggtgcttgccagtattgctttagaaagatgcgcagcacccatggggagtaaggattggaagggagggaattgaattgagaggcattgccataatccttgttaaaggtaaagaaaagcaaggcaggccgggcacggtggctcaagcctgtaatcccagcactttgggaggccgaggcgggcagatcatgaggtcaggagatcgagaccatcctggctaacacagtgaaaccctgtctctaaaatacaaaatacaaaataaaatacaaaaaccctgtactaaaaatacaaaaaattagccgggcgtggtggcgggcgcctgtagtcccagctacttgggaggctgaggcaggagaatggcgtgaacccaggaggcggagcttgcagtgcgtggagatcacgccactgcactccagcctgggtgacagagcgagactatgtctcaaaaaaaaaaggcaaggcagaaggagaggctgggtttctgggctacttagggggtgggagatcaagagggcgtttgttttgcctggattactgggagtagcgctgtgcagggggagggcaaaaattgcgagtaaccctgattcccagattggctggcgaagtggtcaggctgctgttgagatagaggagagcaggctgttggggaggcacagctcccagctggaggcacctgccataccttagggggctcagcaggatgtcggggatcagcagggcatcaggcatagtctaaatgactttgagttgcaagagctatccctgtctacagccagagtcagcaaactaggccacggagcaaaatcaaagatattttatagggacttacgtgatgagaaaaaaacatactttcacaactttttagtgacaaaatttaaaatataaaaacagtggccgggtgcagtggctcacgcctgtaatcccagcactttgggaggccaaggtgggcggatcacgaggtcaggagatcgagaccattccggctaacacggtgaaaccccgtctccactaaaaatacaaaaaattagccgggcgtggtagtgggcgcctgtagtcccagctactcaggaggctgagacaggagaatggtgtaaacctggtcagcagaggttgcagtgagccgagatcgtgccactgcactccagcctgggcaacagagtgagactccatctcaaaaaaaaaaaaaaaaagtaataggctggacacagtggctcatgcctgcatggctgtaatcctggcacttttggaggctgaggcagggggatcacttgagtaggcacctgtaatcccagctactcaggaggctgaggcagaagaatagcttgaacccgggagatggaggttgcagtaaatcgagatcacgccactgcactccagcctgggcaacagagcaagactctgtctcaaaaagaaaaaacaatttaagaattggccaagcatggtggcttatgcctgtaatcccagaactttgggaggctaaggcgggcggatcacctgaggtcaggagttcgtgaccagcctgcccaacatggtgaaactctgtctctactaaaaatacaaaaaatagccaggtgtggtgggggcctgtaatcccagctactcaggagcctgaggcaggagaatcacttgaacccgggaggcagaggctgcagtgagccaagattgcgccactgcactccagcctaggtgacagagcgagactctgtctgaaaaaatttaaaaaaaaaaaaaaaaaaaaaaaagccaggcagggtggtgagtgcctgtggtctcagttacccaggaggctgaggtgggaggatcacgagcctaggagttagagacttcagtgtttgcaccactatactccaaacttggtgacagagagagaccctatctcaaacaacaacaacaaaaacagtaatagttgagtacagtattctggtaatataagtgcactaatgagaggaatgaaactcttgaggttctaagtttgtcatctgaggtgcacatggtcatctctaaggccattctttgctcatggtcatataaaaacaggtgaaattttgttttgtgtattttaccataataaaaataacttggggccaggcgcagtggctcatgtctgtaatcccaacactttgggaggccgaggtgggtggatcacttgagatcaggagttagagaccagcctggccaacatggtgaaaccccatctctactgaaaatacagaaattagctggggatggtggcacctgcctataactgtaatatcccagctactcgggagactaaggcgggagaatcacttgaacccgagaggcagaggttgcagtgagccaagatcacgccactgcactccagcctgggtgacaaagcaagactccatctcaaaaaaaaaaaaaaagaacggggaaacagtacaaaaacaggaggtgagccagatgtgatcagcaggtcattgtttgctgactgtagtctaaagtaccggtttggttgttccatgtgcttttcatctgcctggtcctaggaatccaggtttccctgagagagggccacctaactcgatgctacactgctttttttttcttttttttcagtaaagacaaggtctcattatgtttcccagatctcacactcgtgggctcaggcaattctcccacctcagtttcccaaaatgctgggattacaggcatgagtcaccacacctggcttagctgccacacttctgaggcaggggtcttcataagcttactgcttggcccactgtgctcctgggagaagctgttgaaatccctactttggtcagaaggagtttggcacagaggaggcatttgatttttagcacacaggcattatgtgaaaagactgataacattgtcataggggtttttcctttttaaacgttttcttttttgtgaacttttatccaaagattgaaagaagctataagtacaagtaaagaacaggaagcaaagtaccaggccagccacccaaaccttagaaagctggatgatacaggtaagtggatacctgtgtgcacagccacatttgaattctggggggagacctctaggtttggcgttggtccttggggggcagtggcaacctctctggggaggtgggcaggggccccagctgctggcatcacccatgctagccaaagggccttagggaccccgcatgctcttgcggagctgggggtgtgcattatggtggggctcctccttctctccctccctccctccatggagaggagaacaaggaagtgagggcctgcattccattgaaaatgagcctgcccggccagcctggtgcagtaacacacgcctgtaatcccagcactttgggaggccaagctgggtgaatcacctgaggtcaggagtttgtgaccagccttactaataacgtggtgaaaccctgtctctactaaatacaaaaaaattagccaaatgtggtggcacatgcctctaatccaagctacttgggaggcttggacaggagaatcacttgtatctgggaggcggaggttgcagtgagctgagatcacgccactgcactatagcctgggcaacaagagtgaaactctgtctcaaaaaagaaaatgagcgtgcccatcattggttcctgcctgtgtcattctcaattgttccagcagtaaaaagccaactgcagaaaaaccccttggtaaatagaatactggcccctcaaagctgtccacgtcctaatccccagaccccgtgagtgtgttaggttatatggcaaaggtggaattacagttgcagatggagttacaattgctaatcagcaagatggggagattatcctgggttgtccagttgggtccagtgtcatcacaaaggtcccttttaagtggaaagagaagcaggagagagagcagcagagtcagagatctgaagatgctgctggccttgaagatagagaaaggggcccacctgccaaggtacacgggtgaactgtagaaactgcaaaaggcgaggaattagattcttcccaagagctccagaaggagtgcaaccctgaggacaccccgactcagcccagtgagacccatgttggacttctgacctccagaaccgtaagacaagtttgtggtcatttgtcacagcatcagtgagggactaatacagcctccagcccaagcagaaggagcagcagccacatggacaaggtgtgcaagacagtgttgatcgaatcattccacttctatcaagtgataggcccagaaacatcccttatctggaaaggaatttagggctcctggggcctcctccataggcccccacaatagccaggtacattgaaattggtgctagaaaccaaaggcttactgtgctgccttcaagaaaacgatacaccatggaagctctggaacccaccatggttgtggttgatgcagctgaggagagcccagatggaggaagagcggggagcaggagagactaacatcatcagcacagttcattctggaaaggcaagtggaggaagtgagtgtaaattgaaaggcaagggctgggaaaaccggcctcatcacaccctggagaaggggcacaggacactgcacccaagacacaattttaaggaattaaagagagtttttatttgtgcagtatatattaacttaaaagactgaagaaaaaatcgacacagtttgcagaatggtttcagttggttggtgctggaggaaatgtgctaagtctagaaagtgaagtttccctgaaagagataaaccgggatgacagggcttttccgtgtgcgtttagaaactgaagttcattcaagccaagaaagataattttaaaaaagaagaaactaaaagttcaaggaagatttcttgtggcaaatgtgcattatttaacatttcttttttttttttttgcgtatttgtttcaagtgcaaagatagtgtagaaataaatttcagaaagaaacgaaattacccataattccatttatgtaacgtaacaatttgtatttttatactttgtccacagactgtgtagttttgcattattgcagttccacttctgtattgtcacttgtgtgactctgtctttcctgagcttgtgcaccaggagttaggtgacccttaatttgagggtgtttgatctcccaagtactgagggaaagtgagaaccctctcctaccccgtggaagcgtctcttcttctggcccatgagcctgcgctgtgctcctccctcatccctctggatagcctcagaaccaaccccttcgttccttccacccattttccagatgaaattgttttgggtgtgtgaagcagcatttgaaggaatgtcaattaaccgctctcctggtgtttccttctaaacttagaccctgtccccagaggggctggttctgccatgagtactgatgcttacccaaagaacccacaccttcgagcctatcaccagaagatcgacagcaacctaggtaagactgagcaccacaccagcttctgtaagccactgtccttcaggcagcttacgccaagcatagcccctgcatgagcatcctccagcttcagttccctcaccacacatcacatcccacgccaagctgggtccatcttgccacctcactgtctctggaatctctccacttctcaccatttcctacttctagcccagccgagccctccccacctctcactttcatgaacagcaccagggacccaggagtccctgagaggccataaagtatagcctggacgtgaccgctcacttcatccttcccacctggccactcagagccctgttttcctccttgtgaaatgggctacctctgagaacagtggaaaggttacctgagccagaaagtgcctgggatggtaagagttagtgctcgtgttgcaattggcactttggccacacagcctccagcatgatgtttcaaaacggaagggtgtgcagggggccgggcgcagtggctcacgcctgcaatcccagcactttgggaggccaaggcgggtggatcacccgaggtcaggagttcaagaccagcctgaccaacatggtgaaaccctgtctctactaaaaatacaaaaattagccgggcgtggtggcaggcgcctgtaatcccagctatcgggtggctgaggcaggagaatcacttgaacccgggaggcagaggttgcagtgagccaagatcgcaccattgcactccaacctgggcaacaagagcgaaactccacctaaaaaaaaaaaaaaagaagaagtgaagggtatattcttccagaactctctcatggaaccccacacactcacagtgcagtccaggctctctttggctgccctagtcccttctgccctcatcacctgcaggctcgtgtgggatttctgatgtgagttctttctgcctcgtggcccctatctgcctggatgggctcccccgactctctgtaggctggctccttctctttctgtcagtcttgcattagtatggcctcctctccctgtctctcaggacccttgtgtttccagggggctgccctggccgtttgtgattgtgtatctgctggtttgcctgctgtcttcccaatcagactgtagattccaggacagcatgggagtgtttccattttgtcactactttgtatctggggcccagcaggcaagcacttagtgattatgttttgttttgttttgttttgttttgagacagagttttgcttttgttgcccaggctgcagtgcaatggtgcaatctcagctcactgcaaccgctgcctcctgggttcaagcgattctcctgcctcggcctcccgagtagctggaattacagacatgcaccaccatgctcagctaattttgtatttttagtagagatgaggtttctccttgttggtcaggctggtctcgaactcccgacctcaggtgacccgcctgtctcggcctcccaaagtgctgggattataggtgtgagccactgcgccctagccagtgattattttttgaatggaaaagtcagttacttgaaattcaagtaggtgttggcctgtgggcagttctgtgagtttattctaagtagtgtctcagacttgctgcctcctcctaccgctactccctgagcagaaatctcccccgtggtgacctgggtcaccctgtcagtctcccaccccctgttaggagttggcaaagtgtaggggacaaataataaaatcctcccctgctgtaaaggtatctagtggaaggcaaaactgaaacccatgaagatgcacatggagtgtctgtgcacgggttttctcctgcttgctgtctgggaagccccagacagctgccacctccttctatgccctggactctgtcctccagagccaaagacttatctgaggcagaaggtgtgtctgcccagatctaaccactccagagaagcccagagaggcgtgaaagccctttgtccttcactgcgagaaagggagaggttagggctagtggtatggttggtgcctgctggcagaagtgggagaagggactttgaggaaggatactgcattcagaggcaggaagaagtgctgagtactgcccgccactaggaggtgctgagggtgcacagttggcactgtggacgagcagctgggcagttaccggcaggacgcagtctagagtaggaggtgggcctgggcagaagggcgagtggctagttcagagctcagccctctggccctgctgacacaggccaggccggtccactctggtggggcagggagtgttgcctttgttcacactcttcccgtcttaacactatctccctgctatttcaggatctcaggcaagctctctggactccagcgccctggcctggtggttttacattatcacacattttatctcagcctctctgtttgcttatcctttgctgccctggctgccagtgagcttcctcctgaggcctgaggcaaccacaggctctgctctccatggagcacgaggccatgaattttagtaagcttaagaagcaaagagctgaagacttatcttttttttttttttaattttaattatactgtttttctctttcttttcttttcttttttagaaatggagtctcgctttgttgcccaggctagtctccaacttctgggctcaagtgatcctcccacctcagcctcccagagtgctgggattacaagcatgagccactgtgcctgacttgaagacaatctttttatttttatattttttaatttctttctgagagttttactctgtcgcccaggctagagtgcagtggcacaatctcagctcactgcagcctctgcctgctgggttcaagtgattctcatgcctcagcctcccgagtagctgggattacaaggtgtgcaccaccatgcccagctaatttttgtatttttagtagagacggggtttcaccatgttagccaggatggtctcgatctcctgacctcaagtgatccacccacctcggcctcccaaagtgctgggattacaggcatgagccaccacactcagcctatctttttatttcattttttgagacggagtcttgctctgtcgcccaggttggagtgcagtgcattgatctcagcttactgcaacctcctcctctcaggttcaagtgattctcttgcctcagcctcccgagtagcagggaatacaggcatgcaccaccacatctggctaatttttatattttttagtagagatggggtttcaccatgttggccaagctggcctcaaaatcccgacctcatacgatccacccacctcagcctctcaaagtgctgggattacaggcatgagccattgtacccggccaaaactacctttttaaaaaaactgattttggccgggcgcggtggctcacgcctgtaatcctagcactttgggaggccaagacgggcggatcacaaggtaaggagttcgagaccagcctggccaatatggtgaaaccctatctctactaaaaatacaaaaaaaattagtcgggtgtggtggcgtgtgcctgtagtcccagctactcaggaggctgaggcagaagaattgcttgaacccaggagacggaggttgcagtgagccgagatcatggcactgcactccagcctggacaaaagagcaaaatgctgtctcaaaaaaaaaaaaaacaaaaaactgattttgcttagatttgtggtaccagtgctaagcctttgtgtatcctgatcctttttctcttagtgttttatatttaatcttgcaagtaagaaggcttacaaagcaccacctcttctctctcctctctggctctttcctggctgctgttcctagtaaaaaggcagaaagcagccctgggcatatctccctacccccagcgtgcacaaacacacacacacatacacacacacacacacagtcacaaacctgggaaaaggctttactcttcaccctgacagaatcaattaagtcaagactcatctctgcagtgggtgcagtccccccaggcaacacagatccctgtctctcccacttacccacaccatcaagaagcatttgcaggtgccgtgactgtttgctcatgcctgcgtgtcatttcctcctcctgcagatgagctgtccatgggactgggtcgtctgaaggacatagccctggggatgcagacagaaattgaggagcaagatgacattcttgaccggctgacaaccaaagtggacaagttagatgtcaacataaaaagcacagaaagaaaagttcgacaactctgaagacagacggatttccactctattgtgatgaaaagatttgaaagatctttttttgaacttccaagaaatttcatttactattttagtatgtaaattaatgtgtgtttgcaaatgttataatagagtaggtcttaagacatttttgctgttataaggaagtgtttgtcccacattttcctagggttaacacctcaccaagttcttccagcaaaatgcttattagagtttttgtctgagcacagtagcctggccctgcatatcttgggcgtttgattaccatgctggaataagaagagttgcatttctcattttaatgagcatatggaaagatgggaacagaatttcagtcttgcagccatgagcctctatttctcattcctaagccttaccatgagtcagagtgttaagggggcctgtgaaccagtcgtttggtggaggagggtccttcccacacctttgtttaggagtcatcattcacacacacacacacacacacacacacacacacacacacacacactctctgagcacattatctgtgattctttcatcctcccagaaaggatcagtgttagaatgggaaatagagtgtgccatcttgctcttttgttggcagatgtccccgcttccctccagccccccatccttggcatgtatattagtaggagggcttcacaccagcactgctcactgcgactcctggaaatgtgtggggaattgggtgagcccctcttccccacgtgctcccatctgtaactctccatctgtgatttgcaacaggtcttccactggctcgaggctgcgaggctgaccgacaggggcgcccaatagagtttgtgggaatggagtattgcacagatgcagctgcacaatggtcttcctccacccctctgggaatcaccattaggcaggcctcagtagggcaaaatgtttatttggtaccgggggtctcctgacctgtctagcattcccacccactcttctgcacttcttgcaaggtaacttgaatcatcacttatttctctgccacctggttttaggactggcactctataaatgacgctgactttgtatagaaggattttgctaagggggcaaaaagcccagataccattttaactggcccagttcattttctcctttcattttacaaaagaaatcatgcagaagcatcaattaaaactgatttatttatgttggtacatccaacaaaatagttggagccacaaggcccttgtctttttaaaaaaacaaaatattttgaagatggtgaaagtgactgattttaataatgagataggtcacttaaaataacagtgcctttgaccttaaaacatggcactggcccatgtgacctttgccatttcccagtacttccctttacagtctgcagcctataaacagtggtgtctcaaagcaaaggaaacctccacaagtgctgcaacagtgcattagtttttatgtagcaatttgtttataaaaattcccatcccataatgcatgaccttcctaaaaatatccacagcctccataggcaaggtgagctttctgtgctacccacttgttagattccagccacctcagggattctgatccatgtcattaacgaccatcccagggtgtgagggcctgattaaagcttatcgaactagacatttgtttattagatgagctcggcattattattttctcaataactggtagaagggaaattttaaacataacactcaacccaaacaaaactacttcgtgaggctttcagcaaaaaggctgcttaaaagcatgaacccgggatgcagagcagcttttgtgcacggttccacttactgtaattgtttctggttctttcctctaacaccttccatgtatgtcaactttttatcaccgtcaggcatagactcgtggagattagtcattatagctcagacctaagctaattatttaaaataaatacatgtaaaggccactgccacattctcagcagacttccacttgcctaatgagattagtgattcaactgacttgaagcacagtaacatcttattttatgcacattccctgtcttttgctggactgatgaagccagtcacccgcccttctctgttttttggttttttttttcttaaccccaggtatatggaaggggagttgccttcacttttctggaaatttgtcttcgtctgacatattagagggcctcgttttgtcctgttcttgttcagaccctctcgttctacgtcctgtgctgaggggactgtccgtaagctacaggacagcgagctggtcctttctgccacttcttccccactcccatgcccaggaaggcctggttgctgatgctactttataaatgagttgcttgcattttcacagagaatgaaggaagacgtaacatggctccagaaacttttcacatgatgattgggatcgacaaaaaaatgctaccctctagactagacacatttcatggagacaagcaaaatggtgccagggctgggctgactgtgggatgggatttggtactgcagacagattttgatttccacagttgagctggaaacaaactgtgccttcaaaaaatgacttttctaacttaaggttggttatatgttaagtgtgctactaacttaaaaaatagtggctgggcgcggtggctcatgcctgtaatcccagtgctttgggaggccaaggcggggggatcacgaggtcaggagatcgagaccatcctggctaacacggtgaaaccccatctctactaaaaacacacaaaaaattagctgggcgtggtggtgggcgcctgtagtcccagctactcaggaggctgaggcaggagaatggcatgaacctgggaggcagagcttgcagtgagccgagacagcgccattgcactccagcctgggcaacagagcaagactccgtctcaaaaaaaaaaaaaaaaaaaaaatagtgcactctctggctggtcacggtggctcacgcctgtaatctcagcactttggaaggccaaggcaggcggatcacgaggtcagaagatcgagaccatcctggctaacacagtgaaaccccgtctctactaaaaatataaaaaattagtcgggcatggtggcgggcgcctgtagtcccaactactcgggagactgaggcagaagaatggcgtgaactcaggaggcggagcttgcagtgagccaaggcgacagagcaagactctgtctcaaaaaataaaaaatagtgcactgtccttcgagaaagttttctaacatctagtaatttgtaacttagaagtggagttgccttgtggatgtcttttttgcattctgtaggaaatgaaacgtgaatttaactcgggttgcaagaaataaaaatgtcagtgcatttaaatttctctttaacctctttttgtgaatatgtaattttaagtgtacactataccaatttagtaataatcttatactttgcccatatgggccttttctgcagattttttttttttttttttttttttgagatagagtctcactcagtcacccagcctggagtgcagtggcacaatctcggctcactgcaacctccgcctcccaggttcaagcaattctgcctcagcctgtcgagtagctggggttacaggtgtgcaccaccatgcccggctaatttttttatttttttaatacagacagggtttcactgtgctggccaggctggtctccaactcctgaccttgtgatctgcccgcctcagcctcccaaagtgctgggattacacgtgacctgtagaattttaaagttacaaatgttgttcagcatcttcagctctgatgaatgcggtgtcagtacaaaatgatgagctagagccagggcatggtggctcatgccaataatcccagtgctttgggaggctgaggcaggagaatctcctgaggccaggagtttgagaccagtctggacaacatagtgagaccccacctctagaaaaaatttttaaaaatagcttggcctctagtcccagctactttggaggctaaggtgggagaattgcttgagctcaggaatttgaggctgcagtgagttatgatcatgccactgcactctggcctgggcaacagagggagaccctgtctctaaaaaataataaaatgatgagctaagttcgagaccagcctggccaacacagtgaaacgctgtctctattaaaaatacaaaaattagccaggcatggtggcatgtgcctatagtcccagctactcaggagactgaggcacgagaatcacctgaacccggaaggcagaggttgcagtgagccgagaccacaccactgcactccagcctgggtgacagagcgaaattccatattaaaaaaaattgatgagctagtcattaaaagtgctcattatggctgggcatggtgactcgcctgtaatcccagcactttgggaggccgaggcaggcagatcatgaggtcagaagatcaagaccatcctggctaacacggtgaaaccccgtttctactaaaaatacaaaaaattagctgggcgcagtggcgggcagctgtagtcccagctactcgggaggctgaggaaggagaatggcgtgaacccgggaggcggagcttgcagtgagccgagattgtgccattgcactctagcctgggtgacagagtgagactccgtctcaaaaaaaaaaaaaaaaaaggaaaaaaaaaagtgctcattatgtggggatgggatgggctctttagttcgaactgtttcagaacagcacttttcctccatgccttcaactcaacaagtgaccatattccatcaaaatgtgaagttgtttttttaaacaaattttgtctcctgtgtagttatttcttagtgagttggtggaggggatcttcctcgttgagtcttcatgcatttggtctttgatgccacgtttagccctatgaactaccttctgtcctgaaaccctctcatcagttttccggtgtgtctcctagctccctacccgctctgcagcactatctagaccagggctcagcaaatttctgtaaagggccggagagtcagtgtttcaggcttacaggccaaaccatctctatctctattgcagctgctcagctctgccattgttgcataaaagcagccaaagatccgggcgcagtggctcacgcctgtaatcccagcactttggaaggccgaggcgggtggatcacttggggtcaggagtttgagaacagcctggccaacctggtgaaaccctgtctctactaaaaatgcagaaattagccaatcatggtggggtgcacctgtagtaccagctacttgggaggctgaggcaagagaatcacttgaacccaggaggcagaggttgcagtgagccgagattgtatcactgcactccagcctgggcgacagagtgagtttcaaaaaataaagaataaaagcagccaaagacaatacgtaaataagtgagagtgcgcgagagtggctgtgttccaaagctttatttatggagactgaaatttcacataattcacatgtgataaaatgctatgaattttttttgtttttgagacagcatcttattgtagaatcaaaaggtctgagaaagcatctgtaggttaggctaggccattttggaattttttttttaattaattttttttttttttgagatggagtctcactctgtcttccaggctggagtgcactggtgcaatctcagctcactgcaacctctgcctcccacattcaagcgattctcctgcctcagcctcccaagtagctgagattacaggcgcccaccaccacgcccagataattttttgtaactttagtagagacagggtttcaccatgttggccagggtggtctcaaactcctggcctcgtgatctgcccacctcagcctcccaaagtgctgggattacaggtgtgagccacggagtctggcccatcttggaaatttttatctgtcagtgggctagctccccgtgtcccaaaagccactgtggttttagtggaatatcatctttatttatttatttatttatttatttatttatttatttattttttatttttttgagacagagtcttgctctgtcgcccaggctggagtgcaatggcgcgatctcggctcactgcaacctccaccttacgggttcaagtgattctcctgcctcagcctcctgagtagctgggattacaggtgcatgccaccaagcctgactaattttttgtatttttagtagagacggggtttcaccctgttagctaggatgatctcgatcacctgacctggtgatctgcccgcctcggcctcccaaagtgcagggattacagacgtgagccactgtgcccggccaaatatcatctttaaatatcatcattataaataaggaatgatgaggatttgaacccaggcagtggacttttctggggagacaaagaagtggacattacaagctggatgcggtggctcacgcctataatcccagcactttgggaggctgaggtgggtggatcacctgaggtcaggagttcgagaccagcctggccaacattgtgaaacctcgtctctactaaaaatacaaaaattagctgggcgtggtggtaggcatctgtaatcccagctactcaagaggctgaagcaggagaatctcttgaacccaggaggcggaggttgcagtgaaccgagatcgcaccactgcactccagcctgggtgacagagcgagactccatctcaaaaaaaaaaaaaaaaaagaagaggacattacagaggaagaagcataagtgaaaaaaatcaaggcggctcacatttggcatctgcaagtagggaactggcgttatgggttgtgggtgggagatgacatgaaaggtaggcaggatctaatctaagaggccttatgagccatactgaggagtcagaatattgcacttcaatgacagggaggtactgatggagtctaagcaagcgagtgacgtgacaagattcagattttgaaagatcataaagatgcatcaccgcattatttataaaagcaaataatggctggacgcggcggctcttgactgtaatcccagcactttgggaagccaaggcaggcagatctcctcaggtcaggagtttgagaccagcctggccaacatggcaaaaccctgtctccactaagaatacaaaaattggccaggcgtggtggcagacacctgtaatcccagctactcgggaagccaaggcaggagaatcgcttgaacccgggaagcaaaggttgcagtgagccaagatcacaccactgtgctccagcctgggtgacagagcaagactctggctcaaaataaataaatataaatataaataaataaaagcaaataataagcctagaaacaacctgattaggaagatgatggagtcaactatgttcacccatagctgcaacagacaattgcatctatgaaaagtcttcaaagataatgcttgcaagattaacataaaacattatatggtatggtcccaactttgtggaaaagcaaaccaatatatgaatttcaaacaaaaaaaaatcactcttgcatcagtgaggaggacaagctgggaacagagtaaggaaaagactttggtcatggtccaagcaagaattgaagaggggcccaaactagagtggtggcaggacagaaagggagagatggggcagactgcagagcactgggtaggacaggctttagtgaccaactcaccaatgtaggatgacgtagaaggaggaagcgaagatagcactcaggcttctgggcaaaggaattagtagacagtgtttttcacaaaaggaatacaaaaacaggccaggcgtggtggctcacacctgtaatcccagcactttgggaggccaagatcaatgggtgggtgaatcacatgaggccaggagcttgagaccaccctgggcaatatggtgaaaccctgtctctattaaaaatacaaaaaattacccacgttggtggcgagcacctgtagtcccagcttctcgggaggctgaggcatgagaattgcttgaacccaggagatggaggttgcagtgagccaagattgaccacgcaccccagcctgggcaacagaacaagactctgtctcaaaaaaacaaacaaacaaataaacaacaacaaaaaaaacatggctgggcatggcagctcacacctgtaatcccagcactttgggaggcagaggcaggaggattgcttgagtccacgtgtttgagaccagcctgggcaacatagtgagaccctgtctttacaaataataaaaaattagccaggcattgtggtgcatgcctgtgttcccagctactagagaggctgagacaggagaactgcttgagcccaggaagtcaaggctgcagtgagccatgaccatgccacttgggcaagagagtgtgaccctgtctcaaaaaaaaaaaaaaaaaaaaagcacaagcaagtttggggttagggacattgatgaactaggtactggacaggttaagtttgaagacctttgggacatccagatggatcccaggtgctgcaccaaaagttatgcacaaaacagatcagaatccctgccctcatggaatggacagagaagacaatgaataagacaagtagaaaattaataggctgggcgcggtggctcacgcctgtaatcccagcactttgggaggccgaggcgggcagatcacgaggtcaggagatcgagaccatcctggctaacacggagaaaccccgcctctactaaaaatacaaaaaattagccgggcgtggtggtgggcacctgtggtcccagctactcgggaggctgaggtgggagaatcgcatgaacccaggaggcagagcttgcagtgagccgagatcgcgccactgcactctagtctgggcaacagcgagactccatctcaaaaaaaaaaaaaaaagaaagaaaattaataggccaggccaggtgtggtggttcaggcctgtaatcccagcactttgggaggccgaggcaggtggatcacctgaggtcaggcgttcaagaccagcctgaccaacatggtgaaactctctctctactaaatataaaaaaattaactgggcatggtggtgcatgcctgtaatcccagctactcaagaggctgaggcaggagaatcgcttgaacccgggaggcagaggttgtactgagctgggatcatgccgttgcactccgacctgggcaacaagagcgaaactccatctcaaaaaaaaaggaaagaaaacaggccaggcgcagtggttcacgcctgtcatcccagcagttcgggaggccgaggcaggcagattacctgaggtcaggagttcgagactaacctggccaacatggtgaaaccccctctctactaaaaaatacaaaaattacaaaacaatttaaaaaactacaaaaattaggctgggtgtggtggctcacgcctgtaatgccagcactttgggaggccgaggtgggtagatcacctaaggtcacgagtttgagaccaatttggccaacgtggcaaaatttgtctccactaaaagtacaaaaattaaccaggcgtgctggtgggtgcctgtaatcccagctactccaggggctgaggcaggagaatcgcttgaacccgggtggcagagattgcagtgagccaagattgccccacttcactctagcctgggcaaaagagcaaaactccatctcaaaaaaaaaataaataaataaaaatacaaaatacaaaaattagccaggcatggtagtgggtgcctattaattccagctacttgggaggctgaagcaggagaatcgcttgaacccaggaggcagaggttgaagtgagccgggactgtgacattgcactccagcgtgggtgacaagggcaaaactccctctcaaaaaaaaaaaaaaagagaaaagaaaattaatagaatattaaatgtgaccatggtgaagtatttgcatatgacctatgtacattctcctgtatactttttgttgttgtttgttttgttttgtttttgagacagtctcactctgtcacccaggctggaatgcagtggctcgatctcggctcactgccacctcggcctcccaggttcaagcaattcttgtgtcttagcctcctgagtagctgggattacaggcatgccacgcctggttttttttttttttttttttttttttttgcgacagagtcttgctctgtcacccaggctggggtgcaatagcacaatctcagctcactgcaacctccacctcgcaggtttaagcgattcccctgcctcagcatcccaaatagctggggttacaggcacctgccaccacgcccagctaattttttgtatttttagtagagacagggtttcaccatgttggccaggctggtcttgaactcccgacctcaggtgatctgcccgcctcagcctcccaaagtactgggattatagacatgagccactgcacccagccatatacatattttgagacagtgtctcactctgctacccaggctggagttctgtggtgggatcacggctcactgcagcctcaacctctcaggcataagtgatcctcccaccacagcctcctaaatagctgggattatagacatgtgccaccacacccaactgatttttttattttttgtagagatggggttggccaggctgctctgaaattcctgagctcaagtgatcagcctgccttggcttcccaaagtactgagattataggcatgaaccactgcgcccagtctagaaatttattttctcacagttctagaggaaccaaagtgttgggtcccttctgagagtggtgagagaaagatctgttctgggtctctccctggcttgtacagggcagtcttctccctgtatctttatatcatcttaaggacaccagttatactggattagggcccaccccaaagaccttactttcagtaattacctttgttaagaccctatctccaaataaggtcatattctaaggtactggggattagaacatccacatatgaatttggcaggggagtcaggggagcacagttcaacccagaacctatacaaataagtttcagctggaaggagctgacatctgacggcctttcttttctttatttattttttattttttctgagacggagtctcgctctgttgcccaggctggaatgcaggggagcggtctcagctcactgcaagctccacctcccgggttcatgccattctcctgcctcagcctcctgagtagctgggacaaccggtgcccgccaccacgcccggctaattttttgtatttttagtagagatggggtttcaccgtgttagccaggatggtctcaatctcctgatcttgtgatccacccgcctcagcctcccaaagcgctgggattacaggcatgagccactgcacctggcctggcctttattttctttgcgtggctgaaattggatggagcagagatagatgactggagagttagatcaccaaggatagggctgtcatagacccagctaagacagggcacttagaaggaccctggtctttaacacatttcatggatttaaagaaatagagtagcagtttctagccttagagtcactagttagcttcgcagctgcttagcagcaggtagtagaggacctcaccaatacggctgaagttcaagagcaggactcctgaaccaggccctctgtcttgcacctataatcccaggtactcgggaggctaaagcgagaacacttgaggccaggagtctgggaccagcatgggtaacacagcaagcactggccccctacacttcttagaaaattaaatttttttttggagacggagtttcattcttgtgacccagcctggagtgcaatggcgcaatcttggctcactgcaacctccacctcccaagttcaagcaattctcctgcctcagcctcccgagtagctggaattacaggcgcacgccaccacacccggctaatttttgtattattagtagagaaagggtttcaccatgttggccaagctgctcttgaactcctgacctcaggtgatccacccgccttggcctcccaaagtgctgggattataggagtgaactactgtgcccagctaaaaattaaattttaaaaagatcaagcctcctgtccctgggctgaccagacagccaagaaaggcaagttagaaatcagggctctggcttaaggcttagggcaaaggtctggttccctgactacggtcacaaggcagaagtctaggtgccagacccagggctcaaatcagagaaaaagtaaagctgacttgacattgatctttgcatttaagtgctttaaatattccccaaaaaatgtcccaaaatccggataggacttgacttgactgacacttgcttagttgcccatgctggattgcagtgatgtaatcatggctcactgcagcctcgacctcccaggcataagcgatcctcccacctcagcttcctgagtagctggggccacaagcacatgccaccacgtcctgctaattttcttttttttttttttttagaccaggtctcgctgtgttgtgcaagctgatcttgaactcctaggctcaaatcatcctcccacctctgcctttcaaagtgctgggattccaggtgtgagccactccacccagccaggacttgaccatagactaaaagcaaaagagtgaggcaagccatttataaataggaaagaaactgctcacccgacccccaccaatgctgaaggaagcacaacaacaccctaaagaagatacaaaccttggagacaaagagcacctctaggtcatttagaaattaaaccaagctgggcatggtggctcacgcctgtaatcccagcactttgggaggctgaggcaggcggatcacgaggtcaagagatcgagaccatcctggccaatatggtgaaactccatctctactaaaaatacaaaaattaggccgggcgcggtggctcacgcctgtagtcccagctactcgggaggctgaggcaggagaatggcgggaaccaggaggcagagcctgcagtgagccaagatcgcgccactgcactccagtctgggcgacagcgagactccgtgtcaaaaaaaaaaaaaaaaattagttgggtgtggtagcacttgcctgtagtcccagctacacaggagaatcgattgaacccgggaggtggaggttgcagtgaagtgagatcgcgccactgcactccagcctggcaacagagcgagactccatctcaaaaaaaaaaaaaaaaagaaagtaaatcaaggccaggcgcagcgactgggaggccgagatgggcagatcacctgagttcgagaccagcctgaccaacatggagaaaccctatctctactaaaaatacaaaattagccaggcgtggtggtgcatgcctgtaatcccagctactcaggagccccaggtgggagaatcatttgaacccaggaggcagagattgcagtgagccaagatcacatcactgcactccagcctggatgacagagcaagactccatctcaaaaaaaaaaattaaatgaaaacagatgggtgcagtgcctcatgtctataaatcccagcaccttgggaggccaaggcaggaggattacttgagcccaggagtttttatttatttatttatttttgagatggagtttcactcttgttgcccaggctggagtgcaatggcgcaatctcagctcaccacaacctccacctcccaggttcgagctattctcccgcctcagccttctgagtagctgggattacaggcatgcaccaccgcacccgactgattatgtatttttagtagagacagggtttctccatgttggtcaagctggtctcgaactcctgagctcaggtgatctgccctcctgtaatcccaacactcccaaagtgttgggattacagacatgagccaccgtgcccggcaagcccaggagtttgaaactagcctgagcaacacggcgagaccctgtctccacacacacacacacacacacacacacacacaaacacacacataaaaaataagaataaaaataattagctgggcgtgatggtctgcacctgtagtctcagctatctgggaggctaaggcgggaggattgcttgagcccaggagattgaggctgcagtgagctataatcctgccactgcactcctggtcgacagagtgagatctcatctcaaaaaaaaaaaaaaaaaaaaaaaagacctgtgtggtggctcatgcctgtaattcaagcactttaggagggcaaggcagaaggattgcttgagtacaggagttcaagaccagcctgggcaacattgagagaccaagttctgttgtgggttgatttggcttttttttttcttttttaaaatgtggtttgtttcaagtttcccttctccacgataggctaatactgatcatgtcattccaccacttaaaacttctgttggggccgggtgtggtggctcacgcctgtaagcccagcattttgggaggccaaggcgggtggatcacaaagtcaggagattaagaccatcctggctaacacggtgaaaccccgtctctactaaaaatacaaaaaattagccgggtgtcgtggcgggcgcctgtagtcccagctactcgggaggctgaggaaggagaatggcgtgaacccgggaggtggagcttgcagcgagccgagatcacgccactgcactccagcctgggtgacagagcgagactccgtctcaaaaaacaaaaaaacaaaaaaaacatctgttgggggccaggtgccttggctcatgcctataatcccagcactttggaaggccgaggtgggtgaatcacttgaggtcaggagtttgagaccagcctggccaacattgtgagagaccctttctgtacgaaaaatacaaaaattagccagccatggtggcaggagcctgtaatcccagctactcgggaggctaaggcaggagtattgcttgagcctgggaggtggaggttgcagtgagccaagatcatgccactgcactccagcctgggtgacagagtaagaccctgtctcaaaaacaaacaaacaaacaaatcccacttctgttggctcctattaacgtgtcatttaaggaagccaattggccagtttaggcagcacatgacacagtctccactgatggccctgagtgtggccctgggttcacaggacgagaggtggctagcgtcttacaggtactaaccaaaatcacaataaatcttataatcagaagaccattattactcatttacaataagagagataactgaccagaatgtaagttttctgatgcgagcgcagagcattgtgcctggcacagagtaggcacttaagaagtttttgtaggatggatagtaagaaaaggaagggagagaagagggggtggggaaggagcaagtgaaaggggaaaaaagctcattctctttctgtaggaaggctatttgaggagccaagttaaaatcagattgaatagtgcttattcctccactagactaagtaccaccaagcaggaccatatcacattcactttgcatccccaagtctagctcctgggagatgcttaatacaggtgtgctgaacctatttgtcacttaaatgttcattatctcaggatcttacaaagggcttcttttcctgaaatccagcaaggaggagttttagtccgcatgtgtctgattacccaaagaaatgtttccttccgcttgaaggcaaagccacagtctttctttttttcttttttctttttttgagacggagtctcaggatctcagctcactgcaagctccccctcccaggttcctgccattctcctgtctcaacctcccaagtggctatgactacaggcgcctgccaccgcgcccagctaatcttttatatttttagtagacacgcggtttcaccgtgttagccaggatggtcttgatctcctgacctcatgatccgcccacctcggcctcccaaagtgctgggattacaggcgtgagccactgtgcctggcaatttttgtatttttagtagagaaggggtttcaccatattggtcaggctggtctcaaactcctgacctgaggtgatccacctgtctcggcctcccaaagtgctgggattacaggcatgagccaccatgcctagcaggaagccagagtcttgtatgagctcagtcaagcacaagtggtcccattcttgctggtccttgccttaggaatgggcatgtgccctgatgggatgggatgtaaagggagagctctcaggtttctggaggaagtgctctttgcccttaaaaagggacacaagggctggccttggtggctcatacttgtaatcccagcatattgggagggcaaggtgggaggatcatttgaggccaggagtttgagaccagcctgagcagcatagtgagagacctcatctctgcaaaaaagaaaaaaataaaagaggacacaaggccaggcatggtggcacataactgtggtcccagctacttgggaggttgaggcaggaggattactggagcccaggaggttgacgctgcggtgaatgatgatcgtgccactgcactccagtctgggcaacatagtgagaccctgtctctaaaaaaaggacacaaggaaatgactgtccttctcccactgggcattggcataactggatgtgaggcctgggataaccagccagaggatgaagccaaaacctgaaagaaattagaaccaaaaaaaatcacacagaagcagacccacggcctggacatcctgcatcttgagctgcctgctacagagttcatgttatgaaaaataataaatgcccttgcgcctggctcaaactattttgaatagggatttctgatattgcagccaaagcatgctaatacagcttgttagttaagatgattacatcatgaatccatggcgagtaaacttttgtaagaccattgagtcactctggtgttgcaagtatagacggatctgattgcctaattccaggagggttaggccctgacctcagtcatgactactttctgaataggcttggcaccaggaattgagtgggaggaacctaggtgatctaggagtttaaacaaaaataaaatcttcaattttagaagaaaagatgtcccaagaaactgctccatgatgggtaggagataaaaaagtggaaacaggtacctgagcaggaaaaactatgttcatgattttatactagctcttgaggttttagtcttgtgttaggaaaagtggatttaggattaaagtcttctgtccgtacacaatctacagcattaaaagattttaccctatcagattggcacatgcctgtgggaacagctaatcgggaggctggtgtgggagcatcacttgagcctggaagttggaggttgcagtgagccaagatcaagccactgcactccagcctgagtgacagagtgagacccctatctcaattaaaaaaaaaaaaaaatcttaccctatcaaagattcgagttcagtgaagatccattataaaatacttcctccttcaaatagagatgatgataacaggcatcgatgcaatactcttagtaagcattgactcttggttgttttttagtcaaagatttctaattctggctctattactgaaagaccatctggccacccattatggtacacaggttatataacaagaatgctatggttattgactgaaagccattttataatgagacaccctattgctattacataaaaggcagtctcagctatagaacgaattctcccttggtcagtcactgtggtcctactaatcatggagggaaaagatgtttctctcagaaaatctaaactgagtaggaaagccccaggaggtgcaagcctggttgcacattagaattggctagaagttttaataaatactcatgatagcccttgaacatatgaaaagatgcttgacctcactcctaataagagcaatgcaaaataaaactactttgaacattttttttcacctatcagattggcaagagtctaaaagttgaacataaaattttattaatatccagttctcctctacttctgagaatatggactatacaatttcctgcaccccctgaatttaggcttagcatgtgactcattctggcccataaaatgtgagcagaattaacatattttcctctgggctgaaggatttaatagctggtgctattaatcaaactatggggattctccagttctgttccccaattcagctactaagtgagaaggtgaagtgttccatttggtgcagcctcaggatgggggagtttcaccaccctggatctgagccgctgcaccgaggaacattgccctgtgtcagaaatagttaagccactgctgcataatcccagcccattgtgacacacgctgttgatgaagctgtgagtaaacaggtattctcctatattgctgcaatagtaccaaatgctaaaagcatcatggagggcaatttgaccatagctatagatgcacatttatcatttaatctatcatttaattccacttctgggaattcatcctacagaaatgcctgcatacatatgaaatgatgtatgcacaaagttatacattatggcattgtttgtaacgagagtttggaaataaatatctaagtatggagactggttaaatagactatggtctatcttcacaatggaatagtatgcaaatataaaaacaaacaaacaaacaacaaggaaactctcaaaatgctgatgtggaaattattccaggatatattgttagatttttaaaaagcaagacgcagaagagtggatatgtttcctttagtgtaagaaagggggaaaataaaaatattcttacataaacatttgtgtgatacacaagagatgaatagaagtagttaactatagggtcctccaagtcggatgggatgggagcaggacttctcaataaataccatttgtatcactttatatttgaaccattttaatacattatttttttttaatatagtactcaggtctccctgcaagccaaataaataaatcagtcttctgggatcaggactgggctttttgttgttgttgtttttttatgctatgcaggtgatcaaatgttcagtcagcactgagaatcggtgttttaagcttcagtctcagatgaaacacgatatctgagaggcagtttttgtgttgtgggtatgggtagtatttggcctttgctctgtgttctagaacctaactctgatggctcaagtaacccttctggttggaatactataactagatgagggagctccatctggcacagatgttgacagtgctgtgggatatgcccggatcatgtgccaggctatctggaactgaatactctgaactagagaattgggctagacacagagatgaagtaagatgcaaaccaatattgaatttatcaaggctgtgtggttataatcaggggtcttttttaggggaagacatctattagaagttgtggtagtaggttgggcacggtggctcacgcctgtaatcctagcactttgggaggccaaggcgggcagatcacgaggtcaggagtttgagaccagcttgaccaacatggtcaaaccctgtctctactaaaaatacaaatattagccaggcgtggtggcaggcgcctgtaatcccagctactcaggaggctgaggcaggagaatcgcttgagcatgggaggcggaggttgcagtgagccaagattgcgccactgcactccagcctcggcgacagggcaagactccgtctcaaaaaaacaaaaaagaatttgtggtagtgaccttaaaaaagttctgggtcacactgggagcaacacaaaaggcacacattcaatatagaagatttttgacctaaagttggcaaacaatggcccatgggccaaatcttgcccatcaactctacctttatggcttgtgggcaaagagtgtttttttgtttgtttgtttgttttgagatggagttttgctcttgttgcccaggctggagtgcaatggcacgatcttggctcaccgcaacctctgcctcccgggttcaagcaattttcctgcctcagcctcccaagtagctgggattacaggcatgtgccaccacgcctggctacttttgtatttttagtagagacagggtttctccatgttgatcaagctggtctcacctcaggtgatccacccacctcagcctcccaaagtgttgggcgtgagccaccgcacccagtcaagagtggtttttacatctttaaacggttggggggaaaatcaaaagaatatctcatgatacatgaagattatgtgaaattcaaatttcagggcccataaataaagttttcctggaatatagctgtacctaaacctattgggacaaagtcacatacagtgtggctgctttcccactacaatggcagagttgagtagttgtggcagacacgtacctggcactctcatccctttgtgctgctgctcagtgcactacaagttggagtgctgcaattataattcagcagtattttggccaggcgtggtggcacacgcctgtaatcccagcactttgggaggctgaggtgggcagatcacaaggtcaggagttcgagaccagcctgatcaacatggtgaaaccccatctctactaaaaatacaaaaattagccaggtgtggtggtgggtgcctgtagtcccagctactcaggaggccgaggtagaggaatcacttgaacctgggaggcggaggttgccgtgagccgagatcatgccactgcactccagcctggcgacagagcaagactccttctcaaaaaaaaaaaaaaaaaaaattgccaatgcacgttcttgtatcaaaagaagaaaagtataattttctttttttgagacagggtctcgctgtctcaatgcccaagctggagtgccgtggtgtttaatcacagctaactgcagccttgacctcctgggctcaagcaattctcctacctcagcctcctgagtagctggggccactatgcacagctaatttttaaaaattttttgtggaaatggggtcttgctatgttgcccaggctggtctcaaactcctgacctcaagtgatcctcctgccccagcctcccaaagtgctgcgattacaggcatgagccaccacaccaggccagaaaagtagactttggatgtcacactttcaaggcaaagtgtagattattttgttactgtatacaattgcaaggtcgggggcgcagtggctcacacctgtaatcccagctacttgggaggctgaggcagaagaatcacttgaacccgggagacggaggttgcagtaagccgagattgcaccactgcactccagcctgggtgacaagagtaaaactgtctcaaaaaaaaaaaaagcatacaattgcgaagtattgtgtttattatgcagtgacaccgtatctgtgctaaaagaataaaatgtatgttaacttagactaagcagtcatcacagtattaccaatttataggaaagcaacagtcagaaaaattggaaaattttggctaggtgctgtggctcatgcctgtaatcccaacactttgggaggctgaggcaggagaactgcttgagcccaggaatttgagaccatcctgggtaacacagcaagacctcatcactaccaaaaaaaaaaaaaaattggccaggagtggtggcatgtgcctgtgctcccagctgcttgggaagctgaggtgggaagactgcctcagcccaggaagtcgtggctgcagtgagctgtgatcatgccaccgcactccagcctgggtgacaaagcaaaacccgtctcagaaaaaggaaaaaaaaaaaaaaagaaagaaataaagaaaaaaaataggaaaatttcaaatggaacatcttatcagaatttctgcacaaaaatgaaaaatgaggctgggtgtggtagctcatgcttataatcccaacactttgggaggccaaggtgggaggatcacttgagcccaggagtttgagaccagactgggcaacatagcaagaccctgcctgtacaaaaaaaaattttttaattaggcaggtgtggtggcacatgcctatagtaccagctacttgggaggctgaggtgggagaatcacttgagccctggaggtagaggctgcagtgagctgtgatcatgccactgcactccaacttgggtgccagagtgaaaccctgtttcaaaaaaaaaaaagaaaagaaaaaatgaaaatgaaactgcaaaagtaagtttccaaggggcttatgtgttagccaaagaaagctgcttactggcggtgagttcattaaattgtgtttgtcgtagcagaagaaaagtgtccaaagaaaaatgattttgaatgattttccttgattatcaacgacttgatagatgttaccattagtgctcaattgttgtttatttgaggtgccaatgctgaatataaaatcactgacaaatacatttctcttgaatagtgtgcatggaataactataggcaatattctgaaaagttggccgggtatggtggctcatgcttgtaatcctaacactttgggaggccaaggacagcagactgcttgagcccaggaattcgagaccagcctgggcaacacagtgggccctcatctctaatagacttaacctctgccaggcacagtggctcatgcctgtaatccagcacttttggaggctgacgcaggcagatcacctgaggtcgggagttcgagaccagcctggccaacagggtgaaacgctgtctctactacaaatgcaaaaattagccagacgtgttggcacacacctgtcattccagctgctcgggaagctgaggcatgagagtcgcttgagcctgggaggcagaggttgcactgagccaagatcatgccactgcactccagcctgggtgacagagtgagactctgtctcaaaaataaataaataggccgggtgtggtggctcacacctgtaatcccagcactttgggaggccgaggcaggcggatcacctgaggtcaggagttcaagaccagcctgcccaacatggtgaaacccagtgtctacaaaaatacaaaaattagccatgcatgttggcgcgcgcctgtaatcccagctactcaggaggctgaggcaggaaaatcacttgaacccaggaggcagaggttgcagtgagccgagatcatgccattgcactctagcctgggcgacagagcgagactccatctcaaaaaaacaaacaaacaataacaaaataaataaataaaagacttgaactcagaccagacgtgatgaccagctgaatttaagcatattagtcagcagaggaaaagaaactaaccaggattccctcagtaatggcaagtgaacaggtaagagcccagcaccaaatgcctgccttgcagagtttttacatatatatgtgtgtgtgtgtgtgtgcattatatatatacgtattctttttaagttgagaaaacaataattcagtataacccaaagtggaatctgctaaaatgggtaacaagtgatggtggtaatcatgtatgaagcagaaaaaggcttagttgagcaaatttataaagccctggaaaatataaggtgtttagagcctatggttatttatgacattattcatctgaaactaatccatgataaaaatatatatatatttttgagacagagtctctctcagtcacccaggctggcgtgcagtggcgcaatctcagttcactgcaacctctgcctcccaggttcaagtgattctcctgcctcagccccctgagtagctgggactacaggcgcacgccaccatgcctcgctaatttttctatttttagtagagatggggtttcaccacgctggtctcaaactcctgacctcaggtgagctgcctgccttggcctcccaaagtgctgggattacaggtgtgagccaccacacccagccctttttttttttttttttgagacacagtctcactgtgtcacccaggctagaatacagtggcatgatctggggctcactgcagcttcaacctcctaggctcaagcactcctcctgactcagacttccaaagtgttgtgtttacaggcatgagccaccacacgtggcaactgtagctattattttttgatacggagtctcactctgtcaccaaggctggagtgcattggtgcgatctcggctcactgcaacctccacctcctgggctcaagcgattctcctgcctcagccttcccagtagctgggactacaggcatgtgccaccatgcctggtctttagtagagacggggtttcaccatgttggccaggctggtcttgaactcctgacctcagctgatctgcctatctcggcctcccaaagtgttgggattacaggcatgagccaccgcagctggtctggcgattgtaattattttagaagacaagagtttaagtataataccatctagaaaccctgggaatatgcaagctaaggaagaatcaaaatctatatgttacagcttttttttttttttttttgagacggagtctggctctatcgcccaggctggagtgcagtggtgcaatctcggctcactgcaagctccgcctcccgggttcacgccattctcctgcctcagcctcccgagtagcggggactacaggcgcctgccaccatgcccggctaattttttgtatttttagtagagatgggttttcaccatgttagccaggatagtcttgatctccttacatcgtgatccacccacctcggcctccaaaagtgctgggattacaggcatgagccactgcgcccggcctattacagcttttttaatggtttctttctgtttctctactcattgctgttttgctatctcagcatttagtaactttttttggaatgtttttgacagggtcttgctctgttgcctaggctgaggtgcagtggcacaatcaaggcttactgcagcctcgacctcctgggctcagatgatcccccaacctcagcctcctgagtagctgggacttgaacacctgggctcaagtgatctacccaccttggcctcccaaagtgctgggattacaggcatgagccaacatgcccagcctggaaagtttattttatgcttgtctcaactgtgctaaggaaaaataaaggaaagtatcttttacaaaaattttattatgacaaattccaaacatacataaaagtattatagaatataattaaccctaccctcgcatcatgtcacctggtttcaataattatcaatctcacatggccattcttgtttcacttttatctaacccacaccttattcccctctggagtatttagaagcaaaatgagagatatttggttctttttttttttttttttttgagatggtgtctcactctgtctcccaggctggagggtagtggcacaatcttggctcactgcaacctccgcctcccaggttcaagctattctcctgtctcagcctcctaagtagctgggactacaggtgagcgccaccatgctcagctaattttggtatttttagtagagacagggtttcactatgttggccagactggtcttgaactcctcacctcaagtgatctgcccacctcagccttgcaaagtgctgggattacaggtgtgaaccactgtgcccggactttacttttttctaaaaagagagtttatttaaggaaaatagagagcagagagtttatttttacaatgtttttacattgactgggtgccgtggctcactcctgtaatcccagcactttgggaggccaaggtgggcgggttgcgaggtcaggagttcaagaccagcctggccaatatgttgaaacctggtctctactaaaaaatacaaaaattagccaggtgttgtggcatgcgcctgtagtcccagctactcaggaggctgaggcaggaagaatcacttgaaccagggaggcggaggttgcagtgagccgagatcacgccactgcactctagcctgagcaacagagtgagactctgtctcgaaaaaaagaatgtttttactttttttaaaatagagatggggttttgcaatgttgtccaggctggtctctaactcctggcctcaaaggatccacctgcttcaccttcccaaaatgctgggattacaggtgtgagccactgcacctggccaagagcagatagtttatatagacagatagtacaccctgaaaagatgaggcaaagagggctgaggcaaagagggctgctgaaaagggagtgagccagcagctaatgttcaattatcatttttctctggcttcctcccatctttatccatctacattcaaaaaccatacattaagtatgtatcggctgggcgtggtggctcacacctgtaatccgagcactttgggaggccaaggcgggcagattatgaggtcaggagttcgagaccagcctggctaacatggtgaaaccctatctctactaaaaatacaaaaattagtcaggcatggtggcgcgtgcctgtaatcccaactactcaggaggctgaagcaggagaatcacttgaatccagaaggcagaggttgcagtgagccgagattgcaccactacactccagcctgggcagcagaatgagaccccatctcaaaaaaaaaaaaaagtatgtattatgtgctaggtactgggaatagaaaaaataatatatagcaggctgccctcaagatgctcagattgggatgagaaaaatatttatgaacaattacaatagaatgtgataaaaattaatttaggctgtgcccacagtgtatacatagtaatcagagagtatggtcagttttggttctgcttttagaatatgtgtttggagtcaccagagatgtgacccctaaatgcttcatgctgattattagcctactaaaggaaaaactatggagaggtgaaggacgctctgcatttagagggcagagagcgggttgctgtggctcacatctgtaatcctagctactttggaggctgaggcaggaggactacttgagcctaggaatttgagacgagagtcagcaacagagagacatgtctttaaaaacaaaacaaaacccaaaaagcctaattcagtcaaagcatgggtagaagccagattaagaaggttgagcagctgggtgggtggctcacgtctgtaatcccaacactttgggaggccaagctgggaggattacctgagcccagcagttccagatcagcttgggcaatacagtgagacctcatctctacaaaaaatttaaaaattaaaaaatcaccactaggattacaggcggtggctcacgcctgtaatcccagcactttgggaggctgaggcaggaggatcatgaggtcaggagttcaagaccagcctggcgaacatggtgaaaccctgtctctactaaaaatacaaaaattagctgggcatggtggtgcatgcctgtaatcaatcccacctacttggcaggctgaggcaggagaattgcttgaacctggacctgggaggcagaggttgcagtgagctgagatcacgccactgcactcctccagcctgggctacagagctagagtccgtatcagaataaaaaaaaaaaaaaagggctgggcaaggagcaggtgattatgaagtggtaaatctgacagtgaaaagtagttagaaaacaaagtggagatttttctctccaccctcacccacccactgagggtgtatgctcagggttttagggtatagaggtagaggcccagggaatgactgaataataataatggaagactcatatgatgcttactatgtgccaggtactattctaagcactttgcatatattaacttgtttcatacatagctgggcggggtggctcacatcttggctgagggggaggattgtttgagctcaaaagtctgagacgagcctgggcaacatggtgagatttcgtctctattaaaaatcaaaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaatcaaaaaaattagctgggcatggcagcgcgagcctgtagtcccaactactcggaaggctgaggtgggaggatcccttgagatggggaaatcaaggctgcagtgagccatgatagttccactgcactccagcctgggtgacagaaggagaacctgtctcaaaaacaaacaaaataaaacaaacaggctgggcacggtggctcacgcctgtaatcctagcactttgggaagctgaggcaggcagatcacctgaggtcaggagtttgagaccagcctggccaacatggtgaaaccccgtttctactaaaaatacaaaaattagcagggcatggcggcggacagctgtaatcccagctactcgggaggctgaggcaggagaatcgcttgaacccgggaggcggaggttgcagtgagccgagatcgcgcccctgcactccaacctggtgacagagcgagactccgtcgaaagaaggaaaggaaagggaaagggaaaggaaagggaaagggaaaggaaaggaagagagagagagagagaaagaaaagaaaagaaaaaagaaaagaaagaaagaaagaaagaaagaaagaaagaaagaaagaaagaaagaaaacaaacaaaaacaaatagggattaataaataggcagaagcaggcataatccggggcaggggaagcctcggggccacgcccgagaggcatttgtattttactttcagcagttcagagcccatgatagccaggttacccacttgtggacttccttgaccacttaattgagtcaatctaaccctcaccttctctctcctctcactccatttagcgggtcacgtagccactagggcttccttagcctatcaggccacctggggactgagtcattcagtcagtcacctatctggtggtcacatctgcccctgggctcatccttttactgggccacctcggcccatcgggacctgtcagtccttgacctccctcaggcccctaggctggccaggtcgcctcagtgccacgcctccctggcccgcgattcagcctgcacgttacgctttgttcccagaagcaggttttcgaaacgcggttccctctcggctccagctgttttcctgccagcgctgggagacccggcagccgcagcgcccccagcggcgcgcagcggcccaggaagagagtgcctaccgccggcgcctcttcagcctcctcctggaacgcgggagcgggcgcgaccagcgcccaccctgatcgtcgcgacggtgctcctgattggctgcgctgtgtgacgtaacgggagggccccggcggccgccgggagccggggcccagcgcgtgcgcagacggagcgcgctgagcggagggggaggtggctgccgcttctcccgcgtccgccattttgttgctgtggctattgggaacaagctgggcaaaagcaccccggaggcgcgacgctccttcgagttcggtgcctcgtgtgacggcgggggtcggtgaagacccgtcgagctgcggcgccggcgcgttccaggccgggagtcactggaggcacccctgggacgccgagcagcccgagaaccccggggtggcctccgctgcggctcgggtttgcctgccccgaccccccggctctgccgtgcattcccgggcggctctctccgtgtggcggccccggagcaggcgggcggcgtcggaggatgctgcgggcccggagccgagaggaaagtgctggcccagccctctgagcgctcctcgaggtgtgcgagaggcccttcctcggccccaaagccgtctgccgggctaaggcgtgcagagcaggcgaggacagccgccgcccctaccgccgcagagtccccggtccaacaccatgtcctccgccaggttcgactcctcggaccgctccgcctggtatatggggccggtgtctcgccaggaggcgcagacccggctccagggccagcgccacggtatgttcctcgtccgcgattcttccacctgccctggggactatgtgctgtcggtgtccgagaactcgcgggtctcccactacatcatcaactcgctgcccaaccgccgttttaagatcggggaccaggaatttgaccatttgccggccctgctggagttttacaagatccactacctggacaccaccaccctcatcgagcctgcgcccaggtacgcgagagccctccccgaccgcggaggaaggtcgagaaccgggtctgtcgaagagtgcttgtataggggggtggggcgcgcttgaacccatattccccgcattctgaaccaaattattttccagaaggccttcctaacagaaagctagtgtcaggatctgggtcactggataagaggatgcgttttttttttttccctctcacgaggctgtttctcaatgtgaagaggatgcgttttgaatgtttaacggtggttgcatagttaaaatgcacgctttttgcctttcgtgactttctctgggtgtaatactgatgcagggatttgttggtttttctaaaaacctcttttttttttttttttttgagacggagtctcgctgtgtcgccaggctggagtgcagtggtgcgatctcggctcactgcaacctccgcctcccgggttcaagcgattctcctgccttagcctcccgagtagctgggactactggctcacgccaccacacccagctaatttttgtatttttagtagagacggtgtttcaccatgttggcctggatggtctcgatctcttgccctcgtgatccgcctgcctcggtctcccaaaatgctgggattacaggcgtgagccaccacacccggccaaaaaccgtttttaagccatagacttctttgagaatctgaagatagccgagcactcaccaccccacccccacccccacccccacccctccccgccaaaggcacgtacacacaagtttgcacaccatcccgggtgcttgtactccctccagatctctgaactccaggttaagaactccaggactgcagcctttggaacagtcaaaaaaatgaaaatgctttagcgtttagaaacaaaaaaacctttaaccaaaatatcagaactgtatattgatactgtggtgccaagtttgaagcaggccagacaccaccacttttatagtacgttaattacaaagataagagaaggtgcattggcttcagcgaggatattttttggaaaatttattgcatattttctccccgaggaccattagtaggccagagatcagtctggttaatttccaaggtggaattaggctagaatgttattaaggaaaatttttgaatgacacttagttgtatcctagttcaatttcagacatgctttttgtgttaagtctaatgattttgtatttcttattttaaaattaacgcaaagtgaccaagcattctcttttccaagtgaaatacgttattttaattgattagttgctttaatttgccttaagcgttttagcagagatttgcttttattgttgtgtttgccctgtaacactgattttatcagaggtttcttttatttaaattatcccaaatttgagttgaaaagttgcctagaatttttaaagtaacaaactggccagttcgtttcttaaacatctattttaaaaggactgggtgttgatacagtttttccagggttagatgtttatgactttatggatttgtcgaccgggtattactctaaactttaaacattaaaagctattataattgaggacaccaactgtttgcatagtgggatagagatagaaaaaaaaaagccatgacagtataatgactacaagattaactactgaactaaatggactttaaaagtggggagaaagtgattataaatcaaatactgtataacaaagaccaggacaccaagaatctgattggtgaaacctgcggttcctggcagatgctggtagttgcagtcaactttgagcacaatataattccaatttaaggagttgagaatcttagaacccactgtagtgagatttgtaatatgactgaataaattcttcctctcgtttgtgagcgtgaattatataattaataccaggcattcattaagccatgcatatgcttatgttgaggtcatgagtactaataatacagctgtttcaaaaagcaagttaatgggcgggtgtggtagctcacgccagtaatcccagcactttgggaagccaagccgggcgaatcacgaggtcaggagttcaagaccatcttggccaacatggtgaaaccccgtctctgctaaaaatacaaaaaattagctgggcgtagtggtgggtgcctgtaatcccagctactcgggaggctgaggcaggagaatcgctcgaacccgggaggcggaggttgcagtgagccgagatcgcgccactgcacagcccgggtgacagagtgagactctgtctcaaaaaaaaaaaaggaaaaagttaatgacttgagtctccttctagaggaaggaaaagaagtatgccgcttctctctatccacagaatcgcctccagattttccgtacatgcatgcatcttcttagagaacaagcatgtaattctgtctttgccctctttcgtccttcctttactgcagctgtactaggctgctcacttattccctggtagccatccttccttactcatacctttgtacctttgcacctttgctccagctgttggctcttcactgactgccttaactacacctcactctccatctgttgaaatcctacctgttgttccagtcccctcacagattatagggcctttctctgaccctacccctcacgttcagctttgtttctccttctctgtgccctctgcctcaggcctgttgctttaatttagtttttcattttcctaggtatctctgaaggagatcaccatgctggttgaattagatcctgactgagtttactttgttatactgaatcttcgaattgccactcccaagcctggttttcatggcttaggtttaacatgttattagccttttatagaaagctagtgactactagagcctgggccaaacggaaaactcagtgtaatgcttcttcgcatcccaaacagggtacatttagtggcttaactttgcaggcatcaaaactgagcttttaaagccagagtttcatgcctcttggctaatattttggtttatcttgcatagctaaaatttgtaacaataatgtcctactcgaaatttaaggactggtggcttgcattgttatagtcttatccttttcattagaatgcttcataatttttaattttatatttttattcaaatgtttataagagaattataacccagtgtaacccagtgtaggtactgggaaagatgtgtgacagacatactttcttcctgtggaactcctactgtagtggagaagacagactgaaaagtagaaaaataaagtactagtaagatcaatatacaggagggacctacctggggtggcgtggtcagagaaagcatgaagctaagacctgagggtaaagaagaacccagcctaggcaaggcttggcctgagaggaggagaagagccttccaagtttagggaaaagcttatgtagatgtcctgaggtgagaaagtccattgtgttgggagtgtgtttcttttctttctttcttttttctttttttttttcttgagacggagtcttgctctgtcgcccaggctggagtgtgcgatctcggctcactgcaagctccgcctcctgggttcacaccattctcctgcctcagcctcccgagtagctgggactacaggcgcctgcaaccatgccgggcaaattttttgtatttttagtggagacggggtttcaccatgttagccaggatagtctcgatctcctaacctagtgatccgcccgcctcggcctcccaaagtgctggaattacaagtgtgagccactgcgcccggctttttttttttttttttttttttggtagatgacgtctcactctgtggccaggctagagtgcagtggcccaatctcggctcactgcaacctctgcctcccaggttcaagtgattctcctacctcagcctcctgagtagctgggactgcatgggactacaggcacccgccaccatgtccggctaatttttgtatttttagtagagacaaggtttcaccatgttggccaggatggtccctatatcttgacctcatgatccacctgcctcagcctcccaaagtgctgggattacagatgtgagccaccctctccggcctgggagtgtgtttcttaaaggagaaagggggacatataaaatgagtttggagataaagatcagggtcaggaattgggtttttatttaaagtgctgtgggctccaaggaaggaatttgaggcagaggagtgacctggggctgttattgtaatccagctacaaaatgatggtgactaatagtgacagtggagctgtgacttggagatgcctattttggagataaaattgatttgctggtgggtggggatgaagggaaagggaagaagggatgatttggtctatttgtaactttgttatcttctgtgtttttatctttaactgctttttgtatttgtggtattcctatggtggattttattttatttatttttttgagaccaagtctccctctgtcccccaggctgtagtgaagtggcataatctgggctcactgccacctccgcctctggggtttaagattctcctgcctcagcctccctagtagctgggattacaggcatgcactgccacacctggctaatttttgtatttttggtagagacagggtttcaccatgttggccaggctggtcttgaactcttgacctcaagtgatccacctgcctgggcctcccaaagtgctgggattacaggtgtgagccactgcgcctggcctagctctagtgtatttttatttaataagggctgtttccagtttaacaacagaatgcttcagaaggtagcttgctttgtttgacattttccatttctagcttgtgtcgatagataaattcaggctatgaagaaaaattagaataaataaaattttaccattaaaaactaaaggaagttggcccttcaagaaaataatgtactgtactcagcagactttgagcattacatgtacctggtaatatggaaccaacattgaatcagacagccctatcatgcttctgaggagcttactggttactaaaaaaaaaatttttttttttttgagacggagtcttgttctgtcgcccaggctggagtgcagtggcgggatcttggctcactgcaagctccgcctcctgggttcacgccattctcctgcctcagcctcttgagttagctgggactacaggtgcccgccaccatgcccgggtaactttttgtatttttagtagagacggggtttcaccgtgttagccaggatggtctcgatctcctgacctcgtgaaccgcccgcctgggcctcccaaagtgctgggattacagttatgagccaccgcgcctggcatttttttttttttttttgagacagagtcttgctctgttgccaggctggagtgtggtggtgcaatcttggctcactgcaacctccacctcctaggttcaagtgattctcctgcctcagcctcccaagtagctgggactacaggcgcacgcgctaccacacctggctaatttgtgtatttttagtagagatggggtttcaccatgttgagcaggatggttttctgtctcttgacctcaggggatctgctcgcctcggcctcccaaagtgctgggattacaggcgtaagtcaccgcgcctggctactaaaaaaaaaaaaaatgtaaaggttggctgtgctcggtggctcgtgcctgtaatcccagcacttcgggaggttaaggcaggaggatcgctagatcccaggagtttgagaccagccctggcaagatagtgagaccccattcccacaaaaaattaaaaaattagctgagcatggtgtcatgcgcctttaagtcccagctacttgggaggctgaagtggaaagattgcttgagcatgggaggtcgaggctacagtgagctatgatcatgccactgcacttcagcctgggcaacagagccagaccttgtctcaaaaaatgaatgaatgaatgaatgtaagttgtatatatttaatatatttaatctccatgcatggtgaaacagctgtgggagaactgagaaagggtgcttagtctaacctgagagcccagaagaggagcctcacacacctgtgaagtagaagccaatccctgaagggacaggaggaaacaagaagcatggttgtgcctcctctttacatcccctgttctaattatttaagaactcaaatctagacttccataatttggaatggggaaaggattgccagtaattttaatcagcatagaattcaactctgtgaataaacccctttgcgtttctcctgaccagtagttaaaatcatgtgaatttgattcagagaaaaatacaagaacatggccaggtgcagtggctcacgcctgtaatcccagcactttgggaggccaaggtgggtggattgcctgagtgcaggagtttgagaccagcctgggcaacacggtgaaaccctgtctctactaaaatacaaaaaattagctgggcatggcggcgtgtgcctaagaggctaaaggcaggagaatcacttgaacctggggggtggaagttaaagtgagtcgaggtcgtgcagctggactccatcctgggcgacagagtgagactctctccaaaaaaacaaaaaacaagaacactgtcatgctgagaatggaatcttgtccaattaagagttgtgttcccagccggatgtggtggctcacgcctgtaatcccagcactgtgggaggcttaggcgggcggatcatgaggtcaggagatcaagaccatcctggccaacatagtgaaaccccgtctctactaaaaatacaaaaactagctgggcgtggtggcatgcatctgtagtcccagctactccggaggttgagacaggagaatcgcttgaacctgggaggcagaggttgcactgagccaagatcacaccactgcactccagcctgccaacagagcgagactccgtctcaaaaaaaaaaaaaaaaaaagagttgtgttcccatggaaagtactagtagccattcgatttgtgacttttaaaactcaaatccacagaattgtgacctaaatttttccttttgatctgaatgattagactagatttctgagggtctttaagattaaaatattttaattctgggccgggcgtggtggctcacgactgtaatcccagcactttgggaggtctggcaggtcgggagttcgagactgaacctgggaggcagagatgacagtgagccgagattgcgccagcgccactgcactccagtctggtcaacagagcgagacttcgtctcggaaaacaaaaaacaaacaaacaaaaaacattattttaattctttcagataagtaaaagggggcacagcctattagttgggagttcagattaacttgagttgaatctgagctaaaatcataacaagttgggtggggccaccaggcacatagcaactcacctggaatgaacgtgacaagaacagtggaagaggatgagaagaggctttgaaggtgcacactcaacggtattcgaattctgtcacaccagttttgtgacagtattaaaccagagttaggtaatttgaatacctgagcttttgtgctttcagaaacaaaaaaggagggaaataggaaagggaagttctttgatatatagaggcctacaatataccaaagctcactgctagactcttggaatctaatggaagtaaaccatgtttttgtttttgatttttgtctttgagaagctttggtctattgaaaaaattagaatgccatgacagcttaaaagcaaaggcaatcaactgtacctaagaggtggggagaggcttgaaagaggagatgctcttcaactgattctttaaggatgagaacaagtatacgaggtagaagaggtggtggtagaagagatggtggcagtgcttgctggtaaagacacagttataattaatgtagatgatgggcaggaacctaggaaggaaagataaagccaacttgtaaagggcctcctcagccttgtaaatgagcttaacaatgggagccatctaaagtttttaaaaagagaactgtcagattttaaaaggagaactgatgagttttacttttgagaaactgctctgggtggggaaagatctgaaggactaattctctgttactggagagggaccctgagaagctgagccaagatcaaatgccataggaatgtaaagtggcacatagaaggtgaggggagaggtatgatgacttcagagaggattgagtggtgcctttgagacaagagaaagggattagggtgggtgcgtgattcttttcaacaggaagaatctttctttgaggtacctgctggaagccaggtggtatttagcaatctgatgggtttgttattgagaagagaggtaagggctgaatacatatagatttgggaatcgcagcttagatgggatcacccagaatgaggaggcagaacaggaataagtagagaaagagaagctgcggaaggagaggcagccacaagcataggaggaggagccattagtgatggcctgaaagcccagggacagaagggaggggacctgggcattaaatgctggtcagtgataaagaatggtggttactggctggacatggtggctcacgcctgtaatcctagcaccttgggaggcggaggcaggtggattgcctgagctcatgcgttcgagaccagcctggccaacacagtgaaaccctgtctctactaaaatataaaaaattagccaggcatggtggcgtgcgcctatagtcccagctactcgggaggctgaggcaggagaatggcttgaacctgggaggcagagattgcagtgagccaagatcgcaccactgcactccagcttgggtgacagagcaagactccgtctcaaaaaaaaaaaaaaaaaaaaaaaaagaatggtggttaaagcagtttcactagagaagtacttagctcatcttggaattgaattttttttttttttttttgagacagtgtcgctctgtcgcccaggctgaagtgcagtggcatgatctcggttcactgcagtctccacctcccgggttcaagtgattctcctgcctcagtctcctgagtagctgcgattacaggcgcccaccaccatgcccggctaatttttgtatttttagtagagatggggtttcaccatattggaccaggctggtctcaaactcctgacctcaggtgatccaattgcctcggccccctaatgtgctgggattacaggcatgagccagtcaccacgcccagctggaattaagttttctacctttttttttttttttttaactgtgaaatatttcatacatagaaaagagtaagggtgccgtggctcacgcctgtaatctcagcacattgggaagccaagacaggtggatcacttgaggtcaggagttcgagaccagcctggccaacgtggtgaaaccctgtctctactaaaaagacaaaaattagccgggcgtggtggtagatgcctgtaatcccagctacttgggacgctgaggcaggataattgtttgaacccgggaggtggaggttgcaatgagttgagatcgcaccattgcactccagtctgggtaacagagcaagactctgtctcaaaaaaaaaaaaaaaaaaaaaaaaggaaaaagagtaagcctgggcacgttggctcatgtctgtaatcccagcactttgggaggccgagggaggcagatcacttgaggtcaggagtttaagaccagcctggccagcatgtgaaacccatctctgttaaaaatacaaaattagcccggcagtagtggggccctgtaatcccagctactggggaggcttaggcacaagaatagcttgaacccaggaggcagaggttttggtgagctgagatcacaccactacactccagcctgggcaatagagtgagactctgtctcaaaaaaaaagtatatgtaagctgggtgtggtggcatgcacctgtagtcccaaatagtggggaggctgaggtaggaggattgcttgagcccaggagttcaagaccagcctgggcaacataaacccccatctctgcaaaaaattaaacaaggattggctgggcatggtggctcatgcctgtagtcccagctacatgggaggctgaggtgggaggatcacttgagcctgggaggtcaaggctatagtgagccatgatcgtactgctgcactccagcctgggccatagagcaagacgctatctcaaaaaaatttacaaaacaagccaaaaaaaactatcatctgtgtgctccctttaaaaaataaataaataaaacattggccaggcgtggtggcccagactgtaatcccaggactttgggaggctgaggtgggaagattgcttgagctcaggagttcaagaccagcttagacaacatggcaagaccctgtttctaccaaaaatacaaaaattaatcggatgtggtggcatgcacctgtagtcccagctacacagaaggctgaggtgggaggatcgcttgagccttggaggttgaggctgcaatgagccatgattgtgcctctgcactctagctcgggcaacagaacgagatcccatctcaaaaaaaaaaaaaaaaaaaaaaaaaggaatattaccagcacctttgaaacttcctttttctagaagttgattgtattggttcttagcatgcataaggagattttaagcttagaacatattagcacttggtttaaagatgttttgtgtatggtttatacatgtagaaactgagaacgcttttaaccaaaagagctgagagattcgttatcatcagaaaagaaaagtcagttacgaattagttgttaggggctttgctgctcaaagtgtgtagtggacaataggcaaaaagtgagaagcatggtcaagggtgtttggatgggcttgaaaaccctgtgcattttattttattttattttatttatttatttttgagtcggagtctcactctgttacccagactggagtgcagtggcgcgatctcggctcactgcaagctctgcctcccgggttcacaccattctcctgcctcagcctcccgagtagctgggactacaggcgcctgccaccacgctcagctaatttttttgtatttttagtagagatggggtttcactgtgttagccaggatggtctcgatctcctgacctcttgatccgcccgccttggcctcccaaagtgctgggattacaggcgtgagccactgcacctgccttatctatttaattttttgagacggaatctctgtctgtcgcccaggctggagtgcagtggcatgatctcagctcactgcaacctccgcctcccgggttcaagcaattctcttgcctcagcctcccaagtagctgggcctacaggcacacgccaccacacctggctaatttttgtattttaatagtgacagggttttgtcatgttggccaggttggtctcaaactcctgacctcatgatccacctgcctcggccttccaaagtgctaggattgcaggcatgagccactgcgcctgggcaacactttatattttaaagggaagttgggggagggtgctattttcaaccttgctcaaagaacaaataattgggaagcaataaattttctgatgaatatgcttcatatttctttagacagtggggtctaatggaaaggctaagatatctgacatggagcaacatgtatttatctcttcagtggaactaatgtgtaattttcaggggagtttgatgaataaatgagtttgagaatatagggcagaggacttggaatttgtgtcagggttatggctggtgagattgatttggtgtcaaatttatgaatatctctgcagatactaacacagaaaatgagccccaaggtcactatagcagtatagtagtggagggaaatagaaactatctttatcaaatttctacacagacatacccctcaccagggaagcaaggaagttgaaaagcacactttgcctccctaacccaggaatttagatgggggatcagcaaactgttgagtaaagggtcagattttaaatattttcagcttttccatagagtctctgtccaactactcaactatgcctttgtagtgaaaaacagtcatagacaatacgtaaatgaatgggcttggctatcttcttttttttgtttgtttttaagatggagtcttgctctgtcacccaggctggagtgcagtggtgtgatctcagctcattgcaacctctgcctcccaggttcaagcaattctcttccctcggcctcccaagtagctgggcctacaggcgcacgccaccacacctggctaacttttgtatttttagtagtgacagggttttttgtcatgttggccaggttggtcttgaactcctgacctcaagtgatcctcccgcctcggcctcccagtgttgggattacaggcgtgagccaccacacgcctggctttttttttttttttttttttttttttttgagatagagtcttaactgtttcaggcagtgacgtgatcttggctcactgcaagctccgcctcccgggtttacaccattctcctgcctcagcctcccgagtggctgggactacaggcgtgtgccaccacacctggctaattttttgtatttttagtagagagacagggtttcaccgtgttagccaggatggtctcaatctcctgaccttgtgatccgtccacctcagcctcccaaagtgctgggattacaggcgtgagccaccacacactggctaactgcttttaactatacaaataataaaatactcttggatggagtctaaggtggaactgactgtgctcttaatagtgtctgaaatttatatggtacttactggactgttcacaggctctctgtggctcttgaaatagcaggggctgggtgtgatggctcacacctgtaatcccaacactttgggaggccaaggcgagagaattgcttgaggctagaagttcaagacaagccctgaaaacatagtgagacccccatctctacagaaaatttaaaaattggctgtgtgtgatggcaactgcctgtagtcccagctactcaggaggctgaagtgggaggatcacttgagcttgggaagtggaggctacagtgagctgtggttgtgccactctgcactccagccaggatgacagcaagaccctgtctcaaaaaaaagagaaagaaatagaagcagggatatacttgaaggggtatgtgtgtgttcatgtcggtacattggatgcttggtgctgctcggtaattttgaatgcctcacatgcattatgccattaattctcatacacctgacagatgcagggttcgtccctaaggctgattagctcattatgagtgaagagtttagaaccagactccctgagtgcaagtctaacctcttctttggctcctcatttgtaaaatggggataataacagcatctacctcacagactattaaataatccaatctcttcaaagatcgtaaaccatgcctagcatagataataagtatgagctctttattattactcttgctcctactactcttgctagctatttatttttatttttattttattttattttatttttttgagacggagtctcgctctgtcacccaggctggagtgcagtggtgcaatcttggctcactgcaagctccgcctcccgggctcacaccgttctcctgcctcagcctcctgagtaagtgggactacaggcacccaccaccatgcccggctaattttttgtatttttagtagagacggggtttcaccgtgttagccaggatggtctcgatctcctgacctcatgatccgcccacctcagcctcccaaagtgctgggattacaggcatgagccactgcgccggcctcttatttatttatgttttgagacagtcttgttctgttgcccaggctggagtgtaatgatgcagtcatagctcactgcagcttctaactcctgggctcaagtaatgctcctgcctcagcctcttgagtatctgggaccgcaggtgtgtgccactatgcccggctcattttttgtctgtttagtagagacagggttttgatatgttggacaggcaggtctccaagtcatctgcctgccttggcctcccaaggtgctgggattacaggtctgagccaccacgcctggtggatttattatttttaatttggcaagtctgtaagcccttttttgttccttttttttcaagaggccagaggcagaggcctttgtcattttctgtgtgtccagggaagtgtgcaggatgtaagccatagattaggactgggaggaagagtgtgtggtggttgtgacaagggtccaaaggaaggcagcttccgaacttacttgagattataaaaataaatttaaaccaggtatctctgtgtaatcaaaaggtttctgtaaaacagagatggagtgtatgtgtgtgtgtatacttgtaatttgaaaagacattcagaatagtaacttttgggacagtacagactacaaaaattacaacatgatagaaccttcttaactactaagaatatagaaaggaaaataaagccaggcgtggtggctcacacctgtaatgacagcactttgggaggctgaggcgggtggatcacatgaggccagcaggagtttgagaccagcctggccaacatgccaaaatcctgtctctactaaaaatacaaaatttagctgggtatggtgttgcacatctgtaatctcagctactcgggaggctgaggcagaaaaatcacttgaacacgggaggtagaggttacagtgaactgaaattgcgctactgcactccagcctgggtgacagagcaagattctgtctccaaaaaaaaggctgggctcagtggctcacacctgtaatcccagcactttgggaggccgaggcaggcagatcacgaggtcaggagatcaagaccatcctggctaacaaggtgaaattccgtctctactaaaaatagaaaaaattagcggggcgtggtggcatgtgcctgtagtcccagctactcaggaggctgaggcaggagaattgcttgaacttgggatgcagaggttgcagtgagctgagatcctgccactgcactccagcctgggcaacagaacaagactccatctccaaaaaaaatgtagaggccgggcatggtggctcatgcttgtaatcccagcacgttgggaggccgaggtgcgtggatcgcccgaggtcaggagttcaagaccagcctggccaacatggtgaaaccccttctctactaaaaataaaaaaagttacctgggcgtggtagtgggcgcctgtaatcccagctactcaggaggctgaggcaggagcatcacttgaacctgggaggcagagtttgcagtgagctaagatcacgctattgcactccagcctgggcgacaagagcaaaacttgtctcataaaaaaggaaaataatttattatagaggagagtggtatattaagaagtttgacaggcactggcttagagtaagatttttctcttagagtaattttctttctctcttaaggtatccaagcccaccaatgggatctgtctcagcacccaacctgcctacagcagaagataacctggaatatgtacggactctgtatgattttcctgggaatgatgccgaagacctgccctttaaaaagggtgagatcctagtgataatagagaagcctgaagaacagtggtggagtgcccggaacaaggatggccgggttgggatgattcctgtcccttatgtcgaaaagcttgtgagatcctcaccacacggaaagcatggaaataggaattccaacagttatgggatcccagaacctgctcatgcatacgctcaacctcagaccacaactcctctacctgcagtttccggttctcctggggcagcaatcacccctttgccatccacacagaatggacctgtctttgcgaaagcaatccagaaaagagtaccctgtgcttatgacaagactgccttggcattagaggtaaaatctgttcagattagctttttgggtcctttgacatttggttttaatttttagttttagtttagtttctgctcatttaagcttatattcatggaattagagcactggatgattttggaagatacgcactgttagcgtttcattttaaaatttttttatagagacgaggtctctaattttaaaagagttgtttgcccaggctgatttcgaggtcctggcctcaagcaatcctcctacctcgacctcccaaagtactgggattacagatgtgagccaccatgcctggcccattattagtgtttcacagcttgttttgttctgtcctattccttgtttgccccaaattctcagccttcttgctctttcttgttcccaaagcctaacagatttagttttgcagttgttggtttttcttccagtaaggaaagataatgattaaggaagacccatgacctagaggcaaaatcaacatatatggttctgtatttctaacattggaatcagttgagaaatatgaaaatgtcttagaatttctcttgagcttggtagaggaatgaattttttttttttttttttttttttttgagatggagtctcactctgtcgcccaggctggagttcagtggctcaatctccgctcactgcaagctccacctcctgggttcacaccattctcctacctcagcctcccaagtagctggaacgacaggcacccgccaccacgcctggctaatttttttgtattttcagtagagacagggtttcaccgtattagccaggatggtgtcgatctcctgacctcgtgatctgcctatcttggcctcctaaagtgctgggattacaggtgtgagccaccgtgcccggcccaggaatgattttttttgagatggagtcttactttgtcacccaggctccagcacagtggcatgatcttgcctcatggcaacgtctgcctcctgggttcaaatgattatcctgcctcagcctccttagtagctgggattacagatgcctgccaccatgcccgtcgaatttttgtatttttagtatagatggggtttcaccatgttggccaggctggttttgaactcctgacctcaggcgatctgcctgccttggcctcccaaagtgctgggattacagacatgtgcgaccacgcccagccatagaggaatgattttaaaatacatcagcccttgcttgttatggattttgtaaattagaatagcatgaaatagaacttgaacattttaattaccaagtcattttcttttcttttttttttttttgagacagagtctcgctctattgccttgttgcctaagctggagtgcagtggcgtgatcttggctcactgcatcctccgcctcctgagttcaagtgattctcctgcctcagcctcccgagtagcggggctacaggcatgcaccaccctgcccggctaatttttgtatttttagtagagacggggtttcaccatgttggccaggctggtctcgaactcctgacctcaggtgacccacccaccttagcccgcaagtgctgggattacaggcatgatccactgcacttggccaagtcattttcttctaactaaatattactttttaaaaaaactctttctcagctgggcacagtggctcatgcctgtaatcccagcactttgggagggcgaggctggtggataacttgaggtctggagtttgagaccagtctggtcacagacatggtgaaaccccatctctaccaaaaaatacaaaaatgagccagacgtggtgggcatgcacctgtagcctcagctactcaggagactgaggtggaacaattgcttgaaccaggtaattagaggttgcagtgagccgagatcatgacactgcatttaagcctgggcaatagggtgagaccctatctcaaaaaaaggggggagaatgttgagagagagcctaagtgcatttcagaaggatgaagtaagggaccctcttgcttcaaaaaaaccaaatcctgactcaccaaacagcctgcccacagataaaagttagctagaattggtttcatgggtatttttccataggttgtcctcagtgtttttttgtttttgtttttgttttgttttgttttgagacggagtttcgctcttgttgcccaggctggagtgcaatggcacgatctcggttcactgcaacctccgcctcctggattcaagccattctcctgcctcagcctccggagtagctgggattacaggcatgtgccaccatgcccggctaatttttttgtatttttaatagagacggggtttctccatgttggtgaggctggtctcgaactgctgacttcaggtgatctgcccacctcggcctcccaaagtgctgggattacaggcgtgagctaccatgcctggccctcaagtttttctttggaccagtagtagtatctgaatgaactgcacctgaaggtttgtttcaatgtttgattttttgcctccctttcatgttggctataaggaaaaggagcatttgaggctgtggtgggggtcagggactgagaggctccaggtctcaggaggctgcctccacagataggagtgctggctgagcaggccttccagctttctttccttttttttttttcgagatggagtctcatttgttgcccaagctggagtgcagttgatagaatctcagctcactgcaacctctgcctcctgggctcaagcgattcttctgcttcagcctctcaagtagctgggattacaggtgcccgccaccatacccaactgtttttagtagagaccgggtttcactatgttggccaggctggtcttgaactcctagcctctgatcatctgcccgcctcagcctcccaaagtgctcggattacaggcgtgagccgctgcacctggccaggccttccagctttctcacccacacacagacctgcctaggcacaggtgcatgcctctggcctggtctatgcctcagcaccttggtgctctgggctgttaataccctgtagcatgcattgtgttttcagccttttgaggcattttcacgtccatcatagcataggattggggagctaggagtcagagtgggtgtgactcgtgtgtgtttggcagctgctcgttgagaaccttgaaagtcgaggctcccagtcagaattttaggtacctgcctgttgacctctggctctaggatgtgtgttttagaaacctgtatctagtgtgcgtgcgtgtgtgctcactggagcgagtactaggaggttgtagggaggaataccaggtattacagaagggatcacttagagcttggtgagtgggtggataagtaggtgcctgagagaggtcaggagtaggaggaaggaagcctggttaatgattgtgtattttaagataacctacatacttggccatacatagttcctagtctctctggccccagagagaggttctccacacctgagcctcatgacactaacccagccagctgagcttcagccaagggtttgtttggtgcttgactgagagagaatgtaaatgggacctgagaaatagacctttaccaaattccatttagtggtattttgctttctgaatatttaaatgaaactttaggttatagcataagtaaatttttttttttttcgagactgagtctctgtcactcaggctggagtgcagtggcatgatctccgctcgctgcaacctccacctcacgggtttaagcgattctcatgcctcagcctcctgagtagctggggtaaatgtttttatgattgttatcttctaaaactattattaggatagtggtgcctgtctgatcttgttaaaaacaactcttgggacttttgcaattaggttactaggaaaagtattaaaattaaaatgagaaacagacaagtaggacaaaatgtgctgataattgaagcttcgttattcccctagatagtattacagagaatgatgatggcttaggtgactttattccttaaattattttacaattttttttaatcttgattttcaaaagaggattcctgtaagtaaagagatattttaaaaccagtttgtgtttagctattttcttttcttgctgacttttctgcaaggaaagagttgatcctgagatttgatttgaaggggaatacttggtatctgtaaggtgagtagagcttgtgtgatgagactaacgtcactgaatagctgtagacaggtgagcatgctgggcaaagggcaaaagtggcaaaagacagccagggcagtgggctgttgccatatcacgaagggctgagctgaggagattaacaattttcttgcattgccttcatttgagtcatgaaacagccagtttctcacaactgacaaggtcaggtttacaggcaatttctttttatatattaatttttaaatttagagcaaatgcttgactgtcatgtaataatatcattctcattcatttgcattccagtatgcttttctgactaaaacggaagaaatagcaactttagaattgtacttaaccctgggtacacacacccatgactatttgtatgaaaatttgtatttaagtgtctaaatgcagcctcacctgtgcttttcccccatggtgtggcataagaaaacaattggtgacacaagctggggatctgtgggaattgaagtcagtgaaacagatcgtgtggaggaaaaatagtttcccaggcttacaagtgagacttaaagtgatttgggatggaattggtataaatcaagcagaaaggttgtattgataccttaggtcatttagttcaatcattttccctgtgcttttagccctcttcagagtctaactccatggccctccagtctcaacttggacacctccaaaaaaacattcacttcaacaaaagtttattgagtgcctattatgtgacaggctaggaacttgggatacagtagtgaacaaaacaaagatgtatttcctgtggcacatctggaacataagttgctttttttttttttttttttttttttgagacagagtcttgctctgtctcccaggctggagtgcagtggcgccatcttggctcactgcaagctccgcctcccgggttcacgccattctcctgcctcagcctccggagtagctgggactacaggcacctgccaccacgcccggctaatttttttttttgtattttttagtagagacggggcttcaccgtgttagccaggatggtctccatctcctgacctcgtgatccacctgcctaggcctcccaaaatgctgggattacaggcgtgagccaccgcgcctggcccataacagtttcatgaggtggtctgtctcatgttgtatggctgtggtagctgacaagtcttgtgttctggctctccaccagggagaaagaagccacagccaagtccccttcttgtgtttgcctagcccagtgtgtggacttaaaagtgcatggccccatagttgtccctcttgagttttgtagttttgttgttggtttggtttttattggtcttgtcatatgatctgcgtacatctctgaatccttttttttttttttttgagttgaagtctcgctcttgtcgcccaggctggagtgcaatggcgtgatctcggctcactgcaccctctacctcccaggttcaagtgattctcctgcctcagcctcctgagtagctgggattacaggcacctgccaaccgcgcctggctaatttttttatttttagtagagaaagggtttcaccatgttggccaggctggtctcaaactcctaacctcaggcaatccgcccgcctcagcctcccaaagtgctgggattataggcatgagccaccacgcccagcctctgaatcttttaaaatcctggttatgtcatctagcatattcattaccctccagtttcctaactgcaggttttgtaaaagcaccaacagatctttgtactaaagtccttctatgcagcctctccagatctgcctcttatatctataaaaagacagtgaggttgatctggcgtgacttgttcttggtgggctcatgctgcttccagatgctccacttcccattctaaattctcacaaaccatctgttagctaatcgcatccagaattttgtctgggtttcatttcaagctcactgttttacattttatggaatttgccatcttttgacaaaaaacaagagacttgacccttcctaagtcttccagtgtcctgtgatgtaatttctctatgacaggagactagtcttggactcttactgctgtttgccagtgtgtttggtcagctcttaagaacaccctttcctcatctttggtgctccttttttttttttttttttttggcattttttttcttagtgatactcagcgttctttgaggtcaccagcatcctcaacattcttgctcttcattcccataattgctctgtgtcatctgtgattgcgtttttataatttcttcttggattgtctttgccccatttcaaaacctgtagtaatttggattacatctggtctctgtgtcttttgaattggccttcccaagggcccatggtacaacttcctttactgactgacctggaattatcagattcccactttaccaattggttttgcttcattgcttagaattaaatttgtattagcattttcttcattgctgcatctgcttgctgaggtgaagtaatctgcaaagtaagtttaggtttcattaatactgattggactttgtattggactcatgatgaatccctaagagatcatcatgagttcctcctgctgggtggcctgcagtgctcttggggctgtatgtgttcatcatgaagcatctgactcagccctgggggtccatgtggcaagcttacaggctcccagtgtaatggggcttctgtccctcacctcacgtcacattctagcaacgtgaagccttcttaccaaggcttcccagaaaggcccacaagttagcattcaccttaagcaagaatctcaggtgtgtccttcccatgccgtggtggtgtgtggatgtctggtgcccgaggaatcatttccacttgcctccttggacctttcatcaggactgaccaggatcctcctccacccttctgtctttgacattgtgtcagttgtccttcacagcatctcagctttatttctttagtaccaaaagtgctttttttccttgactataataccatgcaaatgtaggaatctttagaaagtcctttagaatattctcgtatttaaaaatatatacatatgtgtgtttgtgtatgtgtatatatatatatattttatgtgtgtgtgtgtgtgtgtgtgtgtgtgtgtgtgtgtgtgtatatatatattttttttttttttttttttttttgagatagagtcttgctctgtcacccaggctggagtgcagtggcatgatatcagctcactgcaacctctgcctcccgggttcaagcagttctctgcctcagcctcccgagtagctgggattacaggtgcccgccaccaggccgggctagtttttgtatttctagtagagatggggtttcaccaccttggctaggctgctcttgaactcctgacaacgtgagccactgcacccggcccagaaaaaaatatttttaaaaggtttttgttcctctttcctaatgtgtaaattaagtcagaatgccatggaattggggccctggtgtggttcaggcagggcctgtcccatcctggtcattaggctgacctctgttttctgtgatagctgttctctggtgatagctgttgagtaagaagaaccatcagctaggggttcacagagagaagtttattctcatgactgctcccacactaagagcttgaggtttatatagtttgccaactatctaccttctgtctatgaatttacctattctacctacctgatataagtaaaatgatacaatatttgtcctttgggtctgaattatttcattgggtacaatgttttcagagttcatccagattgtagcatatatcaaaacttcatttcttgtcccagcatggggtgactcacacctgtaatcccagtgctttgaaaggccaaggtgggaagatcacttgaggcaaggagtttgagaccagcctgggcaacatagtgagactccatctgtacaggaaattatgataaagacttcattcctttagggctgaataatattccattgttatgtatatatcacgttttgttaatccatttatctcttgatggatacttgagttgttttcgttattttggctatggtgaataatgctgcagtggacattgacacacaaatgtttgagtccttgctttcagttattttggttatatatctcagagtggatttctgggtcaaatgggtaattctgtgtttagctttttttttttgaaacggagttttgctctgttgcccaggctggagtgcagtggcaccatctcggctcactgcaacctccatctcctgggttcaagcgatttctcctgcctcagcctcctgagtagctgggattataggcacgtgccaccacacctggctaatttttgtattttttagtagagacagggttttgccatgttagccaggctttgaactcctgacctcaactgatcgctcacctcagcctcccaaagtgctgggattataggcatgagcctcctatgtttagctttttgaggaactgtcaaactattttccatagcagctgtaccatattccattccaaccagcagtatataagggctcccttcttcaccgccaaaaaaaaattcttccacatcctcatcaacacttgttattttccatattttttattatagccatcctagtaggtgtgaagtggtatgtcattgtggttttgatttgcatgttcctagtgactgatgttgagcatcttttcatattggcttttggcaaatctttggataaatattttcaagttctttgcccattttttaattgggttatttgagcgtttttgttttttattttgttttatattttttgagacagagtctcactctgtcgccctggctggagtacaatggcactcacgatctcgactcactgcaacttctgccttccagattcaagcaattctcctgcctcagcctcccaaatagccaggattacaggcactcaccaccataccccgctaattttttgtatttttagtagagatggggttttaccatgttggccaggctcttctggactcctaaagtgaggtgatccacctgccttggcctcccaaagtgccaggattacaggcgtgcgccaccatgcctgaccttagttattgtatttaggctgttgatccattttaaatgactttttgtgtatagtgtgaggtaaggtttcagagtctttcttttgcatgtggaaattggtgcagttgtcccagcaaggttattctttccctgttgaatagacttggcaccctagtcaaaaatcagttggccaagctgggtgtggtggtgcacacctgtaatcccaggtaccctggagactgaggtgagaagattgcttgagcctaggagttgaagatcagcctgggctacatagtgagactcccacgtgttaaaaaaaaatcacttgatcataaatgtgtgggtttatttttgacctctgagttctattccattgttctatatgtctctccatatgccagcaccacactgttgattactatagctttttgtagtaattttgaagtcaaggaagtgtaagtcctctaactttgatgcttttcaaggttgttttggctattcaggttcctcgcaattctatatgaatttgaggattggttttcccattgctgcaaaaaaaaaggctgttagaattttgatagggattgtgttgtatttgtagatcactttgggtagtattagctttttttttttttttttttttaatttcttttatgaggcagggtctcactatgttgcccagactggtctcaaactcctgggctcaagtgatcctcctgtctcagcctcccaaagtgctggcattacaggtgtgagccactgcacctagccaatattaatatcttaatcataagtctttccatccattaacacaaatgtttttgcatttatttaggtctttaataatttttggtatgcaagtgtttcaccatggttaaattattctcgttttgttttgttttgtttagacagagtcttggctttgtcaccaggctggagtgcagtggtgcaatctcggctcactgcaacctccacctccctggttcaagcgattctcctgcctcagcctcccaagtagctgggactacagacatgcgccaccatgcccagctaatttttgtatttttagtagagatggggtttcactatgttggccaggatggtctcgatctcttgacctcgtgatccacctgcctcggcctcccaaagtgctgggattacaggcatgagccaccgcacagcctattcttggatatttttattttagatgctattgtaaatggaatcacttttttttttttcttcttggagacagagcctcactcccgctccattgcccaggctagagtgcagtggcacaattcttgtgcctcagcctcctgagtagctgggactacaggtgcctgccaccacgcccagctaacttttttttgtattttagtagaattggggttttaccatgttgcccagcatgatcttggcgcctcccaaagtgctaggattcaggcatgagctaccgtgccctgcctggaattactttctttctttttttttgggatggagtttcgctctatcacccgggctggagtgcagtggtgtgatcttggctcactgcaagcgccacctcccgggtgcacgccattctcctgactcagcctcccaagtagctgggactacaggcgcctcctaccacgcccggctaattttttgtatttttagtagagacggggtttcacggtattagccaggatggtctcgatctcctgacctcctgatctgcctgcctcggcctcccaaagtgctgggattacaggcatgagccaccgcacccggcttggaattactttcttaattattcattaccaatatataagacgcaactgatatctatgtgttgatctcgtaccctgcgactttgctgaatttgtatcttttcttatatatatgatcgtgtcttgacttcctcttttccaaaagcccacatactcttgtaccacagcatactggcctgtgatacctttagccccgccccctacctttcccaaataaaatctctgtgttaaccagtaaacagccctcttgaatcaagttactactctgaaggatagtggtaattttaagaaagagaccaagtcttcagtattaaaaccctattagatagcattcagttgtgggtttgagtgtatgagattacttgactgctagccagggcacacagacagggagcctagccctcttaaagcctctatctctctggctactctgattcaggtgcaggtgcacagagaacacaggggcaggcagtggacccatgcagctccgtgagggccaggggtgtttgtctcctttgtgtcctctgttgtatctcttcacggcctacacatagatgttcaatatttgttgaatgactagaggaataaaagccacagagagcaggatgatacctgtctggtgattatagtacatgggctttgttttgttttagatattttgggggctataagcccctttgagaatccagtgaaagttgtgcagtcttcagaaaaacagcatacattcatgtatttgcatacaacttcgcaggatgttctttgatcactgagacccattcacatcactcaagttagaatttatgattccagtgtcaccagtgtactcctgatcttacttttatgtaacctgaaagcatacaatctcagcctatcagtacagggagcggagactgattatggaaccaaaaaactgctgtgacgaccagtgcttgggccctccagtgcgttgactgctctttgaatcaagtgccagatgccagtcagtagagtcatttcctggacaacactctggacaagtagggctgtaggaaactattgccagcagcaagaggtaccctcttgccatttaactcttggtagacataaaagggctgactagtgtccctggcatatgtgttttagagttaatgtgtccactccccaggtgctaagtgcggccagccacaaagatagtgttttgacagttctaataatgattaggattggcctgttccatagagtgaaaattaataaggatgatgcattaggtatgtgcttcctcttaatctgttgataaggtcagccacatctcccaggtgtagtttgccccgtgaactgagttggtatctacccacatcaagattggtctgccctctaagactatactttcagggatcatttctatagttcattactagagaagtttctctgaaggtgtagagcacccctccctccaaaaaaaaaaaacagattgatctgccctccacagtgagtgcttctttgagctggatccgtgtaccatgaacccagaggaagagcaccacaccagaatagggagtgatgagggaaacggcaagatggctgccaagctaccagccattttaggatctgagcacaagcactgtttggtagagccatggaagaagctggtccatagccaggcctgtaactggacagcaggctgcataacagccaggatatctttactgtgttgagatagaaaacagcatgaagaatgatgatggtgttttagcatgtggaaactcctgcaaggccacaatgaggcactaatggtcaaggggccaccagaagtctctcagccattctcttcctaggctgctctttgacctacttctgctggtccaggttccctctgtctaagcagtagctccttgaatcctgtgctctgcagcattgagttaatagtgtttttctgccacttgctgcttttatgtgttttctgtctctctctcttttttttttttttcaatagaagctaggtctcactatgtcacccaggctggtcttgaacatgtggcctcaagtgatcctcccaccttggcttcccaaagtgctgggattacaggtgtgagccactgcgcccagctacaccaagtgcagtgacacgattttggctcactgcaacctccacctcccaggttcaagtgattctcctgcgtcagcctcccgagtagttggaatttgggattacaggcatctgccaccacgcctggtgatttttgtatttttcagtagagatgaggttttgccgtgttggccatgctggtctcgaactcctgacctcaggtgatccatctgccttggcctcccaaagtgttgggattacagatgtgagccactgcgcctaggctttttcttttcttttcttttcttttttctttttttcatttttttttttttttttttttgagacagggtcttgctctgtcacccaggctggagtgcagtagtgtgatcacagcttactgcacccctgcaacctctgcctcctgcgcttaaacgatcttcgcacctcattctcccaagtagctgggactgcaggtgcatgccaccacgcctggctcatttttgtattttagagacagggtttcactgtgttgcccaggctggtcttgaactcctgggctcaagtgatccacccacttcagcttcccaaagtgctgggattacaggtgtgagccactgcgcccggccactttgtgcttttcacactatgttattatctgacaaagattcattgtgtatcccactcaaaagacagaagttttttaaggatacgaactgacctgcccattttccatggagtagatgttcagtaaatttatttaattgattaggtaggatcatgtagaaagtatcctgttgaagaccgccagactcacaagttaattggaaggcgtgaggtgtgagtgttcttggcagctttcaatccttagcctcatctttaatcttcccgtagtcttctttggctgcttagtatccatcacagtcatttattagaccccgttttcagcctgttcctcattggttttgagaggacccttgttggtgacaaggttggaaatcctctgatatatacagtgttgtgcttctcagtgctaattccagctcttcccttcgtgcatccaaagggtatgatcattagagggggcgtggggttgggggatgggttctattcaggaatctctactcaagtaacaatcatttaattactgcaagaacctttcaaagttggaaggaaactgagacttggagaacttaagcagtttgctacagtcatgtagtttctaaaagtggcagaaccaggacatttgtttggtgtcctgcatgctccaaagttcatggcacggaccattggactgtgccataaaaaccttatgcctgtttttattttgagatgtagtcttgctgcgttgcgccggctggtctcaaactcctgggctcaagcagtcctcccacctcagtctgccaaggacctggaactagaggcatgtaccacgatgcctggttctatatgtgtttaagcagacaaaagcttatttcttattgtcttagatcttaggtgggtcttatattcaagtagcgtttttatggacctaagtacacaatacagaaccttagattagtgctctgctgaacagagtaacaccctgtctacaatgactaccacctgaaggtctttttttaaaatacacctttttgtgtaatttgactttaaccattctcagaatcatgtgttcatttctatcctgttggggttagtggccaaaatagaaggttggtgtggggtggggagctgctttgtgctcaaaagctgtttctgtgtgtgtgtgtgttttgatttttgtttttttgagacagggtctcactcggttgcccagtctggggtgccgtggcactatcacggctcactgcagcctcagcctcatgggctcaagccatcctctcacttcagcctcctgagtagttgggactgcagtcatgtaccaccacacccggctaatttttctattttttagaagagatgaggtttcaccatgttgcccaggctggtctcgaactcctgacctcaagtaatcccaggagttcaaggttacaatgagctgtaatcgggccactgcattccagcctgggcgacagaccccgtctataaaaaattaaaaaataatgtgcatggtggtgcacgcctgtagtcacagctattcaagaggtggaggtggaaggatcacttgagcccaggcgttagaggttacattgagcagggatctcaccactacactccagcatggctaacagagtgagaccctgtgtctaaataataatgtatgggccctttggataaggtagtgtttgtgatttaatgtaaactgtctttttcttgttgcagagaaatgctaactttgtcttcttcatccatacaggttggtgacatcgtgaaagtcacaaggatgaatataaatggccagtgggaaggcgaagtgaacgggcgcaaagggcttttcccctttacgcacgtcaaaatctttgaccctcaaaacccagatgaaaacgagtgattgctgttgccctgtttcctgctgctttgttgttctgcctgtcctagtctcctttgaagtgggaaagcattttctctcataggcaagtcacactgcattgccgaagtccagctttctgcagactggcagtcgcacacacatttggaatgcacacagcggctgcctcctgatgtttgtatcatagtcgtattgtcaaagagtagccgattttagagttcttttggatcataaactggaaatactgatggaagcacacaagtggagagaagttgacatggaaagggtcttccttctcattgctgcccgtttgtacatgggactgattctgttgtgttcaccagagaaagcttgaggccatggcgagatactgcatgtttgctgttccacaaagcagtggcttagctgccatcttgcttttctttggacaacaggaagtgaaccttaaggaagagagaattctgttctaaaactccaaaatctggcttttttttttcttttgttttggtttggttttggaaaactaattaattagacttgtgtgggggtttttttttgttttgttttgtttgttttgttttgtttttttgagacggtgtctcgctgcatcacccaggctggagtgcagtggcgcaatctcgccttcctgcagtctccgcctcctgagttcaagcgattctcctgcctcagcctcccaagtagctgggactgcaggcgcgcacaccacgcccagctaatttttgtatttttagtagagacggggtttcatcatgttgaccaggctggtctcaaactcctgacttcaggtgatccacccgccttcagcctcccaacgtgctgggattacagccgtgagccgccgcgcctggcctagacttgtgtgttctaaacaggttaagtagcaggttgggtttttatgatagtgcaaggaatgactcatgcctctgagcttctaaactgaagctgctgtaactaaaggaatctgaaaagaacaaccctgaagcagaggcctttattgtcttggttgccagtagtaccttgttttgccatgtagcagacaacacacaaaataatgcagttgtggtgtgccatgctatgtgcacagccccttggattactttgttttaaaaagcatcagagttgggggtactttagggaaacctttgcttaccttgttttgccagtgataagagcagtgggttggagggcacttggccagttttctgttcagcttttcagtgaatgtacccctttaaggttcagacttaaacttccttaaaaagtggcgttgttcatagaatcgttggactcattaatgaatcgttcaactccactcactgaagcccagacctccgtgcccaggcccaatctcgtcaggctgccagagaaagttggtgctgctcatactggtctcacagtctaagtaagtgtctgtgatgctcccaagcaaaggaaatgcaagctctggaaattcgttaatgtatttgatgtcttagtgttttagtgactagggagaccattaactagtttatcattaaccacttatcagtgtattgatgttaaagcatttccctgttagctaaaagaggcctgttcatacaagccaactggtatatacgtgtggttcatccatcatctgctgcacatagcagactagaattctgggaaccctgtgcaattcagtctgctctcccttgtggaccctggtaaagaaaagcctcagctcatagtgaacacagcagacctagaaatgtagcagcagcctactgagtagctttcatttactgatcatctgctgtgactgtggccctgtctggaggttcctaggttttgagatttagagcaatgcattctggagacagaaccagcagaacagccatttttcaatttttctttaaatcagtattccatcaggcagataactgctgtattcatgaatcttgagagtgttcctgagacagaattaatggtcatttgggaaaactatcgccatggcttcccatctgtggttttcctctaaaagccttggagattagcccttccttgccagtgagaacggtgaccgcctcctgctctgcacggtctgcggcagttgccgcttctggttaggtgtgtcaggttggcttattttgggttcaggcctggcgtagcacccacaagtggcagacatatcacaagagtccccagactctgcctagaaacagtgtttgccctttggccagtgacgtggttcatcccggcccatgttgagccatgagtggagtttccaacagagggaggaatgtgtgccttgttcaaggagggcacgacccttaggcctttttcaaccagatttagctgaagggcttgacacctttgaattacagcagttgactcagagtgcaagaagtctggccattttggaaagcaaggtttcctttcagccctgtctactgaccaataccccgactcaccttgtgtggcgcacttcagaatcagatatacctagagtatacctgtggtttggttttataattaatcagctcgttacttcagcccatgaaaatggcatccagggctgccaggagattcagagctcaaaacaaggcgagcttgagttctgcactccagatatgtgccaaaactagtaaaacttaacggacttacaaccttgtcagtttttttaatgaggcagggatactctgtttttcacactaaacatatgaatgcagcactgctgcctcagctcagcttcgtgcctgggttccccactggtctgggaagactgttgtgctccatagagcagtgcacatctgacccagagggtgggtgttcataactgctacttgctctgctctaccatgtttaaagaaatatttggatgttaaattaactcactatggtttttcacctgggaaggaaacaaattacgtactagagggcattgactggttaaaaacttgtgtatcccgggaaggacctgcggtacaggagtcagccatgtctgtgctgtgtggaaccacctgatgacatggttaacgaggaagacgatgtgttgaccggctgccgtttgaggactttggtcacccagactagacaccttctgtgctcatgtttggaaagctgaaagggaaggacagctgtgccctcctgggagctcatgtgtccctggcgctgtgctagctttcctttacagctgtttacagacaaggcaggcctgaggcagatggccactgctcttgtgatgtttgctcagaggaatatgaacattttatttttgaaaagggatgatgtggttttttgccaggtgtttataattaatcctttaatattatggttattaacctcttaaacatgaatgaattcttgattgttttaacacagtacctaagactaatgctttctgtggacaccactgagctctgcctcaactccaccctctgcgaccggaggactatgcccctagtaactgctgtcggtgtggacgctgtgctggttctgttttctaaaggagcagaaggacaggtctctgagacaggatcgttgtccctacaggaggaacagtggccttgcttcttagacggtcttcactgtgtgttttaaaacaacaacaacaacaacaacaacaacataaaactcttttgacctgtaacttaaagatcataaacttcaggcaataatattttctgtgtaagcttttaaaattatttttggggatcatagcttgttttattttgtgctataaaattaacagtattaaatgacttatattcttagaatacatcgagtgtcttttcttaacagattagtgcctttttatttttgtattccgttttacgttactggtcccagcatcaaaacccttgtttccatggcctgtttgtatattgtctcaataaaacttgcatcagccggtggtggcggcagcttcggtgtttcagtgtctcctcagtccgcccccactagcctcctggcagttcatcagtggtgaaatctctgatgcttctcagagacccttagtgctgctgctgaccaagagctagaatgaagtcttggcatccgcccattccaacactcgggcacccagaggagagcacctggggtctccctccaaaagagaaatctgcctcccagagtgtctgtcttgtaggtattgtatgggagcctagtgcttggccttctgagcatgaggcaatagttcccacaggttgcaccaccacagagaacttggatctttttccttctaggcacccatatctgaggcttctagtaaatatttcttcagcatgagctaaccagggttgaatggtatcaagcagaagtcatgggaagtgagcagcctcattgcaggtcagggcatgatatctgtgcggctttcttgaatccttttctgttcttggctgtaggtggttctcctgatgaactttgggagacctccaagtggattggcttgaggtgttgggaggcccactgacaccccctcagccagggccttgtctctcctactcccagctctcagtacattttatctttcacttcactgtactctattcccatgcctatttgtgtattttgaggtgcatattttcttgtaaaacctcaggaagccatttttaaaaattatggctggatgtggtggctcatgcctgtaatctcagcactttgggaggccgagatgggcagatctggagttcaggaccagcctggccaacacggtgaaatctcatctcggcaaaaaatataaaaatgagccaggcatggtgatgcaggcctgtagtcccaactactgtgcagggagggccaaggtgggaagatcttttgagcttgggaggcagaggttgcagtgagctgacataccactgcactccagcctgggtgacagaggaagatccttctcaccgccctccccgcccccacccccactaagacagtcttgctctgttgcccagagctggaatgcagtggtgtgacgtcacctcattgcaacctccacctcccgggttcaagcaattcttctgcctcagcctcccctgagtagctgggattacaggtgtgtgccaccacgtccagctaacttttgtattttttagtagagacggggtttcaccatgttggccaggctggtctcaaactcctgacctcaggtgagccacccacctcagccttccaaagtgttgagattacaggcatgagccactgcgcccagctgagaccctgtcttaaaaataaatttaccagcactttgggaggctgaggcactttggatcacaaggtcaggagttcaagaccagcctggccaagatggtgaaaccccgtctctactaaaaataaaaaaattagctgggcatggtggcgggcgcctgtaatcccagctactcgggaggctgaggcaggagaattgcttgaacccgggaggcagaggttgcagtgagccaagatcacaccactgcactccagccccatgggtgacagagtgagactccatctcaaaaaaaaaaaagttaaaaatttatttaagacagtgtcttgctcaggctggagtgcagtggtaagatgatagctcactgcagcctccaactcctgggcccaggcaatcctcccaccttggcctcctcagaagctgggattacaggcatgaccctctgtgcctggcccaggatatatatatatatatatatatagaactatgaggctaaaatgtccctggttcctactttcaggtttctgctgaatttgagagaagtctgtcttgaaatatcaaaactgtcacatcattctggaagaaacaatactccagagacatctttgaaaactacctttagagcctggtgcggtggtgcgttcttatagtcccagctactctggaggctgaggctggaggattgcttgagcctaggagttccagactgcagtgagttatgactgtgcctgcgaatagccactgcactccagcacggtcgacatagtgacacctattgagacatagtaggatctcaattttttttttttttttttttgagacagtgtcttctgcagtggtgtattctcggctcactgcaacctccacctcccaggtttaagcgattctcctgcctcagcctccccagtagctgggactacaggcttgcgccaccatgcctagctactttttgtgtttttagtagagagcaggtttcaccatgttgaccaggctgctcttgaactcctgacctcaggggatccgcccaccttggcctcccaaagtgctgggattacaggcatgagccaccacctggccagcatctcaatttttaataaataactaaaaaataacttgtttgaacaggtatatcttggccagcaatgctggactgggttcctttgaggtgagggaaactcttggacatgggacctagtgggggcctctgcttgcctccctgctgggttaacagtacagctggcccagccagtcttgaaaccttaccctgcaacaaaaacttgacacctccaggctggtaattctggaggtgtcttctctgccaagtcggtgactccccaacccgctattatggctggactctgctcttgcagtcttagtgtacaccctggttcttcaagggcagcaagcaggactattccggtagcaaccagagctggagctcagggccccgcactggaaagctggggcagcttaggtggtaactagtgtgctgaggatgaggggcgctatggagcccaggcgggtttaggaagcattcttggcttcctggaggaggggaaatactggtaattcaggctgaaggagctggatggggccaggggcagtgactcacgcctgtaatcccagaactttggaaggcctgagacgggagggtcgcttgagcccagaagttcgagaccagcctgggaaacatggcaagacctcgtctcaaaaaagccacgcgtggtatgcgcctgtgctcccagctgcttgggaggctgaggctggaggatcgcttgagccctggaggtcgagactgctgtgagccgtgattgcaccactggactccagccttggtggcagtgagaccctgtccccaaagaactgggtgatctcgaccctccacatcgctggctctccacgggcgctgcacagtggagacccaggatctgattgcataggactgggcactggagtttaagttctccaggggggtttaatatgcaacgaagttgggaaccactaccagtgaaccccttcattctgtgcggctccagctcccggaagccctcggacaaggaactgtagcccatgtaccgcgtgacgtgagagcggagcccgggtctgcccgggcgcgggcccgcggccacggcgtttggatcccagatcccagcccccgcgctcagtccgggcttcctgaccggcgctctccgcgtcccttctcgcgcgcccttacctggggctggggaggtggggacagagccgggcgcagtcgggggcacagccctgaggcggggctgagggccaggccgccacgtccctggaccctgaaaacgggctcggacccccgctgcagcgtggactccggtgtggccgcggggcgtgcaacccggaccctggccagctccgtgtcctccagacctttactcatgtccccgcatcgccaggccgagctgcaccttcggtccccgcccgcggcagccgaggtagggcatctccagcgccgactccggggaaggtggacatcgcacggaagggggtgaagggcagggaggatcccagcttgggatgggggtagagggtggcggaccttgcgcggggcgggtgtggagggcggcccaactctcgtggcccctggtgcttccgggagctccgtcctcgctctcggatcccaaggaagaacttgacctttccctgacatcctccagtgcccatggcttctggcgtccacggatggcggggaggggaggggggcgcattcagcgactgcagagactgggggctgtgggccggggcagctgcggggcggagggtggcgtgtggtggggttgggtggcgtggggttgcagaaggcggggcatggggcccaacggccggctgcgccgcccttctccgtatggctcttcggagccgttgcatttgccctctcagggcttcctgggctctcggccctaagtaacctgtgtcccagagtccctgagggaggcgcaggatcactgagctctgccctccctaagatggaagcaggaccgtgtggaggagggacggccgcatgggatggccagggtgggggccccaagaggacagcctccgcccgctcgcccgcccgccaaggaaagccctgggggaacacactttcaggctaaggggtctgaggaagagaagactaacaagggggaagccctcgagatgcccaacagtcaagtccgggaaggacggagtagataaccagtaactgcctagagggtgggagccaagaagaggaggggcctggacagggctgcaaggaggaagacacaggcccccatgccagccttctggaaacagcggtttgcagaccacctgagctcaccaagacagctctgaagaatttagggaattatgctttggcttctgggttgaaggaaaaaaatagctataggatgcagcattcaaaagacccgtaggcagggcgcggtggctcacacctctaaccccagcaatttgggaagctgaggcggagaggatcatgtgagccccagggttcaagaccagcctgggcaatatagtgagtctacaaaaaaataaaaatgaaaaaattagctgggcttggtggcatacctatagtcccagctactccacaggctgaggtgggaggatggtttgaacctgggagttggcccaggtgtggtggctcatgcctgtaaccccatcactttgggagactgaggcaggtgaattacttgaggttaggagtttgagaccagcctggctaatcatggtgaaaccccatctctactaaaaatacaaaaattagctgggtgtggtggcccacgcctgtaatcccagctactcaggaggctgaggccggagaattgctttaacctgggaggcggaggttgcagtgagctgagatcgcaccattgcactccagcctgggcaacaaagcaagactcagtctcaaaaaagaaagaaagaaagaaagaaagaaaggccaggtgcggtggctcatgcctgtattcccagcactttgggaggccgaggtgagcgaattgcttgagtccaggagttcaagaccagcctgggcagcatggcgaaaacctgcctctacgaaaaaatttttaaaattagccagccatggtggcacgcccactcctgtagtcccagctactcaggagaatgaggtgggagggtcacctgagcccgggaagtgaaggttgcagtgagccgtaatcgcaccactgcactccagcctgggcaacagagcgagaccctgtctcaaaagaaaaaaaaaagaaaatatttaaaatatttaggcccagcatggtggctcatgcttgtaatcccagcactttgggaggccgaggcaggcagattgcttgagctcaggagttcgagatcagcctgggcaacatggtgaaaccctgtctctaccaagaaaatacaaaaattagctaggcatggtgacaaatgcctgtagtcccagctactccggaggctgaggtgggaggatcccctgagcctgggaggtggaggctgcagtgagctgtcatcacgccactgcactccagtctgtgccacagagcaggaccctgtatcaaaaaaaaaatatgtatttttaacacaattacaaaacactgtttataattaaaaataataaaatgtttgtaataaaaaaactttttcacggcagaataatattccactgtgtggactgagacagctggttttgtttgtttgtttgtttgtttttgtttttgtttcattttgttttttgttttttttttagacagagtcccgctccttcgcccaggctggaatgcagtggcgcgatctcagctcactgcaacctccacctcctgggttcaagcaattctcctgcctcagcctcccaagtaggtgggattacaggtgcccgccaccatgcccagctaatttttttttttttgtatttttagtagagacggggtctcgccatgttggccaacctggtctcgaactcctaacctcagatgatccacctgcctcggcctactaaagtgctgggattacaggcatgagccatcacgcctggcctgagacagctcatactagctcatcggtcactgggagtgtggagcttgttgtcaatcgtgtgtgtgtgtgtgtgcacgcacgcgcgtgtgcgtgtgtttagagagggggttttgtcatgttgcccaggctggtcttgaactccagggctccagcaatcctcctgccttggcctcccaaagaactgggattacaggtgtgagccacgctcctggcctgttgccaaattgatgatagaaattcctcatggggtctaattaagtgccacagggacagggctaccctgcagccctgtgggctagctcttgcccagccctcactgtaggagtcctctgacctcttccgcctacctcttgcctccttccagtccaacaccagtcttagatttctttcctgaagacacatgcaaccgggcacagtggcatatgcctgtagtcccatctacatgggagaatgaggcaggagaatcccttgagcctaggagttcaaggctgcagtgagctatgatcgtactcctgaactccagcctgggtgacagagagaaaccccatttcaaaaacaaaacacatgtgatgaagactccttacccagctccccctgttcctccagaccagccaacctccatgccaggcccctgcccagaacttcatggcaagctggactggactggcatattctgagttctccagaatttaccatcttacctccttgcccacactgtttcttctgtgtgaatgcccttttcctctcctatgaacacctacgggcatctgccctcagctcctgccacctccctccatgagaacagggattaagactggctatccctcaccaggcgcggtggctcatgcctgtaatcccggcactttgggaggccaaggcaggcagatcacctggggtcaggagttcaagaccagcctgaccaacatggagaaaccctatctctactaaaaatacaaaattagccgggcatggtggcacacgcctgtaatcccagctactcgggaggctgaggcaggaaaattgcttgaacctgggaggcggaggttacggtgaccccaaatcatgccattgcactccagcctgggcaaaaagagtgaaactccatctcaaaaaaaaaaaaaaaaaaaaaaagtccgggcgcggtggctcacacctgtaatcccagcactttgggaggccaaggtgggcggatcacaaagtcaggagatcgagaccatcctgactcacacggggaaaccctgtctttatgaaaaataccaaaaaatcttagcccggcatggtggcaggcgcctgtagtcccagctactggggaggctgaggcaggagaatggcgtgaacccaggaggcggagcttgcagtgagccaagatcgcgccactgcactccagcctgggagacagagcaagagtccgtctcaaaataaataaataaataaataaataaataaataaataaataaataagactggctatcccagagcctggggacaggagagtgtgcgctgcaaagccagccatttgaggagggcctagtctgaactgaataggtcaatgggctggagctgactttggacagagttgaacaaccccaaagaatccagtgggtgctgggcatacagtcgtcaggcctgtgtagacagacctgggccgagaagaagctgggctgcagtagccagggcaaggcagaggggcaggaacaggcatgggcgatggggttgggccccagttctttgacctggggaatcccccaacctatgcttccatatgaatgaatcactgtgcatctgtgggcaccactgcatcagcttgcccctccacacagctgcccttggctcatgttggctgtgctgtatcagtccttcaacgtttcctggggatcagttaattaagttgaggtctctgcgtctggaaatccgcctcagcctgcagggaaaaggcccctagtcttgtttctgccttcagaaccctgagacagaacaaggagaatcctgctgattctcagattgggctccagaggggcgacagtgtcaatcacaatgttagatactgaagttggctcagttctttttttttttttccttccccttctcccctcccgtcccctcctttcctctcccttcccttcccctcccctccccttcctcccttttctttctctttctcttttttttttggcggagtctcactctgccatctcactctgcagtggcgcaacctcggctcactgcaacctctgcctcctgggttcaagcgattctcctgcgtcagcctcctgagtagctgggattacaggtgtgtgccaccacacccagctaatttttgtatttttagtagagatggggtttcatcttgttggccaggctggtcttgaacccctgacctcaagtaatcctcctaccttggtctcccaaaatactgggattacaggtgtgagccactgcacccggccttttttttttttttcttcttttgagacagggtctcactttgtcgcccaggctggatgtagtggcagaatcatggctcactgcagccttgactgcccaggcccaagccatcctcccacctcagcctcccaagtggctgggactacaggcttgcaccaccacaccaaggtgaagtgttgttttgtttgttttttgtagagacagttttgccatgttgcccaggcagtgatcctcctgcttcagcccccacaaagtgttgggatcacaggcgtgagccgctacgcccggccactttcttacctaaaatacctgcacaccctacttggagaccctagggtgaggggagtggggaacaggagaacctgacagtagagggtacatgtaaggaggagagggacaagcttgctgtgtggtggggtgctccagggctgggggtgcctagggatccacctctctcccaggctgtggaattatcctccccgcactcactgcttctctaaccttggctatctcctgctgcctttggggtgtctgatgggcttgagggacctcccagctgctctaggtcatctcaccgcagccatgtgccccatttggtactgtcaaagctgctggaatattatcgtctttccagaactatccctggggcaatatcaggacctcaggctgcccggggctcagagccctcctgggtcttcctggggcccctggtccacatgcatctccactaagcctgagggcccttcgggagaggcagcacttttagcctgcccttggttttagcttttgctctacgaagatcttgtgatttctgccccaccatggggcagcaggaacctcaagcacagtgcctgcggcaaagggagccacaatggacttgccccaggtcaggcctgcacttgccttgtgtcagggtatctccccaagttgctggcctcagtccctacactgacctgtttccccagctttatctctggcaccccaaactcagcagccccgaccccacttcccaagcaccccctgtgcctggctctgtgcctgtcatggtgtcctggcagcagtctgggagagtatttcagttacctgcggtgtcctgggaaggctggagcagaggggtccactcactgattgccaaggtcacagaacaggacttgcattgtgcactggaggccctgtggtcttgcatgagcctggtaggcctctcccctcctgcttccagccctccatctgggaggccagcctgcccagggctgctctgccacttagcagctgtgtggccctggagagtccctaacctcactgaacctcagtttctccgtttgtgaaatggagataatacaaagagaactttccttctcaggctgttgtgatgggtaaggaaataaatgcatgcaaaatcacagctgtagttactatgaggcacactgtcttcctggctagaggagattctgaaggtgggtggggcagcaagatcaccacgtgtatgaaatgggggcaggctggttggagactgagggcaccagccccaagcactgccatctgccctgtgatgggactctcctgtggcagtggcaacggtcccactgtggaagcaacacatgagctgagaggacttgcctgaactgagccacatgtgccctctgggcctggtcaccccaccacctgcccccagtgtgacccatgcagggcctgttcctgaccctgaacgagaccaggactccctgggctgcatttcctatctgtaaaattgtaggagggtggtggtggtgggggctcgaacttgccccctgggtggggtggggcataaatagtcccagaggatggcctgggaaggctggctgggcctggcacaggggactttactgctgtcattattgtcctccttacaggagaggagagcaaggcccagaccggggaggaacccacacagcctctgtgctccagcctgcttgaaagacaaggtctacctacaacgcagagatgcacacattaaggacaatgaaacacccaagtgttaggaaccagaataatcagccctaatagaggggaggctgatcagggagggcctcctggaggaggaggcacaacatcagggtgcactgtgatttctggagacccaaggagttctggtaaatgacaggtgagaaaaagaaaatgtaataaaatataattgaaaacagaccctggtatgtgtggagagagggccgggaggaacctaggacaccggggaacctgaactcccccaaccagtgaagggagctgtgggcagcaaggtttgattggggttttctttcttgtggaggtttctcagagtgattcaagttcccccaccccgcccacagatggttctgagactttggaaagaaagaaaaggaaaaaagaccctgcccgcgccccagctgggcatccctgggaggtcgcgaggatccccggagacccagactcgggcccggggcgcccccggccagagcggcccctggctgcctccctacgccccgcgactccggtccggacgccgagggcctcggcctgcccctgtcccccggccgccccccacctgctccggcccggcggggcggtgctgggcccgcgggctccccggccgcagtgcaaacgcagcgccagacacgccccgcccgcgcctccccgcccccccgcgcccgcggccccaagcggttcccgagcccaggcccgcgccgagcccaggtgagcgcccgccccggggaccctggtccccggaaccccggtccccgcccgccgccccgcctcttcgccccggcgccgggggccagcgcttgcgctcccaagtctcggaccccggcccggcacgttaggggctgggggttggcaagcggggccagaggcactggccggggtccgaagctcacctcgtccttctctcgtcccacaacggccccttcccggctcgccgcggggccccactgtgtgccagtcccccttctcgggctgcaaggtctggcgggggcaacgggacggagccggcgaggctgctggcatcggcttcccagagagagggaactgcacgtgcagaggcggggagagtggacagaggcttgccctgagctccgtgggggaggggagagcgcggagcccccacactcgaaggcaggactgggatcagatgccacccctaggacgcctggaagccactgggagtccgatctgggcaggagcccttgggatgaggcagtgggggcaggtggcgagaggtggaggagtggggagaggaccctgcccagcctgcaccctgggggcgccaggagccctgggagggtcaggtggagcaggggccgctctgtgagatgggagtaatccagtcccgcctcacaggtcctggggtccctgggacagacacagactcctgctgggtggttagcactgggctctgctagaacttttctgcagtgggcagctcatgggcaaggaatagcactcgggcgctctgcactctgggggtccctcctgccctgcccctggcaaggacctttgcctttgagtggggtgactgggctccaagccgatctagcacacagtaggccgaaggcacaggggccccacccagtctccttcctggcccaggccctgggggattcaggtccctgggtactcgggaagggacagcacagcctgggcaggtccccagtggcaagaccaggtctgaccttttctgggatctgtggcccatcaggtgaggcctgaggtcagccaggaaggaagcgggcagggctgaaccagggctgaaaccaggacccaggaagggacagcctagtgcccagggaaggggcaggtggggcaggtggcagttgagttttacagaccttctttgatgacaagtgggggaaagagccaaggcacgccccagtggctgtgggagccaccgcctcctcccctgtaatgggcacctcgaggaccgacaggcgcaggggccaggcaccaagggtccctctccaacctggccttttgtttccaccccttgctctcaggcacccacccacggcccttcctggtatctggaccagaccaggtgggtctcagccccacctcaagtgagacttcaggaagaacttccagaggaaactggaggatggcagtgggatggactgtggggaggtcatttgcaaacaaggcagcttatgcctgtgccctgggccttccaaagtccacctgtaggctgcatcttccggaaggcccaccctgtagcctggaaggcacctggctacagtgatctctctgctgtgcaggtgtcccctcccccagggcaccttgcagggccttagggtgatatgggggctttctgggcccctgcccaccttaaaactgatcaaggtgggagggtggggtgggaggccacagggatgcccctgctgcttgaccttgatgggaccttgaccccttgctttccccatatgctgttgggcatgactgcccacaggcctggtgggcgtttgtgaagggctggagtcgggggtagggggagcttatggctgctgggcacaggcgtggcagggctgtgtgcctggcttccctttcccctaaccccatcaggcccgggctggccgcccacttctgttcaccacagagcagggtttccctggggaccagtggactggcccagccccacaccgccccccagcccctcctggccacagcttgagctgggaggagggtggaggctgggccgcctcctggacccctgccctccctgcccggccttccaaggcccggcagcctcagtccactgctgggcctggaacacggagcagtggctgccctgcgaggaggtgggtgtccggagtgctagccagggtggggctgggctagggggagcctgatgtcacccccattgtaggagggagaagaccaaggatgagaagggctttggcttccccaaggtgaccccctctttgagcctaggcatagtggtctcccgggagaatggagggtcccagagctctcaggctgtgggatttggagaggggaaggggggcacgaggaggcagtagaaatcagggaggatttcctgggcaaggcagccgcggggctggacgatgggcggccgaggttcgggcagaggaactccactggaggagtgagggagctgagcttggagggcttcaaaggggaggtgacctccagggccccacgctctgggatcaggctcacgccatggttcccagctcaaatgtaagactctttccgaagctcccactgtctctctccgtccctctgtgtctctacctgcccacacgccccggtcctgatggctccagtctcccctgcaggtcctagagcagctccagcaggatggcggctccagcgtctctaaggcctgcagggggtccagccccatggggggcgccctaggcctccgacagctccccatctgtgctcctgcctgccggccatcctcaggccactcgccatgggcggctgcttctccaaacccaaaccaggtacctcctgtcttcttgtctccatcctttctcctccctccccgcctcctcctcccccgtctcccccccctccccctctgcactcggtaggcctccgaagtaggtcaggctatccaagaacccgctcggaatgttaatacgctgccgccaggagggggtagggggcctggagcagttcccccagctggcccctgctccagtgggtgcccctttttctttggggctttgagtgttggtggtgggaataacagcaggacccttcttggaaaaggaaagtcagggttcctcctgttgcagggttggggaaggggctatgcccccagggccagggaaggggggagctggggacacgctcagccactctgtgacctagggcatgcaagttacccctctgagcctctgtttttctctctgcaaaagagagggcctggccaccctgacctcttagagttgctgtgagggtgtagtgggcagatcctggctctctttgcctcctctgatcccctgtgtggtctcgggctgccttcttggcctttctgggcacacttccccatttatacaggaaatcaccatccaacctagcctgagctactccagccagaagtgggagtgtcctggggtgctaggggaggcctgggtcttttctccactaaagactcatgtctgcggagctctccctctggccccccactttccctcttctctcctcacaacacctggggaggcaggagtgtgcagctttgtcacaggtggagaaactgaggcttagagagacctcaagagcgcagccagtgctccactcaacctgccaggccacgctgccccagccagctcaccccagccagctcaccccagccagctcaccccagctccccttacctgatacccatcagctccgttaccttggaacttgtgaggcttttctccctttcctgggtctaagggagaacttgggcgagggaggagggctgtgatgacccaccaggcagagggacccacttgcctctgctccaagaagccactcttcctcccccgctcctgtgctgtggacacctaggcctgggctggatccctctctgcctcaaaatgtgccttgggcagatgacgtccattgtctccccctagcagtgggtgggatgatgccagctggcctcataccaggcgtctgtggcaccgctgggctggcaggaggccctggcagaagatgccacctgcaggttcttttaaaggaccccaaatggctggcctgcctgggacccgtggccccaggacttccagtgtcgggggtggccaccctcaccaaaggcagtcctaagaacttaggcaaatccagccctgcccctttctggctgtgtggccttgggcaggtgatttcccctctctgagcctctgcatcctcattgtaaagtggggctgttgtgcctagcatgagggcctggcacaccagaagcacttgcggaattttttttttttgagacagagttcactccttctcccatgctggagtgcagtggcgtgatctcggctcactgcaagctccgcctcccaggttcatgccattctcctgcctcagcctcccaagtagctggaactacaggcgcccgccaccacgcccagctatttttttgtatttttagtagagacggggtttcaccgtgttagccaggatggtctctatctcctgaccttgtgatccgcccatctcggcctcccaaggaatattatttgttatcccttttctgagctgggctctgtgctgccaggcctcccctgtggggctgtagccagaggctcaggccccaggtgcccatgctgggcaggtcaggcatgaggctcagggaatttccagatatgggagtgacagcatttggggcctgagggttcagctggggtcttaaggggccacaaagagactagatcaagcagaagacctctgtgcaaatccttcactttctatcttgctccactcgattctgtggctccgtgtgcatcagcacctgcttcctgggttcccctctgtgctcctgtgtgtcctgtctgagtagttgataagaaggtatcagaccagtccctcacctagctcagagctaggaggaagtgcagctctcttagcatctgttcacctgccttttattaggccataactgatacctaaaggctttccatcctcaccatggctgctaggaggctcagagctaactggtaaaacactgctgcccaactccatctattgagcttctactctgggttacatacagtatttccttcagcattcactgtcaccaacgaggtaggcatttgctgttctctctgttttattttcattttttgagatggggtctcattctgttgcccaggttggagtaaagtcgcataatcatagctcgcagcaacctagaactcctgggctcaagtgatcctcccacctcctgagtagcagggactacaggcctgcaccaccacgactggcaattttatttatttttttaacttttttattttttgagagacaatctcactccctcacccaggctggagtgcaatggcttgatcttggctcactgcaacctccgcctcccaggttcaagcgattctcctgcctcaggctcccaagtagctgggattataagcgcatgccatcatgcctggctaatttttatatttttagtagagactgggttttgccatgttggccaggctggtctcgaactcctgacctcaagtgatctgcctgcctcggcctctcaaagtgctgggattacaggcatgagccatcattcccggccaactggcaatttttaaattttttgtagagactgcatctcaccctgttgcccaggctggtcttgaactcctggactcaagcgatcctcctgccttggcctcccaaagtgttgggattacaggcatgagccaccacacctggccttctctccattttataataaaggcatcttaaggcccaaaggggctaaggcaggtcttatgggcagccagaagtcatggagctggggctgatccagttttgtgggtgagcagagacgcctctcccctctacctttccaaagggcccctgacttaatggcttccattagactgcatcagtgagtgggcttggagccttctgggaggaggtggaggatgagagcagcctggcttggcattatctggcccccctgccaggctatttgtgagctcccacagcttccacagctggtgtcagctaagtccaaagtatttctctttttaattcttccaaaaacattctaacaccattacataaggtatagaaaatggaatgaaagccccacccataaccccccacctgatacgatggcctcagtgtggctctgtgctctgcatcctccctgctgggctggggtcaaggaactgaccttttctttgcccctgtgccctgctatgcctgggcctgagctgagggctgggacttggggctggggaggggacctggccagcgtggaggatttagcagagcatgagatgatggatgggctgggcagccaggagaggcaactcctgagccttgtctgggtagataggaaggatggcagccccagcccaggggacagctcaggcaaaggcctggaggtgcatctcggcagcctctctgggttcttggtttctggagtgtcagttctgaggtggaagggatgagaggtaaaacccagaggtgctggtgccttgggaagtgagagaggtacctcctgctccagcatcgggcccatgctgtgccaggggcttagtgtccatcactcagcttcctccctgcagcagcagcctgggaggccagattattgctgctaaaaattctgtttattgttcccttctaattagaaaaatatcccaggcacatcacagggaatttggaaaatgtgcaaaagtataaagaagaaaatggcaatctctggctcactccccgctagagctggccccgtgggcacgctggggaagtggctctgtatggaggctgtggggggggggggctgtgccccctctgtgccatccacatgcattcccatgctcaggttcacccccagggcacacgaggacactgaaaacccagcacctggttagtgatgaaggattctcaaattggtgagaagagctattttgagaagttgaaatcgggccgggagtggtggcccacgcctgtaatcccagcattttgggaggccgaagcgggtggatcacctgaggtcaggagttcgagaccagcctgaccaacatggagccctgtctctactaaaaatacaaaaattagtcaggtgtggtggcacacgcctgtaatcccagctgctcaagaggttgaggcaggagaatcgcttgaacctgggagggggaagttgcagtgagccaagatcgcaccattgcactccagcctgggcaacaacagcgaaactccatctcaaaaaaaaaaaaaaaagaagaagttgaaattatgctgtgaattatgctgtgtacattttttttaatttttgaaaaaaattcaaatatatgggaaagttgtaagactagaacaatgaacccttgacttcctgtcacccagattcactggctgggaactgagctgctgccacttttgaattcctgtatgtacatgagtcataccctgagatgtcagggacattgtcattgtccatcagaagatgcaggactgtagggcctcagggttctttctgccacagaggtttctgcagccaggagaactgcagggtcgaaggaactcagctctgtgtccccctcactaacactgtaattgaaaaaggaggcggggtgtggtagctcaagcctgtaatcccagcactttgggaggctgaggcgggcagatcacttgaggtcaggagtttgagaccagcctggccaacatggcaaaaccctgtctctaccaaccctgtcacgccacacctctggcgtggtggtatgcacatgaagtcccagctactggggaggctgagatgggagaatcacttgaacccaggaggcagagactgcagcgagccgagattgcatgactgcactacagcttgggcgacagagtgagaccctgtctcaaaaaaaaaaagaaaaaagagacatgcagaaacgaattcaagcagacccgggagcacccccacccatccatgcccctccgctgcttcgtgccaggtttaaggctctttgctgggctggtggtgcagagggaattctggggaggttgccaggcagggctgagcctcctggcaccccgaggagctggcctctgcacccagcttgagggatgggggaggaagttggctgaggtggggggctcaaggcgctgccttgcccacagtggagctcaagatcgaggtggtgctgcctgagaaggagcgaggcaaggaggagctgtcggccagtgggaagggcagcccccgggcctaccagggcaatggcacggcccgccacttccacacggaggagcgcctgtccacccctcacccctaccccagccctcaggattgcgtggaggctgctgtctgccacgtcaaggacctcgagaatggccagtgggttctgggcttgcctgggagcggggatcaggggtcccaaggtgggagggtgagggggccatagccgggggtcggggttggcctgaaggggctatgaccagctgctgccctggtcactgcctttgtggcttctaccggtctgggcctgctccccagaaggctggacactgggaggagctgccaggaggttgtgcctggtgtctggcctgacctctgagtgctgcggttccccaggatgcgggaagtggagctgggctgggggaaggtgttgctggtgaaggacaatggggagttccacgccctgggccataagtgtccgcactacggcgcacccctggtgaaaggtgagctgtcaggtgggaggcgtgagggggaccttccaggccccatgccagcttggctcctccccagaccccaggatcttcatctattagtgaagtctcctgggctgtggggaggggcccgcagttgccggggcactgagatccttgggaagcaacccctgctggtgggcgcagcctaacacctccccttcccaggcgttctgtcccgtggtcgggtgcgctgcccctggcacggcgcctgcttcaacatcagcactggggacctggaggacttccctggcctggacagtctacacaagttccaggtggggccaggagtgcgatggggtgggaacctgggggtgtggggttcggggctggtcctgagcaatgcagcccttgcaggtgaagattgagaaggagaaggtgtacgtccgggccagcaagcaggtgaggggatagctcggggctcaggcagaagggaggagccgggagggcatcttggcccagagaatgccatgtgcaaagccctgtggtgggaggagcttggcacgtgtcactggagcagagtgaggggttgcggtagggatgaggctgggctggagcgccaggacctgcctgccaggatgatggcatgcagaggatggcagtgaccctccaccctcctggcacccacaggccctacagctgcagcgaaggaccaaggtgatggccaagtgtatctctccaagtgctgggtacagcagtagcaccaatgtgctcattgtgggtgcaggttggtagtggggtcatgaggggcagggtgggagatgggattggtgagaagtggttcctggcccacgggcccctcccctcaggtgcagctggcctggtgtgtgcagagacactgcggcaggagggcttctccgaccggatcgtcctgtgcacgctagaccggcaccttccctacgaccgtcccaagctcagcaaggtacagggggtggggcaagtagggaccctatccctctgggtcccagttaagcccacttcaagccttgcttgtcaccccattggggtctggccggctgccctccctgcttatgccaggcctgtccgtggtacccccaaaagatctagatttgttgttgttgttttgagacagggtctcactctgtcgcccaggctgggatgcagtggcgccttctcggctcactgcaacttccacctcctgggttcaagcgattctcatgcttcagccttccgagtagctgggattacaggtgtgcaccaccaccatgcctggctaattttttgtatttttagtagagatggggtttcaccatgttgcccagaccagtcttgaactcctgagctcagcccatccgcccacctcagcctcccaaggtgctaggattacaggtgtgagccactgcacctggcttttctttttttgagacagagtcttgctctgtcactcaggctggagagcagtgcctgtctcacggctcactgcagcgtcgacctccacctcccgggctcaaacgatcctcccacctctgcctcccgggtagctaggactacaggcgcgcaccaccatgcctggctaatattttgtattttttgtagaaatgaggtcatttttgtcatgctgcccaggctggtcttgaactcctggttcaagcgatcctcctgtctcagcctcccaaagtgttgggatcacaggcatgagtcactgcgcctggccagatctgggtttgctgagttctgtcctgcagcccctatgtgactggggctggccccaccttccctgggccccagtgtcttctgctgtaaactggctcctctcaagctggctctcccctgcagtccctggacacacagcctgagcagctggccctgaggcccaaggagtttttccgagcctatggcatcgaggtgctcaccgaggctcaggtacagggtcaagggtgggaaacaggcccgaggagggaaggtgggaaccgtgaggttgtgtgggcccctggggtggggtcttggtgctctaccttcctggccccacagcccaggcacctgggaggtgctccaggcttgggagacagcaaggagctttttcctgatgggtcataggcacacacagagccccacggtgtgtggagatgaacgatcagggctggataggagatactggtgggacttgggagggtaaggagaggtttgaggggaaggtgatgtctgaagcgtaaagaatgaagcccaggtggcaggatctgttttaatgggagcttctcagaggctgtggctgggctgtgggtgtactgcaggaccggggagtgggcggcgaggcccagccccatgcccaagctcatgctctgcctggtggggattgcaggtggtcacagtggacgtgagaactaagaaggtcgtgttcaaggatggcttcaagctggagtacagcaagctgctgctggcaccagggagcaggtgggagggtctcctttttacccatcggacactaggcagggcactggcctggacggggctggggctgccaggaggccctcactgacacggccatgtctcagccccaagactctgagctgcaaaggcaaagaagtggagaacgtgttcactatccggacgccagaggatgccaatcgcgtggtgaggctggcccgaggccgcaacgtggtcgtcgtgggagccggcttcctgggtgagaggtagtgggcagtggagatggtggtcaggtcgtcatggccagtcccagggaagttctggtcgaggaaggtgcaggtgccagcctgccaccccctgcccatcaccagggatggaggtggccgcttacctgacggagaaggcccactctgtgtctgtggtggagctggaggagacgcccttcaggaggttcctgggggagcgcgtgggtcgagccctcatgaaggtgagcccaccccagcacccagtgccttggagccctggggcccagcccggcccctggctgggctctcatccaccgcccacctgcccacttgccctgacagatgtttgagaacaaccgggtgaagttctacatgcagacggaggtgtctgagctgcggggccaggagggaaaggtgggcccttctcccttctccctgctgctttctgtcctctgtcccctgagcctgggagctgggtccacctgtttatccacccactccccacagctgaaggaggttgtgctgaagagcagcaaggtcgtgcgggctgacgtctgcgtggtgggcattggtgagttggtgtgtgggcaggcaggcacaaagcagcccagccgtctgcacatgctcacatgtgaccttgggctagtcccttcccctcccagagcctcagtttccaccacatctgtcaaatgggaacccccaaccgcccccactttacggagctgttggggaaggtatgtactgggctcagcccaggcctggcacagtggatgctcccagtgcccgctgcccagtaacactcatctccatgccctgcgagagttgacatagacgagactcgaactggcttctgctccagctgaagtgccaatttgggtaggggccaagatgggaggtggtagcacctgcaggggctgaggaggtatggcatgctgtccctccacttaagggcctcatggagcacttcttggagaaggtgatatctgaggtcttgcgggaggcaccgggtctgtgggagaccgggtagtggggaccagggtgcatgaaggcctcaggtagacagcccctggaggatcagtctggggctggcacatcaagcgcatgctgtagggtgtggagagtgactacgcagaaggcagggacaggggagtggacacaggcttccgtcctgtcaggtgcagtgcccgccacaggcttcctgaggcaaagcggcatcggtttggattcccgaggcttcatccctgtcaacaaggtggggtggatggcactgggtggggaggacccggtgctgggctgggagtggcaggaggttcaggtcagggcccctgtcacacccatggagctctgggccctctctctacagatgatgcagaccaatgtcccaggcgtgtttgcagctggcgatgctgtcaccttcccccttgcctggaggaacaaccgcaaagtgaacattccacattggcagatggctcatgctcagggtatggccagtcccgaggcacatggaggggtgggagggagtctcagggtctcagtgtccccatgcccatgcctcagttgctgaccttgggtcctggacactgttaggcatcaaagctctgatgtggattctctggccagcctcatctcggcgatccagccaacacagagagcgacaccccactgagccagccatagctcctcaatctcagttttccttctggtagtctctcccttttttgtcttcaaggacatatattctgcagaattcctgatcaacctgtgcattaccctggggagggagggagggatttagtggatcaccttcccatttatgcctctgtttcccttgggccactcaagtatctctgtgaactcagttcagcctcatgcaggtccccgaggtgccatctgagcccagagacgtgggctcagtggaggcactgtgctttctgaggaatagctttcccctcctgatgtttgctggccaccaagtcccccaagcctcatccactgtgcacatctggtctgggcccctaagctgcaggtgccatcacattagttgcctcactgcctcagagagaggactgccagactcccagcctgggacaaaggacttctctgcacccatctcccctttcctctgcctttacacctgagggtctgctgcttgaaaccccacttctggtaccaatttctattcaagtccaaagtcgaaagttgttgctaggttgtaagtaaccaaggcaacttatcagccaagtataattaggatttaactgagagagtttaggggactttgaagtacatccaactacaggggtctactggggcctcataggaactggggagccatccacactggtctctttggggccttgtgtgtggctgtcatctgtgcttccctgtgtacttgtgccccattttcctccctcttcagacctgatacgtctgattaggtgtctgtgtgcacagctgaaatggtggcgtactcccccaaccccaagaagcagaccttccagagtcagggcactttattcagattctttaaggaagcaatcaagtggctagctttgaggcaggtgttcccctgcaccagtcagctgcaggtgcaagtgagcagtgggctgaacaatgatgtctcttgacctctggggagaccaggaggagtagccacacgtgtcaggggtccccagggcatcaggagcaggtagtgtgggagtggtaagagcgagagttagggttctcacggccctgggtcccgcagggcgcgtggcagcccagaacatgttggcgcaggaggcggagatgagcactgtgccctacctctggaccgccatgtttggcaagagcctgcgctacgcgggtaaccccggggcctcggatgggggcggggccgagggcgtttaggggcggggcttgggtgtggggcggggctgggagcctaggggcagggctatgaccgcactaggaagaggccggtaagaactcgctggcggcaaggctacgaactacctaaaaggacgtatggagcagggcctgggcggggttaggaggggatcctgtgacgtctcgttccctcccccggctcacgtgggtgccacccacctgcccggcccacaggctacggagaaggcttcgacgacgtcatcatccagggggatctggaggagctgaagtttgtggctttttacactaagtgagagcaccggggtgcagcttggcgcgaagcagcgggagctcagtcgggaagggggattcatcccaggcaaaatcccagaacaagagcccagccctgagccccgctgaggagtgctggagcttccttaggaaagcccgaagcttgtgcacggtcaagccgcgatgtgcaaagcagggagggctgggtgctcaggccattcttgttgccctggggtaggtccttccctgggccccagatggacagcagtgcatcagggttttcaaaaaggggctgctgcctcgcagtcctcaggcttggccatcctctccttgcagaggcgacgaggtgatcgccgtggccagcatgaactacgatcccattgtgtccaaggtcgctgaggtgctggcctcaggccgtgccatccggaagcgggaggtggagtgagtgtgggtgtgggaagcctgggggtgggagtagttccctggagtactggctaaggtgcctatgacagccagccgcccccacaaccctccagggcctttcccctcttggtttgcatcgcctgaggcttacaggactacagggaggtgtggggcaaggatcatggtttgagagcaggctggttatgtgttcatggtggatggaagggatagagatgtgtgtcaccaggcagggccagtgctgtgggaaggggtcagggcccaatgcatgggcaatcaccaggcgtgggacacctaactggacatagttgtgctgagcctggcagaagctaggtgggaaatgcagctactgatgccctgggtatgccctccacatagatggtgggggtggttctaggtttcactcaacaccagccagttcccttatcctggtgtggtgtcaatgagattcaccctctgggagagagctcccagggactggggacagcctggaggccactgggaggctatgagacaggggcaggcttcaggctggaaacaatggaggaccagaaggggacatgataaatgacatgctctctccttggccttctctccgtttctctctcttgccttcgtgaaggctgtttgtgctgcacagcaagtacgtgtgtccttcatgttgaccgttctgagcctttcccatgtcagcccagaccctccacccaatggtcttatctccctctgtccaagtacacctccctgctgggcactagggtctggcacagaacagaccccctgctgtcctcaagggccagctgttcagggtgcccagagtggagagcctgttttcttctgtcttgacccctcctcccctcactcctgcaggactggcgacatgtcctggcttacggggaaaggatcctgagctcacatgcagtagacttgggcaggcaaagggggcaccaagggcacaggccaagccttgggggcaggtgccaatctccagtcccaggatcccccagggcagaacctgagccctcccagtgcttgccttcagccacctggctcccctcctgggaggcctctgctggatccagaagatgctcaaccctcaaggcctctgctgccactgacagctggcactggaggcaggacaagccctgcctcttctccctctattgggactggtcccctgaagaaccctgcaacacgttaaacattaccgtaaaattaaaacgcacaaatttgcagatctgtatgactcccagtgtaattgggccaataggcacaggaccagaccacagggaaacaggcacaatcacagaatgccaggtgccacaccaaggaaatttggcctgtgaacgcccagaggaggtagcaactaattctgcgccccaagccctcccacatccctctccccctctgcgatcagcgaacgctttttgcttttggctctgagttttgaaggaagggtattccaggtagaagggacaacatgcccaaaggtcttgagatagtaaatgctccttcagaggtggctcatgcttgacactttggggcatttgcccacttagggctgtgggagctgtgtcctgagacagaccccatgcttttcatagccggagcattctcaatccccatgtcggaggtgaaggagctgaggccctgctaagtaggaatgagaatccagaggctcctcgccgggctgcctctcagtcagtaagaaagccaaggggagaggggagttgctgggggtcagggctgagggcgctagcaggaaagggagcgttgagccgcctgcagaggccgctgcgagcccggaaccctccatgggggatcccggcagcggcagacgatccaggccggagccacgcgcagacccagggcatgccgggaactgcgagccggccgcgggtcttcgggctgcgtgggcctgggaggcgccgggaagagcagtcgcgacggggctagggacgacacactgcattcactggaagggacaacgcagcgccagtacatagcctgaaacgctccccagaaggtcccacgctcgccgcgcggtcgacaaccgcatcctgcgctcgcccgcggtgtctcggcaagcggtaggcttgtcgggaagagctggagggcgcaagtgcggcgctggccggacgtgccgcaccgtcagcgcagggctcgccgggaaatgtggtttctccagccggcccggggcggtggccgcaagttgggcttacagcgcggccgatccggcgtggacccgggatggctggaccgggcagcacgggggggcagatcggggctgcggccctggcaggcggcgcgcggtccaaggtagccccgagcgtggacttcgaccatagctgctcggacagtgtcgagtacctgacgctcaacttcgggcccttcgaaacagtgcatcgctggcggcgcctcccgccctgcgacgagttcgtgggtgcccggtacggtgggcttcatggggtcctgaggacaggaagggcgatctgcgagggtcccagggcgggtccaggggcgaagccggggggtggtgtcctggggtaggatctggtaatgaggtggatggtgctgtacaggacgctgttcagggcaggggagagggttccgagggagtcccagagcccgatgtcccgggacagggtactggaactaagttgtgtttgtggatattgggctggggtcccaggtgctctgaggtggggtgaggagtccagagagtcctggagccgtgtcaggggtcctcacttgcaggatgattggtgttatcttagaagatgatggatcttagcagttgagaggtgatacctaacttccgtggcagctctcctgcttagtcccattccttgggtgccccccaggagggtcctgtccttaccgccctccactcctttctttccaggcgcagcaagcacacagtggtggcctataaagatgccatttatgtatttggtggagacaatgggtgagtgagtctcagcatcagtgtttggaccaggtacggagaagtactgtggtcagggactgggcctgtccagctccattactgtcctttcagatgctagctggtgcctctaagcttcagtttccccatctgtgagattccttgcactcacctccctggtcgtggtgaggattaaatgagatcctgcactcatggtcctcagcacagcttccagtgggtggcacatgctcagtatgtggaaatgtccctcttctgagtagatgcagccttgaaagaaacacaaccacccttgcggccagccctgccaggcacttttctttccctgtgcctcatcggtatggaggacacagttttatttatttcatgcatttttcactttttgtgggggttttcccaaattgctccaaacatcaggcaacaacgtgatgttttgttggtgggcacacctcctttcacataaactgtctccacttaagttgtggctggtttccttatgcagagggtggagtatttgcacatgactagttgtgtccatgtgtcctagccctgcctctcagccccaggaactagcatgaagccctggaaggtctggcctcttactggctctgcagccttggtcctgtaggcctccttggggggcgggcttgaggatggtggggtagtctggaccccaccaggatctgcatactgggcagaagagcctccttgggcatggtcccctggcttcaagcctgtcttcctcccactctctttccccaggagtagccggtggggcccatttacaaaagcaagtcagagtatgctcctccttggctcatcctcctgtaatgcctccctgcctctctgagtaaaagcccaagtcctcatgagagtctgctgctcctctgccctcagtccctcactgcactggggcggcacgggctgccttgctatgtttggattgtaccaagtgcccccctgctcaggcccttgcactgcccattctctcctctcaccttcctgcccctcctctgatgtttcttgtgactgaggccttacttggccatctggaccaactggagaccattgcttcccctccatacctcttaccatcttcatttgttcctgaggcacacagatgttggttattatccatctcttcagtcaaggcagggcctgtgctccttttaccattgtatcctggcatctagaaaactccataaatgtttgtcaaatgaaggaatgaaatgaagaagagatgcctacccacaagcatttactgcagccttaatgagaaccctccaaaccagaaagggctttagtgtccagtacaaggcagcaagtgggaaatgggggaccttcatcctcaagagtgtccttagcaggtagtttgtgtgacaactgtgtagcaataagcagaaacatttttgctgcagtatgacaaagaaataggatacaaatttgtctcacactagtcttaactttataaagactgcctgagtacaaagaaagatggcctcctgcggcacgtggggcaagtaaggagggggggggggcggtatcacaatcaccaccagcttctaggctcctggcttcctggctgcatggcctcagacacagcctttgagccactaggctttgttgccatctgtgaaatggaggtgagagagcacccactggtgcagactaagtgagaccgttcagggggcacccagcacaggctgggcatgacggggcactgggctcctgtcagtttgcccttcttcccaagggctgggtagtgatatgccagctggtagtgttaggtggtgcaatggccagtgaatttgttttctatttgattgtatggcttttgcaacaaagaaatggcaggggccaggtgcagtggctcacacctgtaatcccagcactttgggaggctgaggtgggaagatcacttgaggccaggcattcaagacgagcctgggcaggaaagcaagacttcgtttctatttttttttttttttttttgagatggagtcttgctctgtcacccaggctggtgttcagtggcgccatcttggctcactgcaacctctgcctcccgggttcaagcgattctgccgcagcctcccgagtagctgggattacaggcgcctgccaccatgccaggctaatttttttgtatttttagtagagatggggtttcaccatgttggccaggctggtctcaatctcctgacctcaagtgatccgcccgcctaggcttcccaaagtgctgggattacaggcgtgagccaccgagcccagcccattgtctctatttcttttttttaagaagtggcaggaagatcagagagaagcaaagggcctctcctgaggcacgggcaagcacttgcattgcagggtacagctgcagaggaaggggattgggacgtgtgaataggggttctggaggctagggtgaggtgtgagggtgactctggcctttgggccatttcatgccttcatgtcagctgctggttgggctcctggtggccacattcatgctttggtcctgaccccaggcaggctggtgtctgcctgtgtggcagccctggtgcccatatcagttggggagcctcctttgtggtcaccactcttgttcttgggcatcagctggttgcctggctgtgttagtgacccagcccacaacagccccctactctaccctggctacatgcagtgcccatctctggggtcactgcagagtagacctggctaatgccaccctctcttccggctgcctttcaggaagaccatgctcaatgacctcctgcggttcgatgtgaaagactgctcctggtgcaggtgggtggccccgtgctccagggccctgcctttcctcctagaacacagtggcacagtgctgggtcccagttgctagcagagtctctctcatcatgggaagctagaaagaagcttccaggaggagataaccacggcctcagggatgccacatccagagccgccctgtcaggctgaggagatcaagtaaccaccccgcacctgcagctgccaagctgggcacacagggcggcacccttctgggctgtccacctctacctcgaggctgatgctagtatgggtacagaagttgctatgtcttttctctcacacttgattttgtaagatggctagtagttacaaattaatttaaaaaatcattctgaaggcttcacaattatttgtcaaaaattgcttaagtataaaactcagaaaaaagctaggagttcaagaccagctgggcaacaaagtgagaccctgtctaggaagatagatagacagatgatagatagatagatagatagatagatagatagatagatagaaagaaagatagatagatgatagaaagacaaagagagatgatagatagatgataggtagattagacagatagatgacagatagatagatagtggatagatgatagatgacagatcgatagatagatgataggtagatgataggtaggtagattagatagatgatgggtagatagatgacagacaatagatgatagatgataggtagatagatgatagatgacagatagatgatggatagattatataggtagatgataggtggatagatgatggatatatagattatatagattagatgattgatagatgataggtagatagatagatgatggttagatagataggtattaaatgaaattgatggaccccgtgctgtaagatgctgcactgctgctgagagcaggagtgtggatggtcctggagtagcatgaggacctggtcacattctgtgagtggaataagcaatttacaaaatatctgccacttgattccattttaaaaaatttcatggaagcctaagtatgcgtaggagaggtgtgcagggaagacctcaaggtgttgccagaggttttctggtaatgggaatttgcatgagctttagtgcctattttgttttttccttattggtgattttttttttttaagtttctatgatgagacaggtatcaccttcaaaatacaaaagtgaaacgtagctgggcgcggtggctcacgcctgtaatcccagcactttgggaggctgaggtgggcggatcacctgaggtcagaacttcaagaccagcctggccaacatggtgaaaccccgtctctacaaaaatacaaaaaattagctgggcatgatggtgggtgcctgtaatcccagctactcaggaggctgaggcaggacaatcgcttgaacccaggaggtggaggttgagccgggatcgtgccactgcactccagccgggacgacagagagagactccgtctcaaaaaaaaaaaaaaagaaaaaagaaaggcagcacagggatgcagggccaccctgtgggggtgtggacctcatgggtgacccccgctgactctcaccacccctgtgcccaccccagggcctttaccactgggaccccaccggccccccgttaccaccactcggccgtcgtctatgggagcagcatgtttgtctttggtaagcagcctcttgcctcccaggggctgtgtcgccccgaggcccacagacaccctgcccttctgcaggcctggggcatttgtgctcgtgctgtgtacagcaggggctctctctccacccgtggctttgtctgccagtcttcggaattctgcgctggatctgggaccccttgccctaacggccctgagctcacagggttgggtgtctttctgtgttactgagctgtggctgggaacagtgtcctgctcatctctgtgtccccagagcccagcacagaggcagacaggcagcaggtcgttccggggcttgtggaaggagtcctggcttatgcattttcaggggggccagattctgctccaccttccagggtttgaaatctccaagactgccctttgggtttgacagtttctcactctctttactcagggggttacactggggacatttattccaattctaacttgaagaataaaaacgacctctttgaatacaagtttgcaactggccagtggacggagtggaaaattgaaggacggtgagaaactttgcagaaacatttgggacaggctgggtcctgggtggcattggacctgggatctgcccccttttgcctcccagatgaggaccctgagggcacgcaatagcagggagcttgggattggtggaatatcccccggtgcagctatgcatggcctgctcccagcccttagactccctcctttcagaagagacccaaatggaccaggcgtggtggcgcatgcctgtagtcctagtactttgggaagccgaggtgggaagatcacttgagcccatgacttcaaggctgcagtgaaccatgtgtgccccactgcactccagcctgggagacagaacaagaccttgtcacaaaaaaatgttcaataagatccaatgtactgctgatggcgcttctggggtcccgctttttgagcaccccctttgatattttgggggcacctaggagaaggttctgtgcctctgtggctgtctgaattcctcttcaagccactagtcggcctctggggctgttgtttattcctagtgccttgtggaggtcctgaagccccagtgtcgggtggatgtagccatgcagcctggctgtggcccctgcactgaccacatggggctgggtggctcaggtctgtgctgggcggcctcactccctcccctcttccctcacactccaggttgccagtcgctaggtcagcccatggggccacggtgtacagtgacaagctgtggatctttgctggctatgacggcaacgccaggtgggtggtggtccggcctgtgcaccccacctccgacagcactgagacccggagcaggccgtcctggcatttgagggcttaggctgggaggattttgagtgcctggtggattttgagtgccactctgtctgggggtttcttgggagggggatggggaaagaggaggatggacagatggaggtgagggccactgggtggagccccgtggctaccagagtagcttggatgaggatcctcagccaggagttgccctgcggagctgagttggtgggcgggtgggcggtgcccaggctcaggcccagccctggttcttgcccaggccaaaggccttttcctccttattttagaaagttggctttgctctctttttctgatcacaaaagtagcatatgctggtttcccaaaacttcagcatcatagaaactcctaacgatgcagtgatggtggcatctgggatatctgtgtcctctccccacccaggagggacactgagtgaggagctggcactgccacactgccctgatgtcatgcatgagagtacttgttctgtctgggccgggcagggggcctggcacagcagggatttgaggcagtggctgccaccccacacagaagttcccgcctcatggccgcacaagtctcctaccctgtgtgggggtggggctcctccctgcagccatcccttccagccaggactaggcccaccctgaccaccagacccaaggggtcctcactggtctgtcctaatacaggttgaatgacatgtggacaattggcctccaggaccgagagctcacctgctgggaggaggtgaggggcgtggggagccagggcgcaggtagaggaggtgaggggcacggggagccagggcgcaggtggaggaggtgaggggcatggggagacagggtgcaggtggagggaggtgggaggcagggggagccaggctgggggtcgaggctgctttcttccccttgcaaagcccagcctcgacctgagcctcgctctcctccctggtgacctgcgggccttcacgaccagttcctcactgtggctgcacagtgattcgaggtttggtgctttggatgggcagagtgccacgtgtgtgaggatgtggttttgctttaacgcaccctttatttcagtgcagtgagggccgtctgctatccagtgtcctgctccctggagctccccctgggcttgctttcccctttagaaacatggaatttatttatttattcattaaaaaaaattgtttttcagtcttctgggcatgaaaaacatgagtttagcccctgatgatttaaccctgacgattttaaccccagctgttcacaactgggccccgtgaagtggatgagacagggctatgagctgttccaagacaaaggaatctgtgaatcctcatctggggaagtttcaagaataaaagcagtcccatctcagcagtctcgagtgtggtgaaatgtgagcgggccctgtgaggccggggctgagctgtcctctccccctgcaggtggcccagagtggcgagatccccccatcttgctgcaacttccccgtggctgtgtgccgggacaagatgtttgtattctctgggcaaagcggagccaaaataaccaacaacctcttccagtttgaattcaaggacaagacgtgagtactctggccagtggggtggagggaggacggtcagttccctcgaatccttctgaatatgaagaacgcctcttgcacctggtggccatggtaaccatccttgtgagctctgcaaacagcaggaggttacagcccggagcagggatgtgcggtgcccctggcaggtccccaggatatggctacagcttagcaagataaggcctggcgaggaggcccctggctaggcctccctctgaacgtgaaggacgtccccttcctcgtgaatagcttggtcagtgccaccagtaacagacgtggcctgcatagatctcaaataatggcagaagaccagaggggcctgcaggtcctgagaggtctggcccatgctgcccctggctgctggccagcccttgatccctgcaatggggctgcaggagagggcacaaggagtgtgagctgcaggtacagggggtttgggaagggacttgggagcttccctggaggccacgggtgcgtgggaggaagggcagggagccccaggatgagggaaattgtcaagggcctggggctcagcatggagccagatggcatagccctgccaggccaggatctgttctgaagtcttcagctaacttagcaaaagagaggacttgctgggaggtactgggaagcctgggaggtggaaggtgctggggcagcatcaggatgtggggtacaggcagctcccaggatggggactcagctgtggggatgctctgactgggcagcgtgaacacagtgacctgcaatggtctctgcacaactttactccccagagagcaggactgcctgggcgggtcagatgccaccctcctgcccatcactgctgcctgctccatggggagaggggggagctctggcaggaccctgcggtgggccacatggagccaggcagggctggtgcccgtgctggatggggtgagaggtgctcagcgcaggtgtctaggccctccctctggaccctgggctagtcaccgtaagggatgcagggggacctcccagtgaaggcctgctgtggggaggccccgagggtgagcaggagcccctgtcccagcattgattcactgttgtgtacccccaggtggacacgcatcccaactgaacacctgctccggggctccccaccacccccgcagcggcgctacgggcataccatggtggcctttgaccgccacctctatgtgtttgggggtgcggccgacaacacgctgcccaacgagctgcactgctatgacgtggacttccagacctgggaggtcgtccagcccagctccgacagcgaggtgagggtgcccaggggtgtcctgacctgccagctggacaccagtagctcctaccctgctcccacccagctcctcacagctttggggccccctggggttccagacagctaccaggagcaaggccaggacacctgggcctcagccctggacacctgccccggcctccagccccagcttcaccccacagcctgcaggtagttaacgcttcacaccccatcatggctgcatggggctgctgtgctgcagacctttcctgggaagcccacggccatgcagctcttccttctttcagaacccactctcaaggccaggatggtgggggtctctgggcacctacctggcccttgccaactggtctcatgcccatgtgtctcccctcttcaggttggtggggctgaagtgcccgagcgagcctgtgcttccgaggaggtgcccaccctgacctatgaggagcgggttggcttcaagaagtcccgagatgtgtttggcctggactttggcaccacctcagccaagcagcccacccagcctgcctcggaggtacaggctgggatcctcattaagactccatcaccccctgaaacaggtcctgtgatcaacacctctcacacatggggagactgaggccccgagaaatacttgcttggggtcacaccacaaagggggtacagggccaagggccctcaccctgctggccaggctgcagctttctggggtgggtgccacacactggcccaagtgccctgaccactctgagggtctccatggcccgtcatgccccactcgcctacatgggtaccaggtcccacctgtgtctgtacccaggggccctcatcccttggggaccctgccccctggcccttcatggccatgaggtgccgcatccttgccttacctggctgcaccagccgcactgtggaggctctgctcccccaccattccaccctgccttcttgtcccccagctgcccagtgggaggctcttccacgcggctgctgtcatctcggacgccatgtacatcttcgggggcacggtggacaacaacatccgcagcggggagatgtacaggttccaggtgtggggcctgtgggcctgtagagccggctgggtggacggatcccccgtgatgagaaactgaggccaagttggggggcagggcttatccaggccattgccagggccacacctggcaggatggaagccttgggaggagccctgtgggctgagggtgggctgaggtggcactaaagtgggcagccttcgtgcagtggggcaggcagatggtgctggggctcacggcagagtcagtggagggagccgggccaagctgggctcagcaccagagcctcacaggcatcatagcctggcccagggcagagccagggccgacagtggcttgcgttgacagccccttcccaggcctggaggagcaggtggtcagggcagggactcacagccacagtgaggtcagggccagcttcctggaggaggttgggatgtgctggtgggggccagtgtgaggacgcaggtccaggcagagtggagacggcagagctctgctgaggcctggggcccagccgaaggcaagagaggcaggggagccctttcctgctgtggagccggccgtggacagttgcaggtgctgaggctggagccaggctgtattttcagggtggggtagcggctgcttcctctcctcagccaggcccacctgcctcctgggccctgagggtcagcatgggccaggtggggacctcagggtcggcctgcacagccacactggggccaccctgctgtctgcaacatctagtctcactgggcccctcttgcagttctcctgttaccctaaatgcacgctgcacgaggactacgggcggctgtgggagagccgccagttctgcgacgtggagttcgtgctgggtgaggtgggtgcctgtcctcgcaccctgctctgcctgctgtgcctgggcagtgggaatttcgcccctcagaaaaacagctgctggcctggtggtgctgaccttggctggctgggtctctgttctctggggcgagggtcctgtgccctctgccagtgcatcattctttgtgcagaaggaggagtgcgtgcagggccacgtagccattgtcacagcgcggagccgctggcttcgcaggaagatcacgcaggcgcgggagaggctggcccaggtgaggtgcctaaccgccctgccctgacctggcagccatgcctggtgtccactggggtgtccttgagctcccttctccccacagaagctggagcaggaggccgccccagttcccagggaggcccccggcgtggctgctggtggggcccggccgcccctgctgcacgtggccatccgggaggccgaggcccggcccttcgaggtgctcatgcagttcctctacaccgacaagatcaaatacccacggaaaggtccgcctgggtgggggtggagcagggttggtgtgggctggggtgcgggcagcagagccaaaaggtgggtgctgccagccctgccttactgatgggccccctgaggctcagaggctgcaggtcaccctccttacccatgatcactgcagctggacgccatctgagtcccccgaggccttgttcctacctagtggccccagcccacactcttccatggggggagccctgcgccctgtgccctgccctcccctctccggctccctgagattcgggggctctggggcgcaggccatgtggaggatgtgctgctcatcatggatgtgtacaaactggcactgagcttccagttgtgccgcctggagcagctgtgccgccagtacatcgaggcctccgtggacctgcagaacgtgctggttgtgtgcgagagtgccgcccggctgcagctgagccaactcaaggtgtggggtggggtcagcgcaatcagggttgggtggggtgtgctcaggcttaggccccctccctgcccaccactgtgagcccctcgcccagcctggggccctggcttgactctgcctgcctgcctgtgcctgtctgccccaggagcactgcctgaacttcgtggtaaaggagtcccacttcaaccaggtgatcatgatgaaggagttcgagcgcctctcctctccactgatagtggagattgtgcggcggaagcagcagccgccccctcgcactcccttggaccagccagtggacattggtagggagccccgttccccttccctgggggctgggagggatggtgttcatctgcggtaggagattgggagccatggagagcacctgccaggccctcggggtgggggtgggtgccatgggaccccagagtgctctcctgggtacagggaggaaacagatgaaggcagaagcccccgacccatggggcttgccacagtgggctgtgtcctggtgacctgggatttcctgagccaatttctgggggtggacatggggcacctctttcgggctaggatgtcaggtctgatggcccagggtcacggtgatcagtctctggacttctctttgcttgtaatgtcacaggccccttcattcccccagctctccctggggcttgtgctgaccccggttgctggctcttggtgatgtctgcaggcaccagaggccatgcagtgggcctggagggggcttgatcatgaggtcagcgagggggtacagcaagctgggtggaagatgagacgctgggtggtgggctgtgcgtggggcatagtgcttgagtcggccagggcgccgagggaggacagaatgtggctgatggtacctcagggcgagtgaggccttctgcctgggtgaagttttgttcagggcagcaacatgggcagatatgcaggaaggtagtgccgtggggccccaaggccagaatcccaggctgtacctgctcagggaccctcctacccccaggcacatctctgatccaggacatgaaggcatacctggagggagcgggcgcggaattctgtgacatcactctgttgcttgacgggcacccacggccagcccacaaggctatcctggccgcccgctccaggtgggtgggggctggacaggaggggagggtgggcctggatggtgtcttcgttctgctgacggccaggtgcctaccgctcgttgtctgcagctactttgaagccatgttccggtccttcatgcccgaagatgggcaggtgaacatctccatcggggagatggtgcccagcaggcaggccttcgagtccatgctgcgctacatctactacggcgaggtcaacatgccgcccgaggactcgctgcatcctcactccccagtgaactcccaggtccccaccaaggggtcctggcacccacctcaggtggctttgaggcccgctctcctgccccagctaggtgatctgggcccagcgcctccctccagagggtttgctggtgcctggggctgggcctggtgctctctgaagcagttggcagctggcaaggaggggtttgcagccaggaggaaccagtgggttcctgaccctcacaactgcccagaggacggggtgggtcattgctttgtgtgacagttgagcacagacatggaggtactccttatgtcacttcagtaggggtctgaacatggagggtcaggatgcctgttaggcctgcaaggccatggaacagcgctacagatgtacagacactatttttctcgggaggggattcatggttttctttggatcctgaatggggcctttgacccactaagtagttcagaatccatttggagagcatgctggcgtgggggcttggggctccagctgcgcccttccctgtccttccctgggagggtgcgggcggaccagcttcctttagtcagctccttaaccaggccccagctacttgtttgcggccccctactactacggcttctacaacaaccggctgcaggcgtactgcaagcagaacctggagatgaacgtgacggtgcagaacgtgctgcaggtagccccccagccccgtgcacatggctgcagctcccactgagtgggtgaaaggggcagcgcctcaaggtccctgccattgcagatcctggaggcagctgacaaaacgcaggcactggacatgaagcggcactgcctgcacatcattgtgcaccagttcaccaaggtcagggctctggcctccccttcaggactcgcttccccttggcagtggccatgcccaggcagggagggtgcccaggctctgtggtcccctgcagtggtgggccctgggggtgagagaagcagagcagcccatcactggccgcaccttgcttcatccttgggaccagcctgagccctgagcagggtaggccccacagggctccactgcccaccatggcccttaggtggatctggtcccatctccttccggcctgcttgccttacaggtctccaagttgcccaccctgcggtcgctgagccagcagctgctgctggacatcatagactccctggcctcccacatctcagacaagcagtgcgcagagctgggcgccgacatctgaggccctgtggcgcctgcccattgtgaagaatcgccgtgcctgcctgccctgcctactgagaagactaccggctatgcgcatgcctatggcagtgggtgcacctgccaggccaagggtcagggtgcccagagcctccaaagagagctgaggggatgtggggccccaaactcattaattcactgaagacacaggtcccacagggagcggatgatgaagcagaccccctcctgtcatcaccctctcctggtgtagtgtggatgcgaggccacggctcagtgatgggctcaccacccagaagtggggagagactttgggcctcccacccagtggggcttggcctggcttctgtggcctgggcgtgttgtggactcaggcactggggcctgtcaccaaggctcctccaacatgcgggaggaggcttagcagacttgcgctgcaccagcgaatctgcctgggctgctcctgtcccacccaccctcactgagatccatgtaaggggctcctcttcccacctggaacttgtgagtggggacccatgatgtatgggtctcacctgacttgaggtgaattttggagtgaagggccctgaggtcagctcccaggtcggtcgtgctgggccaggcctggttttcacaggggctgaaggatcccagtccacctgtgtgcatgtcagggctcggccgggaagaagccagcaaagtcccccgtgtcccttgctgagtattctgtcacagacaagcctccattaaagccacagcagtgctacccaccacacacaccttgctggcccggccaccactgctggcttcagccccttgagcagcccatggcttagcagacccccagatgtaggtcagtggccttacctgtctctatccatgctgtcaactcctgcctccacctggggtcacccagtcacattgggaagggctgtgaaggcctccaggctggccccttccaggggaatcctggaggcctggggtgggctcctgccccttctgccctgccttgcccctgcactatgctcttggctcctgtggaaggagggctgccctcttgccctagtgagggccccatgtggatccactctagtgctgggagccagcgctcccttactgggaacaggattccaggacccctttcttgttgtggctgccatgaagccacagctccttggggaagtgacctgctctcctttgggtgtatgcaggtgtgtggggggccctgagtggcaagttgcttagctaacaggagatccataggcagcctgcaggctaggaagtggcctagtgcaagatgagctgggaacaagggaggagagagcaggagctggggcagaggctgagccgggaggcccttgaggtgaggacacagcaggcccaggaccatggctggggaggatatgtcagcacctggaagtggagtgcaggctgcagcgcccagccatgtgggccaggtgcattcactcagagtggggccacacacccatctacccagtttccacaagatgtggctcctgccacacccacagggcagcctcctccaaatccctcctggaggggcctacccagaagcctccttgaaccagtctgcaaccctgctctatgctgacccttgtcactgaaccctgatctagacttatatgaataaatgaaattacatgccaagggccctaaaaagcaaattttacgaaattgtgtggcagtttctgggactagaatgaatttcatttgtgctcctcggcagggagaggccatacttgcagtgagtcaccccaagacggagctgtttgagaactgcagctgcagcaaggccttccaggttcctgggagttgaaggaaaaggatgctgaggccaggacctgagtgcttgtctccatgttctggccacctcttcctagatttccagggactagcttgttggggctttactacctgctgacatgacccaggaggttgatgattgtcatcatcatccccgtttttcaaatagagatggtagtgaagggggcggggagagggttgtccagcttacccaccaggctgatggggcctgtggacagaagcctgtcatgctcctgcttgagaaccggatctagactgggttttagaagtgttctcaaaggggctggctggtttaagtcagggctgtttcagatcctatggaaagggcgcctggagctgtcttcctggcccctactcacaccatcctgccccttcagagaaccctgtggggcacggagctgcgctagcagggctgactgccacctgtctaccagtagctctgaggggtgagagccaggctccctgttctccttggcaaagagcttggactgagccctctaggagctgcagccactgtctggggcagcaagcttagtactcagaggggctccagcccccagctgagccagacagcaggccctccgtctagaatccgctttattatggcacctggtgggtctggtgggatctgagggaggaagaggctgcagtcttgctgggcagcccctcggtcagtccagcagcccctcaggccatgctgctgctcagctgcatggcaaagtcctgcacatgctccttcagagtctggcgggcatctgcctgtgcccgcttctcccgtgcccgctcctgctgcagcttggtcagtctcaaccgcagccgctgctcccgccgcttgcaggcctgcagctggcgctgggccttgtcaagggcatcaagggctgcctcggctcgccgcttccagagtaaggcgctgcccacctggtagctgtgttcattctggatgtaggctccggcgggtgggggcaggcgcagcatatacgctgagggggagactggccgtggttcgagaggggagggctgccgctctggtgaaggctgggcgctgcagcctgcttcatctgcctgggcacccaaggggcccagtaggtctgaaaaggggctgctaaggccaggctccagcctcccagctggggaggccggcaaagtggcaggtgctgaggcctcttccacaggaaagcaggtgacatcagcaggtggaggtggagaaaatggagttgtgggccctcggccctcggagcagctggtaagggggaagagagagactgatgggctaggctgagggcttgccagacccccctccaccagcccacctgatccacccttaacacccaaacccgatccacaggttctgtgtagcaagaaccctgtccagcgagactgctggcagacacccctagggcccagtccctcagcctaggggtgggagtggggcatcccccacccatatcacataccgcttcctgcatcgtctgagccggctgacttcagcggggccaggtgggtaactgtgtcctttggtcttggttgtccggcgcaacttggagaaagactcaaatatggtggggactgccccctcctttagcctgtgatatccactgcggggaaaagcaacccagatgagctggagagcaagtgctgcctccccaggccaatctgcccccagcagcagcgccgtgggatgctggaaggcatcgtgcaaacaatacgtctggggaacgccaagttacagctacaccaatcgcttccccgcaggactcctcacagtccaggtgtgtggaaagcctgcataagccgagctgggctgaccagccagaaagaattctttgatttgtggacttgctggcaagactggggctctgaaagatactctctggaaaggctcctgttttccccttgtgtcacaggcacagtgatcctgggggtgggtttcactgtgcagagctgggaacaggaaacagcccccttggacgcaggctgctcaagggacttccatgacctgcagctgtcccagtccgccgggagccccacatcctaccccagcgtcggccggcagggaggcccacctgattcccaccagctcaaagcagtcctcctcaaagtgtttggagcagaagtagatgtactcggatgccgggtcccacaggccctggccgctggggtccagccgctggcagttggccagccacaagcctcgcctcgggttgtccttcttgggaagtctgtggagccacaaacccgtgagcaccaggctgtccacagccctgggctcatgctgcccaagcaccccagaggggaaacgcagacccaacacgcgccgccacgagacctccctgcgaccccgccgggtaagcaccaccgcccgggcacagacgaggcaacggaggcctcgagaagaaaagcagtttcctcagcgtcatctggcaggtaacagagtggggcgggtccaagccggctagacttcccgtcctccccttcccgactgcattcagtcccgccgggaccgttccgcttcacctcccacccacaggttcaagcctcctcagtatctgagaaaggcgcgaagcctctacgcagttgcgacccgaggcgagcaacaactagcgcatgcgcacgtgagcccgcggcgcacgcgcgctgacctgtggaaggagatgccgcggttgcgcgtctcgcgcgtgtcccgtgtgcagcagccggcggcggagcagtgacgcggcatctgggaaagaggcgggagttaagtcgcaagcggctctccgggcatccggaggagcctcgcgcctccagccgccgctcctccccaaggggctctggcctgtcgggtcccccccggcccgttgtcgccccaaccccgtcccagccgattctcttgacttctgtcagcggcactcacgctctggccattgctgcgccgccgaagtctcgcgaggggtagcgcgcgccggaagttggtaccatagagactggagagccggaggtgcccccgccaccggggcggggcggggcgaggtcctagctagctgggttagtaagcggcgcgagcgtgcgagtttctgacgcgcccgcgtcgtcccagctccctggactaccagtattgtcgcccacgtgggcttctctttcgtccgctcaggcctcacttttctccgtaaacaccccggcacgatggagcggccccagcgttcgggagcggcccgggagcggaaagcggcagtgtcctgggagcctcgaaagccgcaggggcggcagctcgcctcggaatgacctctgacggaagaaataaaacggggcctgggacgcttgcacgaaagaacccgacaaaaaccagagcccgcactcactctcgtactggggaggtggacttcagggagggttatctggaggaggaatctctcaaagtacaacacaggagaaagacagtatcgcaatacagaaattttattttttattttattattattttcctgagaccggagtctcgctctgtcgcccaggctggagtgcagtggcgcgatctcggctcactgcaaactccgcctcccgggttcacgccattcggctgcctcaccctccacagtagctgggactacaagcgcccgccaccacgcccggctaatttgcaatacggaaattttaataggtaattagctctcctagcgttatggtggggaatacagagggatggttgcctgccgcaccctcccctcactattcttcgccttcttcagcctcagcttccacggaatccatgcccacatcttcataatcctccagagctgccagatcctcgcgggcctcggagaattcccccactgccatgccctcccccacgtaccagtgcactaaggcgcacttggccgaacttatggtccaggcaggcccaggcctccgtgatggccgtggtgttgctcagcatgcacaccgcccgctgcactttggccaggtctcccacagggaccaccgtggggggctggtagttaatgcccacctgtcagagatgggcagcatagaatgaagtttatattggcctcagaaatgggagctcattaaaaatcagagctgtggaccagttccaacactgtgttttaagaattgcttctatattttttggcattatctgttatctatcgacaattaatatcctttgacgacttttttttttcttttcttctccttcttcctccttctcctccttctttgttgttgttgttgagacagggtctagctctgttgcccaggctggagtgcagtggtgcaatctcggctcactgcaacctttgtctcccaggttcaagcaattctcctacctcagcgtcctgagtagctgggattatgggcatgtaagatggagcccggaagacggagatttcagtgagctgagatttcgccactgcactccagcctgggctacagagcgagactctgtctcagaaaaaaaaaaaaattattacccatattacccatacagtaaaacacatgaaaaagaatgagaaccctgtcttgggatataaatacatccaaggtatattgtatactttgtaaaaagaaaagtgagttgaagtctatgtatttatgtgtaaaaaaatccatgtaataacatacacaggctagaaccttgggcagctagggtagcatcatgccggaggaggacaaacgcctgctgaggtggtgaccctgccttgccctgccaagcacgtagcagttagcaccaactagatacagacatactccacaggagttggaaggggcagagagaagggttcgtaccctgatcagggagtgtcctcccacaactctaaggccaagcctatcagcccttccaagtgggagtgctgccagctttctgtttactgtgaccacctgtgtgcagcaattgggtctgtcacctacaggaaagggacatacatatctgctggccactgtcaacatcacctgtataacaagagattaatatgccttgaatatgtacagaatgtttttcaaaggacagaagcagctctggggaagaagaggacttcagcttttcagtcttctgcattctttcagtattttgccacatatcaggttttgttttgtttttgagacagggtctcactctgtcacccagccttgagtgcagtggtgtgatcttggctcactgcaacctctgcctcctgggttcaagcgattttcccactttaagtgatccgcctgcatcagcctcccaaagtattgggattacaggtgtgagccaccgcgcccggcccatatcaagttttttttttttttttttttttttttttttttttttttttttttttgagatggagtcttgctctgtcattcaggctggagtgcagtggcacaatctcggctcactgcaacctccacctcctgggttcaagcaattctcctgcctcagcctccagagtagctggaattacaggcaaccgccaccatgcctgactaatttttgtatttttagtagagatagggtttcaccatgttggccaggctggtcttgaactcctgacctccggtgatccgcctaccttggcctcccagaatgctgggattataggcgtgagccactgaccgcacccagctttttttttttttttttttttgagatgggttttgctctgtcgcccaggttagagtgaagtacaatggtgccatcttggctcactgcagcctcaacctcccgggcttaagcagtcctcctgtctcagcctcctgagtagctagcactacaggaaatgtgccaccatgcccagctaattttttattttttgtagagacaggttttgccacgttgcccaggctggtctcaaagtcctgggctcaagccatccacccaatggattacaggtgtgagacactgtgcctggccaacataagtacttttataataaaaaacccaaatgttcgtatttttttttctaagggtcttgttctgtcacccaggctggagtgcagtggcgcagtcatggctcactgcaacatctgcctcccagtctcaggtgatcctcctacctcagcctcccaagtaactggaactataggtgtgtgccatcacacccggctaattttttgtattttgtgtagagatggggtttcaccatgttcccccaatggatcctgaactcctggactcaagcttttttttttttttttggtgagagagggtctcacttggtcacccagcctggagtgcagtggtgcaatcttggctcactgcaacctccacctcctaggctcaagtgatcctcccacctcagccttccaagtagctataagtgcgtggcatcatgcccggctaattttttgtatttttggtagagatgaggtttcaccatgttgcctaggctggtctcgaactcctaagctcaggtgatccaccgacctcagcctcccaaagtgttgggattacaggcatgagccactcggtccagcccccaaatgtttttaagcatggaaaagactcttcgaaaatagcatatccgaagctgggtgcagtgactcacgcctgtgattccagcacttcgggaggccaaggcggttggatcacttgagttcaggagctcgagaccagcttagccaacatggtgaaaccctgtgtctaccaaaaatacaaaaattagccaggcttggtggcgcatgcctgtaattccagctgcttgagaggctgagacaggagaattgcttgaacctgggaggcggaggttgcagtgtgttccattgtactccagcctgggtgacagggcgagactccatctcaaacaaacaaacaaaaaaaaagcaaatggttgttaaagaatgtatggttggctgggtgcggtggctcacacctgtaatcccagcattttgggaggccaaggcggatggatcaactgaggtcaggagttcaagaccagcctgcccaacacggtgaaacctcatctctactaaaaatacaaaaaattggtcaggcgtggtggctcatgcctgtaatcccagcactttgggaggccgaggcgggcggatcactaggtcaggagatcaagaccatcctggctaacacggtgaaaccccggctctactaaaaaataaaaaaaaaaaaaaaaaaaacgttagccaggcgcgatggcgggcacctgtagtcccagctactcgggaggctgaagcaggagaatggcatgaaccccggaggcggagcttgcagtgagctgagattgtgccactgcactccagcctgggcgacagagcaagactctgtctcaaaaaaaaaaaaaaaaaatagccaggcatggtggcgggcgcctgtaatcccagctactcaggaggctgagtcaggagaattgcttgaaccggggaggcagaggctgcagtgagccgagatcacatcactgcactccagcctgagtgacaagagtgaaactccgtctcaaaacaaacaaacaaacaagaatgtatggtaaatcacactaagactgacaaaaaggaacttaagagcaaagagaattaattcaacaaggtccatctaaggctggactatcttctggggggaggagaggctgtgactttatctccccacagactagcctccctactgtctcacaatacttagttacaataggaaacctctgcacagcatagcatctcccacagtgcctgccagctaaggatgtcttcaccttccaaatgtaacactaattgaaagaaaaattcctctactcaagttgagaggcttaataattagacacagaatggagggtttcacctcctacctgtaacatcttacatctaaggtctgtaatcctcctatgtaacatgtaatgaacattccaggttggtgtaactgttgtagattttacccttctttttcctcttttttttttttttttttttttttgagacagtcacgctctgttgcccaggttggagtacagtggtgatcttggctcactgcaatctctgcctccctgtctcaagcgatcctcccacctccacctccccattagctatgactgcaggcatgcacaaccatacctggataatttttatatcttttgtagagacagggtcgcactatgttgcccaggctggtcttgaactcctgggttcaagcaatcttctcacctgggcttctcaaagtgctgggattacaggcatgtgtcactgagcctggccgattttaccctgttctatgaatcactttaaatctgtcaacttaaagatggtttgcatcaacgtgagatgaaaaagagagatgatctgtgtcaaggtgttgtaaagtggctgagagagggccagacagattcaagaagttgtgtgcgttcagaggcaagttatggccattccacatgggaaaaagaagacacatacctgtgactttctcatatcatttcaatctggaatgatcctggaacttgcaactcctcaaacaccttcagaactcattgagacttataaatgtgggatctatagctttgcctaatgtgggaaaccactgtagacaggggctcttaactaaccatagggcacaaagttgaccaacacaggtgtggtgaggcatttagcctagtcatcacaacagatcttcgagcctgacattctgttatttggcttccaaatacatggtacttttcttttggtagacaactgactgtaagcatagctaaaggagcaccaaatcatcagtctgattgtgtgtgaggcagaggtctctgcttggtttggagaaagggcaaagacctgcctttggtcttcacagtaaacactgcacaatatatttaaaaatctttacagaaatattagtgttgcccaaaattcagtgacaacaggtgaccaagatgatgtaaagtgtaaaaaccactatttataacacaaaaaatgataacatagaacctgacaaattactaaagtgagcagtggagtaatgtggaggacagaccaggacctgcagtcagataatctctgatttctctctgcatcacttgctgcctgtgaggctccagacacctaaagctatctcagcctttgttttcttttcttttttctttttctttcttttttttttttttgagatgtagtctcgctctgttgcccaggctggagtgcagtggtgcaatctcgactcactgcaagctctgcctcccgggttcacgccatcctcctgcctcagcctcccgaatagctgggaccacaggtgtctgccaccacacccggctaattttttgtattttttagtagagccggggtttcaccgtgttagccaggatggtctcaatctcctgacctcgtgatctgcctgccttggcctcccaaagtgctgggattacaggcatgagccaccgtgcccagcctcagcctctgttttctaaagtgtaagatactggtaatattgccccatgaactttaaagggtagtggttaaggtatgagggaacataaagtatttggtaaagtataaggcggtaggaaataaattactaaaattattatccttgcaacctagctgacgtgaaaaggggttgtctccataaaggatgcgggccttcaggggcagcattattctgcaggtctcctgcttcctgatggcacaaggactccacatcacccagtcctaccttaaatccaatcggacaccagtccacaaactggttggtgtgcttgctcttgatggtggcgacagccgcactgacatctttcaggaccacatcccctctgtacaacatgcagcaggccatgtacttgccatggtgagggtcacacttgaccatctgattggctggctcgaagcgggcactggcgatcttggccacggacagctgctcatggtaggccttcttggctgagatgaccagggcgtaggtggccagggggaggtggatgtgggggtatggcaccaagttggtttggaattctgtcaagtacacattcagggccccatcgaatcacagggaggccgtgatggaggacacgatctgcccagacgactgaggttggtgtacatgggacactcgatgtccaggttgtgctgacatgtcataggtggctttgctgtcgactatgaaggcacagtcagaatgttccagggtcgtgtaggtggtcaggatggagttgtagggctccgtcatggccatggagacctggggggctgggcaaatggcaaactccagcttggacttcttcccgtagtccaccgagagccgcttcatgagcagagacacgaacccagagccagtgccgcccccaaagctgtggaagatgaggaagccctgcagtcccatgcacagatctgcctgagagaaaccagacaacgtaagccaatgcccgtgggagccacaccaccaacctccaccaagccggggccacttctctttgcctctgagagttgatacggattcagaccatccataatgaacacgcatcacactttgaagcagagaaaagcagacaatacagatctatgcacaaatcaccacgcacacttcacagtaagacgttgcagaggtctaggaaggctggtttgaagaaatacacagaagaaaaacggatggactaaccagagcgctcagccagcctgctggactggcacccgtggctacagacactcttgtttagcaccatggagagctccctgcacagaagcaaggactcagggcattgccccctctctacctgagaactagactcagcgcccagcactggatttgataatacaggtactcaaatacatgtgctttcctctttactcagacacttctagggctggcagggtcagacagtaatcccccactttgtggggaggccctgtttttgctgaacagctcaagggcaggaagattctttcttccacacacccctgcaactgccaatacttgttctgtgtgacccttgcagccatcctatgcggtaggtgctaccattgccatggatcaagtggggacgcacagatccaagctccttcacctctcaagggagttgggccctcccacagatctcttggaggaaaaaaatggccttgctgggcctgtcgatttccagtccccacccacctccctcatgtacatgtgtctgtttgtgaaaccttcatagcaccttagcttccaggccctccatcccggctgcctctctggcacttgcccttttactgtgcgggtccaaagagacacctatgttcagtttgtcaaagtctgaaataagcctgtcttttaatttcactgactcccagtagtaatttttttagaagacaaactgcttctctggcagttacactccagggccaattctcaaaggccaagtctggtgccaccccactccctctaagctgcttgagccagatgagagcttctgaaatgctgcagaaaagagctctcctggggcatccattaaaatgcagattcactggcattcccctaagagtttggttcagcaggtccagggtcaacatctgcatgcctcacccagggtcacaggtgattgttactattattggaccatttgaggagaggcaggtagaagtgcaaattcctggcaaagcaaacactcaggggcatgagagtgatgagaccaaggaatcccaaccatgtcttctacctcacctggaacaaaatctataccctttttgccacggcctacagccctgcagccctctgccctctccaccccacagcctggccacgcttccctggctccctagcctaggcacactgctgtctgccagtctgggaaacaggcccgcatgctcactgttcctctgcttgaaatgctctccctctgatcttgccatggctgactccttcccaccctgcacatttcagcttaaatgtcacctcacagaggcctccccagccacctctttaaagcagggggtccccattcttctctagaagcataaactatttgtttcttttgcagtgccaataattactcagaatgatattgttaacattgtcccttgaggtcaggaacttggttttgttcaaggtggatccctggtggctaagtcagtgcccagcacatacagcagcgcgcaatgagatatttgtggaaggaatgaagagttccgtgtggctggagtggaagaggagtggggcaaggtggggtgtggggagcaggaaccagagcacatgctccctggcgatgtgcagcgcggtcctgccaacccccacccatccctgccccaggaagctgagctttcatggccatggtgccctgcgcaggcattacctgcttggtcattcagctggttgtagctcaggtccagggacttcaggtctgtgtgggccagcaggagttcggcaaggtgctgggccgcctgctcctccaggccattccctgacagctgcatcttccgcatggcctggttcactgtgagggcggcacagagggcctgggctcctgccactcccagctggttctccaacaggtccacatctgggggacggagccactcctcagccagtgggatgcaaagccaggtaccacccccctcccccctcttctgccatcccccaaacctccaggtctgaggcagaggaaaaggacttacaggttaactgtcctggggttgcatggtggctctggctcccaatggctgggtcccctctgcccctgacctccccctccctgtgtgcccaccagcttctgtgtcaagcggttaaaactgcctacctcctggtactgtagagactgctgtggtggggggcagccaccccatcaatgattatgtctggcagtgatatcaccacccacttcagaagccctcactgccccattgccaggattggcaataatagcccaggtgactgtgcatggagcacttacatgggtcacacactctgctgatcacttcaggagtgcatttcacttcatgctcaccacagccccaagcctatgaggtcttgtgggggccatttcacagattggaaactgagctgctttcataggtcaccccgttttctcagtggcagagacagcatttggattcagcttcaatgaactcccaccttgcccacccctttcttgaacttccccgcccccaactctctgtgttgcaggactttccactctgcattcaggcactggggagtctcccatgtgcagggcagggcaggagaatgggtgccagccaacaaggaaggagagtggtggggtagggtggatgaggaagggacttgtatccagcatcagctgcacagcagagggtctaactccaccccacataccccctcctgtgatgaggcccctcctctatccaccagcaacaccagcaggacccaggtgacatggcccagctttcaggggtggaggcacatccctgaggaaagggaggactcacgcctgcccacctgccccagacccagcacctaccgcagatgctgctgcttttgctcagggcacctgccagggcctctgtacctgccccatagagcccactgtcccaaaagttcagccacttgacatatggattggagctcaatgaggaagccagagaccggcgccctgggacagacagagcaaacacactggccactatcctggctcatgctccagggctcagcccgctccacgtcccccacctggaaagtacccccctttccacctgcttaagggacacatgcttctccttttaggccccacctaggtgtcccccacccccacctctcccagagcccccagcgggttagaagcctgaaggctccccaacccttcatgccatctgtcatagcatcaatcccatctgtctctcagatgtcgagggtagggcatgcctggcacaggcagaagctggggagtacaggggacagactcaggggcactcccatggctgttgtctcccggggcctctccctgtaagcctggacccagtgtccttccagtggtacctggggccccaggccaccgtgcagcaggttcagctctggggcactcccttggcacagaaagcagaagatgggcacaatgctatggatccagcaagacctcaggtacagggtgtccccgaccagttctccaagtccatgggtgcctggtaggagacagggggatgaatgtgaacccctgcatggctatagccacctgcctcctcccctgccctgcatcactacctggcctattttttgcctctagaagcactgcttcctatgctccttaggaccactgcccgcatatgacagataagaacatcgaggctaaggcaacgcaaatcttttccttaaagtcatacagctgtcaaaagaaagctggacaacctgggcaacatagcgagataaaaaattatttaaattagccagatgtggtagccccctgtagtctcagcgactcaggaggctgaggcaggaggctcaccagagtgcagagttcaaggatgcagtgagctatgatcctgccactgcactgaaagctgggtgacagagcaagaccctggctctaataaatgaatacataaagtctcacagctagtggtagctaatcctgccagagtcaggcctctacctgtctgatgacaaatggcacactatgtcttttaacctgattgcagaccacaaatgttttgtgaatattttccccagggaaaaaaccggaagtagttctaaattctatacatccattatattagttttacctgtggattgggaaaacccagctctgattgcatttcagggcgggacagcctttggtgcactgtctggcgggattttccattttaacctccttctagaagcgccttctcatggtaaagttcctgatgccgccaggagcgccgaggagagggcagggggctggagacgccccgcagagggctacgtgccctgctggacagaggtctcctgcctcctcggcggcgccagcccacctcccacaacccctgcgggagaagcccccaaggggaggagacgggcctggcccctgccccgagcaccttccgtctctaggtcggagtctgaatcggccttgggaccctgcttggcttcggggacccctgcaagacgtccacaggccgccgtcgcctcttcctcctgctttttatcctccccagacctctggcaggaaccgctcatcgttacgcccctttcgcagcctcagaccctgaggcggagaccgcttggcgcctcacttagagcgcgacccggggatgtgggcggagtctgcggctgcgctgaccaatcgagtgtggcgtccatcgactggcgtctgccacggcaattagcgacgcgctcccccgcggcggtcgccccggcaacccagtgctgtaggttgccgtagaaaccgtggctctcctgcgctgaggctcctcgcctgagaggataaactgcacgcgccacgggctatgcactgggctgggcgccttgtgggcatcctccctgccttcctagggggttccagcatcgcccccctttcgtggactgggaaacacgcctgactccaggacttgtgttgtcctcactgcactggggaaggtggcgggggcagcttttcaggagggcctggggaacttcgcagagccaggtcaccctctcactctgtgcctcttagttatcttgcatgctctggtctttgcatacgctgctccctgcaccaggaacctccatccccatctttgtctgcttgtcgaacttcagaaatctgcaagggtcagcttagaggtcacttcttccggaagctttcctcaacaccctccccgccctgctgctgctgccctcaggccctcctctcacagcactgataacagctgtccgtctccaccctcccaccacctccactcccaccccaggaagtgaggccagagggcagggacagagctgctgctgttctctgtgtgccagggcccagcaaagggaatgtagggagggtgggaggtgcagggcagctgggattaggggttgagggctgggtgttggaggctggatctggatcctgctttagtggaagtgtccctttaacagcaactggcctggcctggctcgggccctgctttgcctcctgttcagctgcggctgcagctgccatgctgactcatgtgcccgcagctagcaggagctggcagcatgggctccccaggggctacgacaggctgggggcttctggattataagacggagaagtatgtgatgaccaggaactggcgggtgggcgccctgcagaggctgctgcagtttgggatcgtggtctatgtggtagggtaagagagaagagcttttggccaggctggaggggcaagggaagaggtggggggtggggcttggtcctgctgggttgaagttgagggttgggctgtttaggggctggagtggaagggggcagattgggacggggttggggagagctaggcgatacaagacaggagagcaagaacaagctgtgtgtttgtcctgtgtgtccacttgcctccttcccaggcccccacccaggccccacccagggggcacatgacatagtccttaacatctgtgagagctggagcactaggcccccagagagaccaccagctgtatctcgggtcaggagagtctgtaagggggaagctggatctagtcaggctgggggtgggtgctggctagtgaaggtgattgtctgagggcattggctctctgatgcatggctggagcttctgtctcattcagggggtctggagtgggaagtggggccagagaggaggtggggccttcgatgttgggccgggagcctgtagggtgtggggggagaactgagcatgtagggctcagctccgcccctgtcactacacgctggggacacaccacactgcccgacttctcctccccaggtgggctctcctcgccaaaaaaggctaccaggagcgggacctggaaccccagttttccatcatcaccaaactcaaaggggtttccgtcactcagatcaaggagcttggaaaccggctgtgggatgtggccgacttcgtgaagccacctcaggtgggggccctgatgttgctgacgggggcgcaagtcctttccccactgacagcctgaacacccgccatgcagccagtgtgtgcgagagagaagcatgtgatgccagagacggctgcgggttctcaggaagggcttcacagaggagtggcacctggacaggactttcagggatgtgtaggaggttttggggtggaaaaaggggccactcaagaagccaggccagggttggacgtgctggctcacgcctgtaatcccagcactttgggaggccaaggcaggtggatcacgagattgagagtatcctggctaacacggtgaaaccccatctctattaaaaatacaaaaaattagccgggcatggtggtgggcgcctgtagtcgcagctactcgggaggctggggcaggagaatggcatgaacccgggaggtggagcttgcagtgagccgagattgcaccactgcactccagcctgggtggcaaagcgagactctgtctcaaaaaaaaaaaaaaaaaagccaggccagagaaactgcatttccaaagactgccaacagaaaagaagggagtgtccaggactaatggcttgagcttgagagtggtgtgaggtgctggggcatggaacttccctgtagccctgctccctgacctggggcactacggtcaggtgctgctcctcccctcttctcggctgcgttttcctcctccctccacccagctcatccccagcctcaactgccacttctgctcctctgatgcccagggtgtattcccagtgatcacctgcccagagcacagctgtcttctaggtgcacacccacatgtccaaagatcaattattttcctctcctggcatggcctctgtgacgcccactagtcatggtggctgtgacatccactagtgcctcagccagacccgtgactcaccctggaccccttcctgtcccttccaagatttttcaccactacccatgccatgccatgcatgagactatggcctcctagagggtccctagatgcccctctcgcctcctcccttactgctcggtgcacaccacgcagcagccaagctgaactttcacaccaggcatcatgagagcctgcagcgcctgcttctaccctcaggaattcccccaaccctgcccatgacggtgtccacactttcctcccaatcctaatggctgccactcccagcaccatctggccagccctcaccttcccttcctgggcatacattccccaaattcacagtgctctcacgagcagcactggagggtcagcctttctttccaatgtcctcggccacccgttgaccacagacacagctttccctcttctcccttggcccctgccatgccagtgctgctgtgtgtgagatgggagactcacctcgtctccatcctgagcaggtgctgggcccagctctcccttggatcttcagtactagaagcagcaggctgttggaatattctggttggagccaggcatggtagctggagcctgtagtcccagctacttgggaggctgaggcaggaggacctcttgagtccaggagttagaggttgcagtgagcactgatcacaacactacactccagcctgggtgacgaagtgtaatcctgtctctaaatacacacatacacatgcacacacacacacaaattttggttgagacaagagacttgtctcaagagatggacatgggcacaaggcttcctggtctcaaaaatggccagaaccactgccagcctcccatctctgcttcagtctgccttacagggggacagggttaatgacttgatggggccaacatcccttccctcataaaccaggctgccggcttccggcctttccagtcaacacgagcccagccaggccaaccttgagacttgcctcctagggagagaacgtgttcttcttggtgaccaacttccttgtgacgccagcccaagttcagggcagatgcccagaggtgagtttacccaggatcctcccagcgggtcccttgttcctccatcagccccagggggccacccgtgtttccctttccccttcccaggtggctgaaggctcagcctgtgctcggtgtcccccaggcactgggctacatcttttcctgaatcattatgttcagtcttcacatatcccctgcctggtaggaagtcctgtgatccccatttcagaggagaagactgaggctcagtgaggttgagtcactttcttaaggcctccaggcctgtgggtgacaggaccccgagctctgggcagcagcagttcccatgaggtgtccaggccctcccatcctggtcctgcctctgggtactctccaggttggtagtgtgacacccagagctgcgcacatgctcagggaggttctaatagcaagagccaagctggaatatcacctccccttgtctgtgcccagcctctattaatatgtcctgaggcagctttcatctttgtgggccaacacagcacactcttgctcatggtgaattcaggattgcttatgatttctggatagttttttttgttttatttttgagacggagtttcactctgtcacccacgctggagtgcagtggcagatatcagctcactgcaagctctgcctctcaggttcacgccattctcctgcctcagcctccggagtagctggtactacaggcgcctgccaccacgcccagctaatttttttttttttttgtatttttagtggagacggggtttcacggtgttagccaggatggtctccatctcctgacctcatgatccacctgcctcggcctcccaaagtgctgggattacaggcgtgagccaccacgcccggcctgatttctggatagtttttacatcaaccgtggtcaagccagagtcccccaccttgttcttcttcatttctgatccagaaatgctgattctccccctgacatttcaccttttccccttgcctggggatgtccctgggatcctgcatctgtcacagagcatgctcattctctccagctgtgaattttgtttgaactattgggactcaggacatagtcctgaaagtttacctccacagtgacatctttaggcaagtccaacatttacgtgcctcctgggctggagggtcgttgtgcagacagctgtcccctgagccctggtggctggtcctagcacagttgctggagacatcccatgtccgtagttggaaatatgcacaaaggattgcttactctttttgtttgtttgtttttttgagatggagtcttgctcttgtccccaaggctggagttcaatggcacgatctcggctcactgcaacctccgcctcctgggttcaagcagttctcctgctcaccccctgagtagctgggattacaggtgcccgccactgtgcccagctaatttttgtattttaagtagagacggggtttcaccatgttggccaggctggtctcgaactcctggcctcaggtgacccaccagcctcggcctctcaaagtgctgggattacaggcgtgagcctgccgagagcttggtcggggagacctgaacccagcggtgctaaaggaattaaagacaaacacacataaatatagaggtgtggagtgggaaatcaggggtatcacagccttcagagctgacagcctcgaacagatttacccacatatttattgacagcaagccagtgataagcattgtttctatagattatagattaactaaaagtattccttatgggaaacaaagggatgggctctggttggttagctgcagcaggagcatgtccttaaatcacagatcgctcatgctattgtttgtggtttaagaacgcctttaagcggttttccgccctgggtgggccaggttttccttgccctcattccggtaaacccacaaacttccagtgtgggtgtcgtggctatcacaaacatgtcacagtgctgcagagattttgtttatggccagattttgggggcctcttcccaacatgagccactgtgcctggcaggatgtgcttactcttggtgaacccacacaatgtccttctctttcttaatgctcagatgtgcatttagtgttcagtttgtagaccgttctgaaatttggctggatctgtgggtctgtgtttttcagaatctgtgcaattcctctttgtctgcaaccacacttctggctcttcccatgaaacgtcagggctgggtcgtaattatcagatctgacaacctggctttcccggaagaccagagttctgccagctcctctagggatcctggtgcctgatccctcccttacatgcaccatgctctttatagtgtcacctccctcagcagacaccgctgagcctccccgctgggccagggggctagctaggctaaattcacaaaactccatctcccatacttcaaagaccacccacatggacagcccagcccaggtggcaggtcctatgatgggacagaggctgtaggtgggggacctagggctgcacttgagcagaatcttttttttttttttcttttttttttttttgagacagagtctcgctctgtcacccaggctggagtgcagtggcgtgatctcggctcactgcacacctccacctccttggttcaagcgattctcctgcctcagcctcccaagtaggtgggactacaggcacacaccaccacactcggctaatttttgtatttttaatagagacagggttttgctgtgtcggccaggctggtctcaaactcctgacctcaggtaatccgcccaccttggcttctcaaagtgttgggattacaggtgtgccaggccaagcagaatcttaaaaaaaggtggggagaagctggtgagcaggtggatttggttgaagcaggatgtcgacacagagggggcttggtgggtaaaggccctgagctgtgtgaggtgaggtgcctttagggctacctgccactgggtggagctgaagtgaagatttggactggggtgggaagaaggtagttcaggatttcaggggcccctgtaagccccactaaggagctaaactgtttttgtttgtttgttttctttttctcttttcttttttttcctgtagcaatgaggtcttgctttgttgcccaggctggtctcgaactcctgagctcaggcaatccgcctactttggactctcaaagtgctaggattacaggcgtgagccactgtgcctggcaggagctaaacttgattagaggaacagaagagagccacacgtgggctcagaggcagggtgctcagtttcctgcacattgggatgcaccacttgggctgctgggcataggtggatgagggtatgggaagacgtgggggccccactggtggtcactgtggggtctagttggaggagacggtagcccagctggggtgaagaggagaggcagacacaggacataggtagggacaaagaagcagagcatgtggctctgctccgacctccacccaatcacgacggccctgtctttcagaaagtcccaccgcctcattctggcttctcagaggccctcagccttccttgcgcccctggtgctggtgttcttcctgctgcccctgagctgagtgccctgggcagcagtgtccatcctcagttggggcaggaccatgcctgggagagtgcccgatgctcaagggtgccttcgtctctggggtctgggaccccagaaagctcacctgtcctccccttctgccagagccccatagtcctatgcctctgtgcaggcattaatgtccccaggttacagaagagcgagcaggaaggagtagcctgtggtccctcagcaagggtgtggggtcctgcttcaatacccaagcccctgactctagggccctgatctttgtcagctatgtccccatgccgggcatcaaaaactcaccctcccaaggtatcttcaccttccctgatctgtcatccaaattggaccagaggagctagacctggaagaatcacttccgcatccaccagggacagaactgtcaggagggaaggggcagggtgcgttgtctcacgcctgtaatcccagcactctgggaggctgagacagaaggattgcttgaggccaggagttaaaaaccagcctggtcaacatagcaagactccatctctacaaaaaaaaaatattaaaaaatcagccaggcacagtggtgtgtgtctgtagtcccagctactgggaatactgaggtgagaggattgcttaagcccgggagggcgaggctgtagtgagccatgatcataccactgcactagagcctggacaacagagtgagaccgaatcactaaaaataaattttttgaaaaaggaggaaaggggtctccctttgtctttgaaatacagtactgtaccttcatctggccagggcattgctccgctccctcctctgaccacctccttttatttgcaccctccagctttcctgtgtggccccacactcagggtactctggcggcggggtggtgaggttgtttaaggtgggaagggggcctgtccttcccaccttgaacctccctgcctttgagactgggctgtggaggggagacatcccctgtgccattggtgactgctctctctcccacctcagcacccgtccgtcccactggctaactgctgggtcgacgaggactgccccgaaggggagggaggcacacacagccacggtaactgtgggctctgtcttccagtgcccccagcagggtgggggccgggctgggatcctgggtggctcctgagtgcaggccctgctcgcctctgtccctgcatctctctttctgccaacaaccccctggctgaaggcctccccaggcctgcagagatttgaaggtctggagttcatcttttgttttctaggtgtaaaaacaggccagtgtgtggtgttcaatgggacccacaggacctgtgagatctggagttggtgccccgtggagagtggcgttgtgccctcgtaagtgtccccacaatcccctaccccaactggcgcagggccccaggcctggcagaggctgtcacctcccttccacctgcaggaggcccctgctggcccaggcccagaacttcacactgttcatcaaaaacacagtcaccttcagcaagttcaacttctctaagtaagcagagtgggtctcatctgccccaagaccctccttgtcccctacctcatctgacctttcccactcctcccaggtccaatgccttggagacctgggaccccacctattttaagcactgccgctatgaaccacaattcagcccctactgtcccgtgttccgcattggggacctcgtggccaaggctggagggaccttcgaggacctggcgttgctggtgggtcccaagttgggggcagggttcctagagggctctgggagagggtcccgggcccacccaccggtggaaaagctatgtgctatgtgcagggtggctctgtaggcatcagagttcactgggattgtgacctggacaccggggactctggctgctggcctcactactccttccagctgcaggagaagagctacaacttcaggtgaggccccactgctcccagtgcccagctgctgggcccatcgccctctcactgtggcggccaggacagaccacacccaggcccaggcctctagatattccactacgtgtgcaagggggtcccaggagcaggagagagctgttctcaaccccacatcctccagcacaggctccgtcctgctgccccaagtcctgagccctccaccccatctgtcccaggcccctgcccagctcaggctcctcactgccagcccttcctccaccccacctcgcttctagtatctcccctccacagcaatggggtgtttcatttttactttccccttctccccttcagctttgttttttttttttttaagacagaatctcattctgtcacccaggctggagtgcagtggcccgacctcggctcactgtaacctctgcttcctgggttcaaccgattctccttcctcagcctcctgagtagctggaattacaggtgctcgccactactcccagctaatttttatattttggtagatagagatgggttttcacaatgttggccaggctggtctcaaacccctgacctcaggtgatccacccacctcagcctcccgaagggctaggattacagacgtaaaccaccatgtctggcctcccttccgcttttacctaaactttttttttttttttgagatggagtctcactctgtcgcccaggctggagtacagtggcgggatctcagctcactgcaagttccgcttcccgtgttcacgccattctcctgcctcagcctcccaagtagctgggactacgggtgcacgcctccacgcccggctaatttttgcatttttagtagagacagggtttcaccatgttggccaggatggtctcgatctcttgacctcgtgatccacctgcctcagcctcccatagtgctgggattacaggcgtgagccaccacgcccgacctttttttttgaaacggagttttcactttcttgtagtccaggctggaatgcaatggcgtggtcttggctcactgcaacctctgcctcctgggttcaggtgattttccagcctctgcctccagagtagctgggatgacaggtgtgcaccaccacacccaactaatttttgtatttttagtagagatggtgttttgccatgttggccaggctggtctcgaacttctgacctcaggtgatctgcccacttcagcctcccaaagtgctgggattacaggcatgagccaccaagcctgttttttttgtgttttttttttttttttttttagatgaagttttgctcttgttgcccagactggagtgcagtggcccgatctcggctcactgcaatctttgcctctcgggttcaagcaattctcctgcctcagcctcctgagtagctgtgattacaggtgcacaccaccacacccagctaatttttgtgtttttactagagatggggtttcaccatattggtcaggctggtctcgaactcctgacctcaggtgatccacctgcctcagcctcccaaagtgctgggattacaggtgtgagccactgtgcctggcctcaagtttcataaattgcatttattatcatgtctttgagtcttctaagcagatctattggatccttctgccaccgagcgtcacctcgtcatgcaggcaggcacacacgaccaccaggcctggggatgatgcccctcaacatagctcactgcaccccgtctgatctggcttccccaacctccccagcccttcgaaaccacgtggggctggctcccacccacatcctgttcccctgacctctgtgctggcaaaccacctgtgtgcatgttccttcaggcccagcctcatgtcccctccaggaagtctaccccagttcccagggaagagtgagttcccatctctggaatccctcagccctgagcctgccccttcacatcccccgctgctgggtctgtttagggactcctctgtcccccgtcctctcagcaggcagggaacttctgagggacaggtcttcgtttgctttttctgttttctcaccaattacatagggctgagacccaggactcaggcttgggctgggggtttatagagtcaattgacaagttggacagaggtctggcagggccagccccacctgggggtgggcaaagcaggtcaccagagccttctttcctgcccacaggacagccactcactggtgggagcaaccgggtgtggaggcccgcaccctgctcaagctctatggaatccgcttcgacatcctcgtcaccgggcaggtaggcacaggtaggggtcaggccggggatgggatggggcaggcagacagggctggaggaggcatgaggctgacagtcgtgggctgagaggttcagctcagatctctctcaggcagggaagttcgggctcatccccacggccgtcacactgggcaccggggcagcttggctgggcgtggtgagtgcgagcactgtgggcacctgcaggctgcagtgagtgctgctgaccagggtgtgtccaatgcatgctggagcctccggtgcctgcacattgagtctcggggtgcaggctggggaggtggcaggagagcaggctcgggggctggaacatgggttggccctgcctctcccaggtcacctttttctgtgacctgctactgctgtatgtggatagagaagcccatttctactggaggacaaagtatgaggaggtgagctgaggtcgctctgcttggaccctgggttctgccacacttaggaagatgttggctggatccctgacctgctgtcctcatctgcaggccaaggccccgaaagcaaccgccaactctgtgtggagggagctggcccttgcatcccaagcccgactggccgagtgcctcagacggagctcagcacctgcacccacggccactgctgctgggagtcagacacagacaccaggatggccctgtccaagttctgacacccacttgccaacccattccgggagcctgtagccgttccctgctggttgagagttgggggctgggaagggcggggccctgcctggggatctcaaggatgaggccccagcatggaggattgggggtagaattccacccttgaaccccagcagacagtccctcccctgactcccaccttggtagggtgctgcctcagggagccatagaagtcggctgtgttttgagacggcgacagaacctgacccgtggagactgggagagcccagcaggcacctgtattgcagggctccgactgcatgtggcaggggctcctgctgcgtctgggcctggaggtctctctcccagtgctctgtccccagtgttcctagcagaggtatgcttaccagctgtcagcacagaccctcctgctgcctgggtcctggccctcctcccccatctgcacccccatcataggtagagaccccaccctcccatcggtcctacatggggctgtgcagctggagccaaaaaggcaaggtagaaagaggagtgatgggggagggggattgtttcagcttctctggtgctgtgatgccccaggagagtcctaatctagggaatggggtggagtaggcagataatccacctccctatcccccaggcaagggcggagcatgtgtcttgggcccacacctgcttagtttatgaggaccggctgctttccagtggtagcccttttgccatggaggtctgggagagagagcagagggcggcagggctaagttggtgatcattgggttcttcaggaccttctatatccctcctcggtaaccccccagcccaaccccttggaatctttcctccaggcttcctgagagccctgggggtgggaggctgtgggaggctgtacatctgaaattcacttcagtccaagtcatacctaggaagctgtctgggcagctgctcgagggaggccctggctctgatcccaggctggatggagtggctggaaggaatggttccaaacaacaccaccgagatctccctcaggctggccaggttttgcagctggaattctcctcttggtcccagggcggggcagggaattctaagtgtccaccccagggaggcaaggggctgctttccactgtgggtacctggtgatcagggcaagctgtggagggccaggggtggggctgagactgggctgacatctagaatcacctgccacctggagcctcagtaaaatgcctggggtccctgctgcctctcaatctccagagccatgtccatggggaggtgggctctgaagggcgaaggtgggagagcagggcccctgaggcctgggtatccaaggaggggcacgtgcacctgattctccttggggcccagaggaagctgatgtcatggctggacaaagtcacggagtaaagccagcaaagccaccctcttcctgtgtagtccttacaggcatgactggaaagttggggggcatctatggtagacatggcacagccatgaagagaccagtggggtggtgcagggtggacttggggaccctacccctgaagactgaggccctgcagctaccaggtgggctagaaggtaactggaacaggcctgggcacttgtgcacccatgtaggagcatgagggccacactcttttcacctcaaagcccttgaagagtgggcaaagacagcaagagagctgcagcctgggcccgagctcagaaacagctgtcgcctcagtctgcgcacaggcatgcaccccagggtagtgcctgcagggatgcatgtgtccccgtgggggtgcctgtgccaggcaggcctcaggtgcatgccatgctcagaaccctgctgccctttctaggcagcctccttggggcccaagctctgctccctggatctgccacctagcagacgtggggagcctgaccccatgcctgtcatggaaccctccttgcctggtgtgtgtggctcccctcttcactgggcacctggatccaggcccacctgtgtccctgactcagggtggtcccaggactggcacctactctttagagagccccagcatctttgatgtggattggagacaattgcctggttccctggggcaggtgaagacttggtgccacaaagaatgccacagtggatacgccagcaggccacatggctggccaagcaattattattatggatcccttgggctgtgggccttcccatccaccccaccacaactgcccaggtagctggagctgatcataaacaagaaggctctgggcagagtccatggcaccagcaccagccaaggcccactcctgaagacccgaagcccagcccctggatgaaggtcctaaggtcctgaggactccccagcctgtgcaggcctgcaaacccaggctgcccacaacagaaggggctctcggcttgtctggcctctctggcctcccaagcaggtgtgggagggcggggcaagtgtgggctgatcagctactccatatggccagggtcctgtgctggtgcctggctggggggctgcatagcctgcactgtctcctccaggctgcccctggggaataccacgtagtgtgtggagttcagccctggcagctcccgctggttctccttgctatgccggatgccatagccgaaatacactgcaagtcctagacagggcaggaggcagggcatgagcctgaggtacaggttccagcccttcctgtcctctttgccctcctcctgaccccggtcccagcctggcccccactcacccatcagcagccagatggagaagcgcacccaggtcagatagctaagtttcagcatgaggcagatgttgaggacgatgctcagggctggaatcaggggaaccatggggatctgaggaggcagaggcagggcagggctgggccgggctgcaggaaagatctgccagcccagggctcactttctcgggaatccatagagcctttgttcctcacgggagattgtggagacatgtgctcactcaccatgcagaaaggggtgcgggatgggtgtgtggtcctccccagccccgtgagacttgttcattctgggatggtagtgggggaaggggaggcagctgcctgggccgagtgtgagtgggtgttggctaggggaggtacctgaaataagtcttcccgatactgttgctggtgagcccccaggacaaggaggctgagcagaaacatgacactggtgagcaggagcagcaggatgtaaccccagtgtgggaggtgcagggtcgagttcccaaagacaagcacgcagcctatggtgatggctgaggccaacataacgccaagcgcccaagtcaccactgctccagggctgtacccatccaagaagcccaggtagggcctcagggctggcttcagctcccctggctcagggacggaggcgtgtacagtgcccaccagctgtaggtggtctgagaaggagctctgctgcttggtcagggggccagggctggctgggcctggggagctgggcggggaagacttctggaagcgcagcacaatgatactggtggccacgaatgtgtaggccaggagtgtgccaagggacaggaactgaaccagcgactccaggtccagcagcagtgccaggaaggccgtgaggagcccgaacgccagggtgcccgccacaggcacctgtgtccgggggtgcacatgggcaaacacctggaagaagagcccatcggcggccatggcatagacaatgcgtggcagggagaagaggaggctgagcaggacggtgttcatggctgtagcagagagagtggggagggtcagcatggcggagaagcccaccaggggcctctgctgggggtcggtgcatgggtggctccttgggaacaagggcatgagcttgtctgggctctcagagtaagcatgagtttgtgtaggagtaatagattgtcagcgctttgcccaagaacaggacatctgggttaggtcacaggcccactggagcatcggatgagggctgagtccctctgcctaggaaataatctataaggacatgcccagaactaatatgctatggaccatgtgtggggcggtcccttccaaagtttctgaagaaactttttttgaagtgaagagtttctaataattagcactttccttgccccattatgcaactagtaaaacagccccagttgaaggtgcattccccaagaatctgaggacaaggtcccccttgctcttttccctgccaccctgcccaggaagagtctctcaccgcagatggagccagctgccacgatgaagccagcccacctgtagccccgctggtagaaggcatctgcaagcgctgagtcggggtccaggctgtgccagggcaccatgagggttagcacggtggagacaaggatgtaggcaccagctgcaatggcaagcgagatggcgatggccagaggcacagaccgccgtgggttctgggcctcctcactggaggcggcaatgacgtcgaagcccacgaaagcatagaagcaggaggcagtgccggccatgacgccggagaagccgaagggtgcaaagccgccttcgtcagcgctccagttgtgaggctgggccaggatgaagcccaggatgacaatgaagagaatgacaagcaggctgatggccgagaaggtgtgattgagccaggaggacacgcgggctccacaggagacaaaggcagaggccaggaggatgatgccagcagccaggaagtccgggtagtggcccaggaggggcacctgccaagaacccacgtgggtctcagtgaagttgcggatgctgtggctgaacatagagtccaggtagccactccaggcacgggccacggcggcgccaccgatgatgtattcgaggagaacattccagccgatgaggaaggcccacagctcgcccatggatacgtaggtgaacaggtaggcagagcccgtgcgtggcacacgtgccccaaattctgcatagcatagggctgccagcagggaggccacagcggccacaccgaaggacaagagcacagcagggccagccacctccttggccacggcacctgtgagcacgtagagacccgagcccaccatgccacccacgcccagaagagtcaggtccagcgtggacaggcagcgccgcagtgacgtctccatggtggagtcctccagcggcttcaggcggttcagcttctggcataagcgtgccaggctagcaatggtgggcagcccccgggccatggcaggtggccgagaagagcaccgagccagctactggaacctgctagggccagaggggaatgacaggatgcgtagccggggcctgaccagccttccatccctcctggtctgaccacccccagtcctctctctgtccctgacctggggacctggacaccctcaccaggggcctgctggagagctggaatggggcaggtgtcagaacctgtgggcaggaggtcacaggaagcctggaggccctgtctgcatcccaggcagcaaaggaggcctggtgaggccccacctgctcacccgctcggtggccctgaggggtggggagggagcagctccagggggagcagggtgagaggctgggaacggctcagtggtggggtcccagagccaggtgaaaccgaggcttccccagagtcgagccggacccggaacaggagccgcggctctgcgtcggggcgggtgtggcccaggcagccacctggccacagacagacagtggcggctacatacacccccgcccctgcacccgtggccaggctggggtatccgcgcgccaggcggaatgcaggggcgccctgggcccgcacacctccccatgtccgacacgccgctgctgctagagcctgctccgccgcgcccccgtccccggacacctgcgccttcgcctgttcttgggcctgagcccgtcccagtccccgtccccgcaggatctgctgcaacccacctgctgctgccgcagccgctgcctccgctctgagcactgagcccgcccagttcgccggcgccgagcgcagggcccgcccccatcccaggccccccgcgcggccccacccgctgccacacacccagatatttcaccctgcccactctgcccgacctcgcaaggtcgttaccggagctcaccggggtctagggaagccctgtgactgtgactcagtcacagatggagaaggtcagaccgccggctgactgactagcctaggtcagttcggggaggttaagggccacgtctgaaagtccgcagcccaccttctttctactgcagcggacacccttcttgatccctcaccccagtacatgaaccccacccagctgggccccagacaggccccacagcaccgtcatgtgagcttcaggcacagtgagttagatgaagacatgggtctggcagagtggcctggggcggtccctgacctctactcttacaatggaagagactgcagccttttgagagagttctgcgaattgagggaatgcattctggctgttttgagcctgcagctaccacgtcctgcaaggaagcaagcagcttctgggaccagcctgcagccctcctgtgggggagtagagctcctcagaccccagtggcagcccttcctagcctaggcacctctggcaggccgggagggccctatgggaccccaatagcagatccccacttgtgtttatcagcgacagccactgtgtcctgagtactgcattccagtgccccacgccccaggcaggcagctatgcaacaatacacctggctaattttttaattttaatttttttagagactgggtctcactatgctgcccgggctggtctcgaactcttggcctcccaaaaggctgtgattacattcatgaaccatggctcctggcctccccagaacgctatactagacatgtgttcaggcttacatgtggtttgtggaatggaatcttaggagcatctgcagcctatccagcctattgggctggtgacaggatgatggactcccagacaagatggtgccaatttggaacattctgcctcggccagaatgccaataccttctaatatttggctggtattgtcttgaggaacttctcagatggctcccacttccggtgggatggtagcttccttaccccatccctgtgttgcctgagcagacgtcccttgtcctgaaatgtcaccacaaaagtctaggcacttcaggccagagggttaggcagatttgtaatgggagctccccaaaggccttaccaatgactgccttattgctggtgtccagtgttttggagtgttgactttttatctacctggagaaggtgtgacaccacaccctctgccacaggcaccaacatacaacggatatgtgagactaagcagggctgatgcagtaaattgtacatttccagagatatttccctcactactgagtgagacagctacacagagcaaccccacagtgatgcagtgaagacaaaccaccaggaaacaaaaactttctaactcattctgcaaggccaggattaccctgacactaaactcaacaaagacatcacaagaaaagaaaaccacagaccaaaatcccttatgaatatagatgtagaaatccccagcaaaacacagtggactcttgaacaacacaggtttactaatacatagatatttttcaaccaaatgtcgatcaaaaatacagtatttggctaggcccagtggctcacaccggtaatcccatcactttgggaggctgaggtgagaggatcacttgaacccaggagtctgaggctgcagtgagctatgatcctgtcactgcacttcagcctaggtggcaaagcaagaccctgtctccaaaactactaaataaataaattaaaataagtggtgggtgcctgtaatcgcagctacttgggaggctgaggcaggagaatcgcttgaacccgggaggcagaggttgcaatgagctgagatggcgccattgcactccagcgtgggtgacagagcaagactctgtctcaaaaaaaaataaaaaacaaaaaacaaaaaattcatatggaaatgcaagggatccagaatagccaaaatacttgggtattttgcctgggtaacatagggagacctcacctctacggaaaggtaaaaaaattatatgggcatggtggcatgtgcctgtggtctcagctactgggagtcgggggtggtgttgaggtggaaggatttcttgagcctgggaggttgaggttgcagtgaggcatgtttgtgccactgcactccagcttgggtgatagtcagaccctgtctcaaaaaaaaaagaaaaaagtaaagaaagaaattaaaggcaacataaataaatggaaagacatcccatgttcatagactgtaagactttaaatataaaatggcagtattccccaaactggtctacagattcaggggttgcatagattgagtgcaattcctattgaaatcccaactacctgttttgcaaaaatcatcaaaattcatgtggaaatgcaagggatccagaatagtcaaaatacttttgaaaaagttttggaggacttacaattcctgatttctaaactgattgcaaaatgactgtaatcaagattgtggtggtgacataagagtagacacatagatgaacggaatagaattgacagtccacaaataaacagttacatttatcgtcaagtgattttttaaaaatagactttattagctgggaatggtggtacacgcctgtagtctcagttactcagaaggctgagttgggaggatggcttgagcctaggaggctcaaggctgcagtgagcttgatcatacctgtgaatagcctcttcactccagcctgggcaacatagcaagaccctgtatctaaaaaaaaaaaaagttgagttttcagagcagttttatgttcacagcaatattgagcagaaagtacagttcccatatacttctgctcccacacacgtgtagccccctctcccactactgacatccagcaccaaaggggcatatttgttacaatcgattaacctacattgacacatcattatcacccaaggtctatagtttacattagggttcattcttccggttgtacattctatgggtttggacaaatgtgtaatgacacatagacacaccattattgtatcacacacagtagtttcattgccctaaaaaccctctgtgctctgcctgtccctccctgctaacacctggcaaccaccgatctttttcctgtctccatagtctagtcttacttttgcagaatcttatatagttgggattatagagtatattgccttttcaggcttctttcccttaataatatgcatttgagattcctctatgacttttcatggctgaatagctcgttttaattttattttttatttttgagacagagtctcactctgtcgcccaggctggagtgaagtggagtgatcttggctcactgtagcctctgccttcaggattcaaacgattctcatgtctcagcctcccgaatggctggggactgcaggcgtgcactgtcacaccaggctaaattttgtatttttagtagaaatggggttttcccatgttggccaggttagtctcaaactcatttcctcaagtgatacacctgcttcaacctccccaatgtgctgggattacaagcgtgagccacccaaccaggcctgtgctatttctaaaatgcaggagatgaagttgccatgtgaaagatgcaacattcttatcttcaaggatgagaagttgaaatgagagaattctatacagaccttgttaaaacactgttatcttttaagcctccccatataatttagttgcctcttcataacttattattatttgtccaattcagtgtataagtaacagactctaacttcttctttgggtcttcaaatgtccttatgagggttcccaacccatgtaaaacttgtactcaataaatttgtgggactgtgtggtggctcactcctgtgatcccagtgctttgggaggccgaggggggcttgcttgagtccaggagttcaagaccagtctgggcaatatagtgagatcccggttcaacactttttttttttaattagattggtgtggtgggtggcatgtacctgcagttccagctactcaggaggctgaggtgggaggatagcttgagcccaggagtttgaggctgcaatgagctgtgatctcaccactgcactccagcaccccttatttataaataaatataatggctagccttagggactctgttcgcaagattaaagaacagaaatcagatgtagaatagcatataaataaatttatgtgcttttcttctgttaacctgtcctatgtcaatttaattcttgggcccagctgagactctagggatggaagtggagttttgccacccctacagtttctggtgacaaggatgggatcctctcaagcctaaagatgggatcctgggagaacaaataaaagcgggcacaggtaggaattcttaccaaagtgaactctttttttttttttgagacggagtctcgctctgtagcccaggctggagtgcagtggcacgatctcggctcactgcaagctctgcctcctgggttcacgccattctcctgcctcagcctcacacgtagctgggactacaggcacccgccaccacgcccggctaatttttttttgtatttttggtagagacggggtttcaccgtgttagccaggatggtctcaatctcctgacctcgtgatccgcctgcctcggcctcccaaagtgctgggattacaggcatgagccactgcgcccagcccaaagtgaactcttctggatctctgtctgtaatgcctggttgaaagaggagagtaaaatttttccttgtccctttctaaattcaaactggcaggagaaaagcatggtaagaattgattctttgagttatgactcttatgtcaaccttaaataatgagattcagaaaatatcagctaggcacgttggcttatgcttgtaatcccagcactttgggaggccaaggtggaaggatcacttgaacccaggagttggaggctgcagtgagctataattacatcactgcattccagtctgggtgacacagacctagtctccaaaaaacaaaaacaaaaaaaaccaaaggaaatatgatttttattctagtgcaaagcttgaggatggacacccaggaaacagcttccaaagggttggggtcattgctccaaagtggggaagctaaggtttcactcatagaggcagaaacagtgtcagcaggattgcaacatcttctgtacaaatccagtatgttagattccattagtacagcttgctacattccaaggaaaattgtttcaacattctgtgagaagaagtcaagctctgaggtcatcttatctctgatgctgctcagacatttctaaccatttacagggaaaagcagaagttgcaactgcatgctccatgcctcaggccacatggccacattcctcctgaggctcataataatgtaaagttccaacagcttggtggtggctcacgcctgtaatcccagcactttgggaagctgaggtggctggataacttaagaaaggagtttgagaccagcctggccaacacagcgaaaccccgtctctactaagtatacaaaaattagcccggcatggtggcgggcacctgtagtcccagctactcaggaggctgaggtgggaggattgcatgatcctgggagtttgaggctgtagtgagccatgattgcagcactgcactccagcctgggtgacagagggagaccttgtctcaaaaaaaaaaaaaaaagaattatttgatttcacacttccgaatttggtatttggctctgcatacatagtggctattgacccacagcctcccagaaataaggcttgttttccatgtctctgttgtgtggtttatcatatcttgttttatgtcttgagaacatggctctgtgaccaattgaaatattctctttggtttctgccagctgcaggggttgggaggacaagtccttgttaggctgctagccagctgcccaggaatcagaaacacagtgtctctgtccaacggttccagctctcagaggagtttgtcctacttgtctcagctttcattgccttgataacaattaggatatttgcctgcttaggctatcttgaaaaagactttggatcttgagggggattgtatcttttccagcctgtttgggatgctcttctgtgcctccagttaagccagaaaaggcatactgattttaagccataaaaaggcttattggttttgagtcacaattaaagtaggtataacattgaagatttggacttttgaatctaaaagctttttttttttttttttttaagacagagttccgctctgttgcccaagctggagtgcagtggtgcagtcttggctcactgcaacctctgtttcgtggattcaagtgattctcctgcctcagcctcccgagtagctggtattacaggcatctgccaccatgcctggctaattttttgtatttttagtagagacggggtttcaccatgttggccaggctggtatcgaactcctgacctcatgatctgcctgcctcagcttcccaaagtgctgggattacaggcatgagccactgtgcccagcctaaaagtatttttattaaagcgtgctattggccaggtgtggtggctcacacctgtaatctcaaccttgtgggagactgaggtgggaggatcgcttgagcccaggaggttgagctgcagtgagctatgatcttgccactactgcactccagcctgggcaacacagtgagaccccatctgtaaaccgtccccccccacaaaaaagggtgctttcatcccaaacaaccgtcctattggtaactagagaaatatcaaattaaaaagaagacacaaagaaatataggccaggcacggtggctcatgcctgtaattccagcactttgggaggccaaggtgggtggatcatgagatcaagagatcgaagccatcctggccaaaatgttgaaaccccatctctactaaacatacaaaaattagccgggcgtggtggcgtgcgcttgtagtcccaactactcaggaggctgaggcaggagaatcacttgaacccaggaggctgagtttgcagtgagccgagatcatgccattgcactccagcctgggtgacagagccagactctatctcaaaaaaaaaaataaaataaaataaatatggttagctttagggacttcctttaatcttcctcaatattaaagaacagaaatcagatgtagaaaaaaagttgaaatctgcaccctctgtaaattatcctcctccacccacctgtgctctgctcaacccccaagtccctgtccctgatcccccagaaggtctttcggatatctgggcccctgacttacacttaccctcctcaaaacttggccctattctccttagcaaatttcttttagacctaaaacttctccaaatatcctttcaatgcccagctgcctactttaacttctcttttcctataaaattcacagaaagcaccccagcctgttttccaggcccaagatatacaggtgacatgtatatactgatagccagaaaatagacctaacacaggctctgggaatgagcagccaggcttgcttcactgtaccttacaattcctcctacttcctggggctctgtaatcaaatctcatcagctccaggcattcccatgtttaggccgaaaccacaaaaaagtctactggactatcgtactcttaggaaaaagaaaccataaaaattaccctagatctctgataacaaaaaatatgctctgaaactccttggagaaaatctacattctttctcagttttcttgctctgtcgccagtcttatcatatctttaaaacttaagggccaggcacagtggctcaagcctgtaatcccagcactttgggaggctgaggcaggcggatcacgaggtcaggagatcgagaccatcctggctaacacggtgaaaccccgtctctactaaaaatacaaaaaaattagccaggtgtggcggcgtgcgcctgtagtcccatctgctgggaaggctgagacagcagaatggcgtgaatccgggaggcggagcttgcagtgagccgagatcgcgccactgcactccaacctgggtgacagagcaagactctgtctcaaaaaaaacaaaaaacaaaaaacaaaaaacacaaacttaagtatctgaggaactgggctgggcacagtagctcacgcctgtaatcctagcactttgggaggtcaaggtgcgcagatcgcttgaggtcaggagtttgaaaccagcttggccaacatggtgaaaccctgtctctactaaaaatatatatatataaaaattatccatctgctggggaggctgagacagcagaatggcgtgaacccgggaggcggagcttgcagtgagccgagattgcaccactgcactccagcctgggtgacaggacaagacaccatctcaaaaaaaaaacaaaaacaaaaacaaaaaaaaacttaagtatctgaggaattggctgggtgcagtggctcatgcctgtaatcctagcactttgggaggtcaaggtgggcggatcgcttgaggtcaggagttcgaaaccagcctggccaacatgatgaaaccctgtctctatgaaaaatatatattaaaaaagttagccaggtgtggtggcatgcacctgtaatcccagctacttgggaggctgaggcaggagagaattactggaaccactcgggaggcggaggttgcagtgagctgagatcatgccattgcactccggcctgtacaacagagccaggctccatctcaaaaaaataaaataaaataaaataaaagaatctgaggaattaactagaacaacccccagtatgctagtctgagattaaaaaaagtgttgaatgtttaacattttaggtgctttacttcaataatgtttgatatttgcctaatatatatgtcataaaaattgccagcaaaataaaacttaagataataactagctttgtctaatgtttcatgaagttttcacaattcagatataattgttaaataaactaaacttatataaatgcaagtgggaaaaaatttgtaaataagttattattattattttttgagactgggtgttgctccattgcccaggctaaagtatagtagtgggactgtagctcactgcagccttgaactcctcttgccccagtatcctgagtagctggggcaatgcctggcaaatttttagaaaaattttcttgtagagtggagtcttgctatgttgcccaggctggtctcaaattctgggcctcaagcaacctcctgtcctggcctcccaaagtgctgggattacaggtgggagccactgtgcccagctataaataattttttactgttttaatttttatttttgactgactcattgctagccagagctcgggtttctgtcacccacagcctgggaggccttaagtaagtgattcaacctcactgagcctcactctttgcctctgaaatggggatcacaggaattcctgccaggcaggggatatgtgaagactgaacgaaatgattcacacaaagatgtagcccagtgcctgggggacactaagcacatgctgagccttcagccacctgggaaggataaagggaaacacgggtggccacctggggctgatggaggaatgaggggcccgctgggagtatcctgggcaaactcacctctgggcatctgccctgatcttgggctggcgtcacaaggaagttggtcaccaagaagaacacgttctctccctaggaggcaagtctcaaagttggcctggctgggcttgcattgactggaaaggccagaagccggcagcctggtttatgagggaagggatgttggccccatgaaatcattaaccctgtccccacgtaaggcagattgaagcagagatgggaggctggcagcagttctggccatttctgagaccatgaagcctcatgcccatgtccatctcttgagacaagtttctttctcatttgttcaaccaaaatatcttttattttctttcttctttatttttttttttgagacagagtctcactgtcacccagactggagtgcagtggcatgaactcggttcactgcaacctctgcctcctgggttcaaaggattctcctgcctcagcctcctgagtagctgggattacaggcgcacagagtttcactttactcgtccaggctggagtgcagtggtgtcatcaacccttactgcatcctgtaactcctgggctcaagagatcttcctgcctcagcctcccaagtagctgggactataggctgtaactaccatgcctggcgtcaaccagaatattacgacagcctgctgcttctagtactgaagatccaggggagagctgggccctgcacctgccaggatggagtggaggtgagtctcccatcccacacacagcagcactggcatggcagggcacaggtgagaagacagaaagctctgcctgtggtcaaagggtggccaaggatgttggaaggggaggctgaccctccagtgctgcccatgagaacactgaatttggggaatgcatgcccaggaacggaaggtgagggctgtgcagagggtgctgagagtggcagccattgggattaggagggatgggtggccactatcattggcggggggcctcctgagggtagaaacaggggctgcaggctctcatgatgcctggtgtgaaagttcagcttggctgctgtgtggtgtgcaccaagcagtagggaggaggcgagaggggcatctaagggccttctaggaggccatagtctcatgcaggcatggcatgggcagtagtgaaaaatgttggaagggacaggaaggggttgaggctgagtcatgggtctggctgaggcactagtggatgtcacagccatcatgactagtggatgtcacagaggccatgccaggagagggaaataattgatctttggacatatgagtgtgcacctggaagacagctgtgctctgggcaggtgttcactggggctacatacaccctgggaatcagaggagcagaggtgggtggaagttaaggctgtggataagctgggtggagggaagaggaaaatgcagctgagaagggtggaggaggagcacctgaccgaggtgccccaggtcagggagcagggctacaggaagttccacgccctggccccaccacacccctcccacaccactctcaagctcaagccattagtctcaaacactcccttcttttctgttggcagccttcggaaatgcagtttctctggcctggtttctcaacccatccctttttctaccagaaacctcctacacatccctgaaagtcctgttcaggtgccactcctctgtgaagcccttcctgagaacctgcagccacctttggcatcacatgcttctctctcgcacacactggctgcatggcgggtgttcaagctgtcagtggggaaaggacttgcgcccccgtcagcaacatcagggcccccacctgaggtggcttcacgaagtcggccacatcccacagccggtttccaagctccttgatctgagtcacggaaacccctttgagtttggttgtgatggaaatctggggttccaggtcccgctcctggtagccttttttggcgaggagcgcccacctgggaaggagaagatgggcagtgtggtgtccccccagcgtgtagtgacggggcagagctgggccctacatgctcagttctctccccacaccctacaggctcccagtccagcatcctctctggccccacttcccactgtagactccctgaacgagacagaagctccagccatgcatcagagagccagtgccctcagacaatcaccttcactagccagcacccacccccagcctcagtagacccagctccgagcttatagactcccctgaccggagatatagctggtggtctctctgggggcctagtgctccagctctcacagatgttaaggacaatgtcttgtgccccctgggtggggccgtggggagggactgggaagcaggcaggtggacacacaggacaaacacacagcttgttcttgctctcctgtcttgtattgcctacctcccaccccgtcccattatggccccttcccctccagcccctaaacagcccaaccctcaacttcaacccagcaggaccaagccccacccccgacctcttcccttgcccctccagcctggccaaaagctcttctctcttaccctaccacatagacgacgatcccaaactgcagcagcctctgcagggcgcccccccaccagttcctggtcatcacatacttctccgttttataatccagaagcccctagtctgctgtggcccctggggagcccatgctgccagctcctgctagctgcgggcacatgagtcagcatggcagctgcagccgcagctgaacaggaggcaaagcagggcccgagccaggccacgccagccgctgttaaagggacacttccactaaagcaggatccagcctccaacacccagccttcagcccctaaccccagctgccctgcacctcccaccctccctacattctctttgctgggccctggtggcacacagaaaacagcagctctgtccctgccctctggcctcacttcctccggtgggagtggacgtggtgagaggatggggaaggacagctgttatcagtgctgtgagaagacggcctgagggcagcaacagccccgggggggctctgagtaaagcttcaggaataagtgacttctgagctgacgcttgcagattctgaagttcaacaagcagacaaagatggggatggaggttcccaggggagcgaacagcgtatgcaaaggccagcgcatgcaagagaactgagagccacagagtgagagggtgacctggctctgcgaagttccccaggccctcctgaaaagccattcccaagtgcagtgaagaaaacacaagctctggagtcaggcatgtttcccattccatgaaaggggggcgatgctggaaccgcctaggggaggcagggggataaacgcagcaaggcgcccaatccggtgcatggtctgtggcgcatgcagtgtatcagcccgggcgaggagcctcagcacaagccggccacagtttctacggcaaccgacaacaccgggttgccggggcgaccgccgcgggagagcgcgtcgctattggctgtggggggtgcctgttgctggacggcacattcggttggtcagcgcagccgcagactccgcccacaatcccgggccgcgctctgggcgcggggtcaagctgtctccgactcagtgtctgagactgcgagagggtcgtaaccatgaggggttcctgtgagaggtctggggaggatgaagagcagaaagaagaggctatggtggcctgtgggcgtctttcaggggtccccgaggccgagcagggtcccgaggccaattgggactccgacctggagacggaaggtgctcgggggagggggcaggcccgactcctcccctttgggggtcttctcccgcaggggttgggggaggcgggctggggctaaggccagcagggaacgtacccgcctgcggggcgcctccagccccctgccttcccttcattgctcctggaagcatcaggataaaatgcaaaatcccgccagacagtgcaccaagggctgtcccaccctgaaatgaaatcagagccgggttttcccaatccacaggaaaaactaagctaatggatgtatggaatttagaactatctcggttttttctcccgtaaaatgtttacaaaacatttgtggcctgcaatccaggttaaaagacacagcatgcaatttggcatcagacaggcagaggcctgactctggcaggattagctaccaccactagctgtgggatgctcagcgcaggccagccatgacttctactacaaacaacattgggttgcttgggctcatatttattaataaataaatatataaataaattatttatttattagagccagggtcttgctctgtcacccgggcgtcagtgcagtggcaggataatagctcactgcagccttgaactctgcactctagtgagccttctgcctcagcctcctgagtagctgggactacaggagaccaccacgtctggctaatataaaaattttttggctgggtggggtggctcacgcctgtaatcacagcactttgggaggcccaggcaggcagatcacctgaggtcaggagttcgagaccagcctggccaacatggtgaaaccccgtctctactgaaaatacaaaaaactagcccagtgtggtggtgggcgcctgtaatcccagctactcgggaggctgaggcaggagaattgcttgaacctgggaggcagaggtttcagtgagccgagatcgtgccactgcattccagcctgggtgacagagcaagagtctgtctcgaaaaaaaaaaaaagaaaatttgtctagctatgttgcccaggttgtccagctttcttttgatagccgtatgactttaaggaaaagatttgcgttgcctgaggcttgatgtcctcatctgtcatatgggagcagtggtcccaagaagcacaggaagcagtgcttctagaggcaaaacataggccaggtagtgacacagggcaggggaggacacaggtggctgtagctgtgcagggtccacattcgtccccctgtctcctgccaggcaccgatgggcttggagaactggtcagggacacactgtacctgaggtcttgccgggcccatagtgttgtgcccatctcctgctttctgcgccaagggagcgcccaagagctgaacctccggcaccgtggcctggggccccaggtaccactggagggacactgtatccaggcttacggggagaggcctcgggagacagcagccatgggagtgcccctgtgtctgtcccctacactccccagcttctgcctgtgtcagtcatgccctaccctccacatctgggagacagatgggattgaggctgtgacaggtggcgttaagggttgtggatcctgcaggctcctaacccgctggggggtcagggagagctgggggtggggggagaccttcacagagcctaaaaggagaagcaggtgtcacttaaaacaggtgggaaggggagggctttccagctggaggatgtggagtgggctgagccctggagcatgagccaggatagtggccagtgtgtttgctctgtctgtcccagggcgcccgggctctggcttcctcattgagctccaatccatatgtcaagcggctggaccttcgagacaatgggctctgtggggcaggtgcagaggccctggcaggtgccctgagcaaaagcagcagcatccatggtaggtgctgggtctggggcaggtgggcaggcgtgtcctccttttcctcagggatgtgcctccatcgttgaaagctgggccgtgtcacctggggcctgctggtgttgctggtggatagaagaggggcctcatcacaggagggggcatgtggggtggagttagaccctctgctgtgcagccgatgcctgatagaagtcctttcctcacccaccccacaccatcactcccctcccttgctggccagcatccccctcttcacctagcacatgggagactcccagtacctgaatgcaggatgggagagtccttccacacagagaggtgggagttgggcattgtaagaagcaggtaggcaatgtgggagtttgatggggctggatccaaatgccagttctgccactgaagagctggatacctgggcaagcagcttaacctctctgagcttcagtttctgatctgtgaaatggcccccaaaataccttatgggcttggggctgtggtgagcatgaagtgaaatgcactcctgaagtggtcagaagagtgtgtgacccatgtacgtgctccatgcatggccacttgggctattattgccaatcctggcaacggggctgtgagggcttctgaagtgggtggtgatatcactgccagatgcagccatcgacggtatagctgccccccaccacagcagtctctacagtaccaggaggtaggcggttttaaccacttgacacagaagctggtgggcacacagggagggggaggtcaggggcagaggggacccagccattgggagccagagccaccatgcaaccccaggacagttaacctgtaagtccccttcctcagcctcagacctggaggtttgggggatggcagaagtaggggagtgcctggctttgcatcccactggccgaggagtggttctgtcccccagatgtggacctgtcggagaaccagctgggagtggcaggagcccaggccctctgtgccgccctcacagtgaaccaggccatgcggaagatgcagctgtcagggaatggcctggaggagcaggcggcccagcaccttgccgaactcctgctggcccacacagacctgaagtccctggacctgagctacaaccagctgaatgaccaagcaggtaacgcctgcgcagggcaccatggccatgaaagctcagcttcctggggcagggatgggtgggggttggcaggaccgcgctgcacatcgccagggagcatgtgctctggttcctgctccccacaccccaccttgccccactcctcttccactccagccacacggaactcttcattccttccacaaatatctcattgcgcgctgctgtatgtgctgggcactgacttagccaccagggatccaccttgaacaaaaccaagttcctgacctcaagggacaatgttaacaacatcattctgagtaattattggtgctacaaaagaaacaaatagtttatgattctagagaagaacagggaccccctactttaaagaggtggctggggaggcctctgtgaggtgacatttaagctgaaatgtgcagggtgggaaggagtcagccatggcaagatcagagggagagcattgcaagcagaggaatagtgagcatgcgggcctgtttcccagactggcggacagcagtgtgcctaggctagggagccagggaagcgtggccaggctgtggggtggagagggcagagggggctgcagggctgtaggccgtggcaaaaacggtgaagattttgtttcaagtgaggtagcggatgtgattgggattccttgatctcatcactgtcatgcccctgagcatattcaggagctgtctgctttgccaggaatttgcacttctacctgcctctcctcaaatggtccaataatggtaaggatcacctgagaccctgggttaggcatgcagatgctgaccctggacctgctgaaccaaactcttaggggaatgctggtgaatctgtattttaatggttgccccaggagaatcgtctttttattttttattttttgagacagagtctcgctctgtcacccaggctggagtgcaatggtgtgatctctgctcactgcagcctctgcctcccaggtccaagcaattctcctgcctcagcctcctgagtagctgggattacaggtgcgtgcgacaaggcctggctaatttttctatttttagtagagatggggtttcaccgtgttggtcaggctggtctcgaactcctgaccttgtgatccgcccgccttggcctcccaaagtgctgcgattacaggtgtgggccaccgcgcctggccgagaattgtttttcagaagcactcctctgtctccagctgcttagagcaagtggggtgacatcagccttggcctgtgagaattgcctctggcatataactgccagagaaccagtttgccttctaagaaaattattgcaagaagtcagtgaaattaagtgaggtggccgggcccggtggctcacgcctgtaatcccagcactttgggaggccaaggcaggtggatcatgaggtcaggagatcgagaccatcctggataacacggtgaaatgccgtctctactaaaaatacaaaaaattagccgagtgtggtggcaggcgcctgtagtcccagctacatgggaggctgaggcaggagaatggcatgaacccaggaggcggagcttgcagtgagccgagatagcaccactgcagtccggcctgggcgaaagagcgagactctgtctcaaaaaaaaaaaaaaaaaaaaaaaagtgagacttggcaaggcactgtgcctatctgtaatgccaacaccacttcgggaggctgaggggcgaagattgcttgaggccaggagttagaaaccaaactgggcaacatagggagccccagtggtgacaacaaatgattaaaaaaattagccccgggcaacagagcgagactccgtctcaaaaaaaaaaaaaaaaaaaaaaaaaattagccccaagtggtgacatgtgcctgtagtctcagtcaggaggctgaggtgggagaattgcttgagcccaagatgtcaaggctgcagtgagccgtgattgtcccactgcactccgggttgggcaacagggtgagaccgtgtcttaacaacaacaaaaaatactttctttcctctttagtgcctgtttccctgttatgatgttaaaagcaggtactgtgatgtgcagctggtttctggctcttctgcaggcgctttcttgtgtgtataaatgttcgctttggtgttcctgtgagggttgtaggatgaccgctggagggttctgttcggccatgttgctccgccttcatctctaggtctcgctattttgcccaggctggtcttgaactcctggcgccaagaaatccttctgcctcagcctcctgagtcgctgggaccacaggctcacaccactgcctggctttcaccttcctttctctaccacccccatctcctctctaccacagctgtgccagccctgttgcctcttgcctagcctatggcaccagccttccatctggtcccccagcctcttgcctctgcccccacccagcccagtctatcctggacacctgccacttgctgaaatgctaatccagcctcatcacttcctaaggccctccctgactccttgccacttgtatgtgctgcctaagccccttggcttggcacacaaggcccctcagcatctctcaagtgcccattactccttcctcacctcactggcttccccctccccaggcccagctccaagcctgcgtgcatttccacaggtgcctctgccatttgcagtttcctgtgtctcctccccactgtgcataagcctgtgtgcatttccacaggtgcccctgccatttgcagtttcctgtgtctcctccccactgtgcatgcacacacccctggggaattcctcagtcctgagttatctcctctgtcctctttcctgacttcccccaagacaggctggccaccactctgttctcacgcctcccccttttagtctaaatgaatagctcacatcccatacatttgcatttgtatctcccccatgaaatgtgagttccttaagggcaccgcaggcccacattagtttcatgtctgtgaccctcctgcccagcagaggctcggcacgcagtgggcatcagtgtgatcttttgaaggagtgaagagagtgagtcagaaggtctctcttggtgtttctgaaggggagacacttggaccagccctggcagaaaacacaggactcaccgagcttaacgtgagctggaatcacctccggggcccaggagctgtggcatttgccaggggactggaggtatgaagcccccacctagtcggccctacagcctgtctgctggggcctgtctcccaggggccacctccctgtctctgcagctcctcggaaatgaaccttggatcttttaagcacagcttaaagactgtttctttaggtgattttaattttcctggcttcacttagtgaccacaatacactgtgctcaccgtcacatactttcctgaagggtcactgttgaatatcttgcaccttccccagacaccatagacacccagctgggaagggacatctgtgcagtctggtgacacatgctcactgttgggcatacgcaggtggtttcctgagatgacaccttgcacccttggatgccagcacagcctctcaaacacccacctgttcccttccatgttgtggttcatagggctcgggaatgggtggctcaagctggtgctagggtggtacaaggtgtctgcaatgtccccagtgccagataccctgtggggccctcctcaggccatggcagctgctgtcttgccctgatgcaggggctgaccttggggtcctgccccacaagatggcatgtcacactctgtcttgccagagcacctacccttctccccatcacagtacgctggacaggtttcatccaacagctgttcactggatcttgggatccctgccctctagagccattaagtgggtgtggagtccgatcaatgtttctggggcctgctgctgctctgcacacgcccctcccagtctctctgagggccattcacgtctacaccggtcctttcctgttgtgctctgggccactgggctctgttgaccaccatcatccaagctgcagccaccagggggtctgcatggcactttcctgacccttccttggagcctctccccttctgccctttatctcttatctttgcacctcagggctcctggtctctgaggctgtggcaccctggcttgctccactgtcagatggggtcccatgacttcactctttggtattctaggcaaacatcttccttaaagttctagacatctcatacaatggctttggggatcctggagcctctgcggtgggtgaggctctgaaggccaacaacgtgttggaggaactcaacatgaggtgaggatccccggggggacaccccaggaatcatgggctccatgatcttgctgctgaagcacacagtctacccgtgatggggattcccgtgatggggcttgagccacaatcccagagcagctctgtcatccttatcactggagtttataattttatttatttatttaaaacagcatcttgctttattgcccagggtagagtgcagtgctgtgatcatggcccactgcagccttggccttcccagctcaagcaatcccaccacctcagcctcccaagtagctgggactacaggagtatgtcaccaagcctggctaattttttcttttttgtagagacagtctcctgctggccttgaactcttgggctgaagcagtcttcctgcctcagcctcccaaagtgctggaattacagtcatggggagttcatcgttgttacatagagacctgtgattcctatagcacaggcggatggctgcgaattgcacacggtgtataaagcatctccggcagagcctggtgcatggtgggtgctccatgcaagctttcctcccttgcagaagacgagccagggccaggttctgtggctcacaactgtaatcttagcacctaggaaggctgaggcgggaggatccattaaggacaggattttgagaccaggctaggcaatatagcatgactccatctctatgcgaaatctaaaaattgtccatttccggtggcatacacctatcattcctggtacttgggaggctgaggcaggaagattgcttgagccgaggattcaggatttcaggctgcattgcaacagagcgagtaaaacgagcctagtctgggtggggcaaggcaggaccctgacaagtgggccccagtgcctgttttgctcagcatgtggctactggagcatgccctgtgtgaggggctcctccaggccaggcagcgtcccagcctagccaggaggcacaagcccagagggaagaaaagaggcggatgccagggaggtcacgggccagaggccagggaggtcatgggctgctgtggctgagaccctccccaggggcagctccctgtgggcaagaaggccccactcaatcctgcccagctttcctccccatgggaggagctaagactggaggcagccgcggaggctgaatacggaggtgcagccagagctggggtctgagaagtcagagagaagcgggactgactccggagacaaagtggtccagggcggtgctgaggactggagtttgggaacggcaggaggaggagaggccttgaacataagctaggtgattttctggaacaggcgttgtaatggtgataggcatgaggtgtcagctggggcagaatatgtgggagcacttgcagagctcagaggagcggcagctggtgtccaccaggacagggacgctttaggtgtgtttgccgtgtgattcctctgaacggtgtcatctccaccttttacctgttgatctgtccagggttcctggggtgtgagtggagggaacaagagacccaacctggtggctgcaatggcagctccagtgggcaccctggggcagtgggctctgcaccgctgcttggaaggttgcacaatgcatgtgcctgttgtttttgttgcagtaacaaccgcatctctgcgatgggagccctgagcctgggcctgggcctccgggtcaaccagacgctgaggattcttgtagtgagtgctagcctgatgactgagacaccagcacagacctgccctgtaacagtccacacagatccctcccccacagcccccacccaggggcagcaggcaggtgcacacaggctggctcactcccttgccactcaccctgaatctggggcctggccctcctcttctccccttcatccctcccagcctctctcccacatcttcttgctgcccttcctcctctgtgggctggggtgctgctctgctgaaggtggctgggcaccccttgtgtctccctcatcttctcccctgcctttcctctggccttgctgagacccaggccccacccaggtgttctgttggccactgctcaggcccacctgaggcctggtgttcccagctggggttccttcccctgggtttgcaggtggggagggagtgctgagcaggacagggagcagaagacagacacaggagggaggcaagccgggagcaggtccccaggggaccactgtgcccacagcaggtacgtgctgggggacagtattgccagctgggtatggacatccagctctgtcggccctcagctccccaccctagccttactgggcttctcccatagctctcctcccctgcttcctgcctcacaggaacctggacctctctgaagcatagacctgcgtttcgagtcacctcgtagacagtcctctaaatgtcccaaagacacgtgggaatgtgagagtccaacctgaacgcatacccccctctaagggccacctcctggtggggggctccttcttccttcttcccaagtcaccagctggggcccagagcctgcctgcccctcccttttccacaccctccctcccaccttctgcaggggctcaccctgctgactcctccctcttctgacttcctctcttagcttctgtgaacttgcgggattcctggctgcggttctttcttcccagctgctacccaggaccagaaacatgccctgctttaaaactgttggagttttatcccctctggataaacccaagctttgagtgcatcatgtcatgcggagctaggtgtggtggctcacgccaataatcccagcacttcgggaggctgaggcaggcagatcgcttgaggtcaggagtttgagcccagactgaccaacatggtgaaaccctgtctctactgaaaacaaaaagatgagccagatgtggtgatgcacacctataatcccagctactctggaggctgaggcaggaggatcctttgaacccaggaggtgaaggttgcagtgagctgagatctcaccactgcactccagtctggatgacagagcaagactctgtctcaaaaaaaaaaaaaaagtaacatagcatgtcatgggggatctgggctctgccagcccctctcttccaagttcagtgctctcaccccaagcttggagcacacacacacacacacacacacacacacacacacacacacacacggtactatttttcacccctgcctttgttcctctgctgttcttgctgaagtgtccagctccggccacctcacctgggaagctccgctgagccctgcccagatacacctcccctcccagcctttccctcccaggggagctggtgcacactcactcactgcgctgatcacaccacatttcatgatgcttcctttccctcccctctccccagcaggcaagttcttaaaggcaagggtgtgtcttgtgtgtctatatcaatcggaggcctctcccttcctttcttccctgacccagcagcctcaccagagcattctgtctgactatctgatggagacaccttctgagccgaaacagtgtggccatagtggctgtgtcctcagagatgaggagcccctccttccctttcacattgctctctggccttcccggacctggcttctcgcagctttgtgtgcgtgtttctcaggtgtccaggaatcccatgcgaagtgaaggctgctttggtctcctcaagtctgtccaggacaatccagcctctgccctggaactgctggatttctcagtaagagcattttataaacctcgtttctgatcctcccagcagccctgtgaggtatcataattttagaagaagaaagtgagggttacagaaatcaagagccctgcccagttacacagcgtggcagaagcagagttgcaacgggacttgaatgcaggcatggggccactcagctctgcccgctccagactgctggttccacgggatctcacctggggcacctgcctgggttcttcattggctgagagaggataagtggaggtctgggcatgatgctccctatccactgaggtttcgatctgcaggcgcagcacctgcaaggctgccctctgcccctcccctgactgtctgcaggtggactgtggtgctggaagcttcacttgagtggctgtgagagagattaggatcccttttcattcaattttgccactttttttttgagtcagggtctcactctgtcacccagttgcagtgcagtggtgtgatcgtagctcactgcagtctcaaattccttggctcaagtggttctcctgtctaagctccccaagcagctggaagtacaggtacaggtcaccatacctggctaaagtttttagagatgggggcttgctatgttgcccaggctggttgcaaacttctgacctcaagtgatcctgtgccatggtctctcatgtcttgggtcaattttgattttttttttttttttgagacagagtctcactctgtcgcccaggctggagtgcagtggtgctatattggctctctgcaacttccggctcccagattcaggcaattcttctacctcagcctcctgagtagccaggattacagatgtgtgccaccacgcccggctgattttttttttttttttggtattttttttagtagagatggggtttcaccaggttggccaggctggtctcgaactcctgacctcaggtgatccacccacctcggccttccaagtgctgggattacaggcatgatccattgcgcctggcgaattttgatttttttaatgtagaaaaagtgccaggtgagatggctcacacctataatcttagcatgttgggaggctgaggtgggaggatcccttgaagcctagagttcaagaccatcctgggcaacacagaaaggtccccatctctacaaaaagctttttaaaaaattagccaggcatgtggcacatacccgtagtttcgggtactcagaagactgaagcaggaggatcacctgatcccaggagtttgtggcttcagtgagctatgattgtgccactgcactccaacctggggaacagggccagattctgtctcaaaaaaaaagggaaggaaacaaaaaaaattgagttacaaatcagtgctgattctaaccctgatttttttcaacccagacttgagtcaaagcctttccagaaatgtgtctgtgtagtttcaattcttcaggtttgggacaaccgatgtcaaacgtccttaccatttccttctaatggcctgttcttgccttaaccatgtgcctgctgctctgagaattcctgtcagcactggatctgtcattctaaaagaaatagaatgtcatatggcattatcctgcctgaatatacacttacttgtcacaatgtatggtcattatcagaagcccctagtcttgtgggaatgccatgggctttggaatcagttcagggttgggaccaaatcctgtgtctatcaatgtgagatcctggacaagattctgagtcaaagaatcataaacgatcaatcaataacaagcctgggatgggcatgatggttcacgcctataaccccaggacctcgggaggccaaggcaggtggatcacctgaggtcaggagttcgagaccaccctggccaacatggcaaaacctgtctttactaataatacaaaaatttggccggagttggtagctcatgcctgtaatcccagaactttgggaggccgaggcaggcagatcacctgaggtcaggagttcgagatcagtctggccaacatggtgaaaccctgtctctactaaaaatacaaaaattagccgggcatagtggtatgcacttgtaatcccagctactcaggaggctgaggcaggagaatcacctccaggagaacccagaggcagaggttgcagtgagccgagatcgtgccattgcactccagcctgagcaacaagagtgaaactctgtgttgtaaaagatagaagaaaaattagctggatgtggtggtgctcacctgtaacctcagctactcgggaggctgaggcaggagaatcgcttgaaccagaaagcggaggtttcagtgagccgagaccatgccaatgcattccagcctgggtgacagagcgagactctacctcaaaaaaacccaaaaaacaaaaaaacaaagaaaaacaattagcctgaattgaatattctatcttctattccttaactgttgttatctgttatcactagtataatctgactagcccagattttattctgagctttgagggaaatagttttgaagacttatagttcaaggaaaatctttccctaggctcagacttgtgtttttgtgaaatggggctaacgtctaccccgcaaggccatcatgaacataagctgagatgacagacctaagggaaaggccttgcacagagaaggactccatcagtgccagttctgttcttcacaaccccttggttttttgtttttaattgaggaacaacatctatgctgaaaaatgcacaaagattaagcatagagcttggagaattttcacaaacagcataggtgtctatgtaaccagcccccagatctggaaatacagcatagccgggcatggtggtgggcacctgtagtccctgctattctggaggcttaagcaagaggatagatagcttgagtccaggagctcagggatgaagtgagctatgattgagccactgcactccagcctggtgacacagtacgatcccatttctaaataaataaatacagcaggcctctaaacatcccccattgtccccttctctcctggatcttactagtttgcgggtatgagactgtcatccacaggggagaagctgcccgaaggagcttctctgagaccttgcgtgtgtgagtgaaaaatggtgaagttctcagatagtaacaaagttcatccttgtaatgggtgtctccttaggatatccaggtgaacgcagagtttgatggccttgctagctcagtgaggggaattcttccagaactctgcataaagactggcgcttgcagagtggagtataaaaaggagttgctgccagtcttcagatcagccctgccagcgtctgtccctaagtgaccttggagtgtggcttcctcatctccaatcagctgctttgacctccagggtgaggagctctttgactcacgaggccttgttaccacttgtgtctgcactgagtcctcacgtcagccgtgtgctaagtccacacggtgctcacacacctgtaccctcctctgtgccccacggaccctgcactcatctgggccttcatgtgctctcactcattcctgtcacacaaacccctactaagtactgcacattgaactgggcatggtatccaagatgcccaagcaagtccctgccctccccatgttcatgttctggtgacctcaggaaactattaaaatgtaaggaggggtgcacactctacttttgagaatgcaaacgggcacagcctttttggaaggcagtttatcatcatgcactgagagcctcaaaactgcctgtgccctttgatacaatcatttgactaatgtgctctagagaaataaccagagatgtataaaagattgatgcctaaagatgctcatggggccggacgcggtggctcacacttgtaatcccagcccttttggaggcctaggtgggtggatcccttgaggtcaggagtttgagaccagcttgacaaacatggtgaaaccccagctgtactaaaaatacaaaattagccaggcatgatggcgcacacctgtaatccccgctactcaggaggctgaggcaggagaattgcttgaatcctggaggtggaggctgcagttctcaccattgcactctagcctgggcaacaagagcaaaactctgtctcaaaaaaaaaaaagatgcccatggaaatgctgtttatcataatgaaaattggaagtgtccccaataacgggattggccaattaaaatttggatatgttaaatgttaaaagccacatgctcaaagaacacttaaccattcatgaaaatacacatgattaatgttcagtgagaaaattgggaagaaaaaaatcacatggcagctgggtgcagtggcacgtgcctgtagccccagccattcagaggctgaggtaggaggattgcttgagctcaggagttggagaccagctggggcaatacaataagaccctgtctttaaaaatcaatcagtcaatcacatggcttgtctgacagttcctcaaaagcttaatcatagaattaccgtataacccattatttccattcctaggtatatacttgaaagaaatgaagacatatgtccccacaagaactcgtgcatgaatatccatagcaacattatttataatattctaagagtgaaaatgcccaccagtggataaatgcaatgtggtatatccatacagtggaatattatttggcaataaaaaggaatttgaggtgataccaatgttctaaaatgtattgtggtgatggctacgtaactgtgcatattctaaaggcaattgaattacagatgctttacatgaatgaaccgtatggtatgtgaacggcatctcaataaaactgtttcgaaaagaaggaaaaggacggacacatgctgaaaacgggtgaaactagaaaacatggcgctaagtgaaagaagccagccacaagatcacgtgtcgcatgaccgcatttatgtgaaacatccggagtatgcaaatctatacagacagaaagtagattatacattgcctaggtgcagagaaatggaagtattggaggttgacggctaaaggatgtggatttctttggggggtgataaaagtgttctaaaattgattgtggtgatgtgcgactctatgaatacgctaaaaaccgctcgattgtacattttaaatgggtgatttatgcggtatgtgaaatacatctcaagaaagctgctgcaaaaaatatcatacgggttgagcctagtggtattaaaaaagtataaatatggccaggcgcggtggctcacgcccataatcccagcactttgggaggccgaggcgggcggatcacgaggtcaggagatcgagaccatcctggctaacatggtgaaaccccgtctctaccaaaaatacaaaaattagccgggtgtggtggtgggcggctataatcccagccactcgggaggctgaggcaagagagttacttgaacacagaaggtggaggttgcagtgagccaagctcacttcactgcactccagtctgggtgacagagcaagactcggtctcaaaaaaaaaaaaaaaaaaaaaaaggaagaatcaggctcagcgcactggcacatgcttataatcccagaaatttgggaggccaagatgggaggatcacttgaagccaggagttccagaccagcctgggcagcatcgtgagacccccgtttctacaaaaaacatttaaaaattagctgggcatggtggcatgtgcctgtcgttccagctacctgggatgctgaggtgggaggatcactcaaacctgggagtttgaagctgcagtgagccatgattgcaccactgcactccagtctggttgagagagtgggaacctgtctcgaaaaaaaaaaaaaaagaatggaaggatcaaactgggcatggtgatgcatgcttgcctgtaggcccagcctacaagggacgctgaggcaggaggatcatttgagcctgggaatttgagcccagcttgagcaacatagtgaaatcctgtctaaaaaagaaaaaaaggaagaatcaaataattgttccaaagtctttcaaaaggagtattgagtcccaactcggcactttcctgagcagggatatgtctcctctccttctcactaaggagccagaaactcaccccttctcactaaaaaagtgagaaaaataaaaatagctcagagaactttgagctatgtgaggcacgcagaatttatcaggtccggagacatgaatatgggacttcaggcagggcatgatggctcacgcctgtagactcaggaggccaaggtgagcccaaggtgggaggatcactttagtccaggagttttgagaccagcctgggcaacatcaggagatccttgtctcctcaaaaacttaaaaaaaaaaaaagctgggcatggtggcacacacctgtggtcctgagtcaggaggttgaggctgcagtgagctatgaccataccagtgcattccagcctgggtacacagcgagaccctgtctcaaaataataataacaataatatgctgggtgcagaggctcattcctgtaatcccagctctttgggaggctgaagtgggtgaatcacttgaggtcaggagttcgagactagcctggccaacatggtaaaaccctatcttttctaaaaatacaaaaattagccaggtatggtggtgcatgcctgtaatcccagctacttgggaggctgaggcaggagaatcgctggagcccgagaggtggaggttgcagtgagccgagatcatgccactgcactccagcctggatgacagagcaagactctgtctcaaaacaaaacaaaacaaaacaaaaaaataataattataataatgaaaagaaaaagaaatgaatatgggacttcagtaacatatttcttatccatgcccgggggcaattgtttaaaggcattttgttcctgactagcttaacccattatcttcctgtttctggaatttatgatacaaagaataatgtatagacaaccaatagcttatgtcgttttaatataaattcttgtggccagggaagctgaagtgataggattgtttgaggccaagagttgaagaccagcctcagtgagacccatctcaattttttaaaaaagagcaattcttggtaaaccacttaggaactgcctcttcttttctcttaaaaacagcatctctggccaggtgcaggggttcacacctgtaatcccagcactttgggaggctgaagcaggcaggtcgcctgagcccaggggtttgagaccaaccctgagaacatggtgaaaccctgtatctacaaaaaatacaaaaaattagctgggcaaggtggcacatgcctgtagtcccagctattcgggaggctgaggtgggaggatcacctgagcctgaggaggttcaaggctgcagtgagccatgatctcaccactgcactccagcctgggcaacagaatgagacgttgtctcaaaaaataaaataggctgggcacgacggctcacgcctgtaatcccaacactttgggaggccgaggcggtggatcacgaggtcaggagctcgagaccagcctgaccaacatggtgaaatgccgtctctactaaaaatataaaaattagccaggcatggtggcacgtgcctttcccagctactcaggagcctgaggcaggagaatcgcttgaacctgggaggcggaggttgcagtcagtcgagatcctgccactgcactccagcctgagctacagagcgagactccgtctcaaaaaaaaaaaacaaaaataaaaaaacaaaagaaaaacaaaatgaaaaacaaaataaataaaataaaataaaataaaaacagcattttgtaactgctgctaattaagagtgtatattcaaagcaacttgaatctccgctccagggctgaaggtcttaaatgtggcaataataaactttttttttttttaagagctctgtcactcaggctggaatgcagtggcacaatcacagctcactgtagctttgaactcctgggctccagcaatcctcccaccttggctttccaaaggaaaagggattacaggtgtcagccacctcactcagccttctcccttctatttaccttctcccttctattttagtttgttattctccccttttaagagcttcttccttataggtttaaccctgataggcagacacactttgttctcattctctttttttttttctgtcaccacagaatattttgcatgccatagagtttcaaactgtcttgaaatgaacgggttcacatttatgttctggttcacagagtgagtatctctatccacgtggggcaggcaggtgtccagataggcaacgcccgctgggaactgtactgccttgaacttgcaattcagcctgacggtcaaatgccaagtgacaaaaccatcggtggtggggatgactccttcaacatgttcttcagtgagattggggctggcaagcacgtgcccagagcagtgtttgtggacctggagcccactgtggttgataggtcctcgggcactggatggcagctttcctgggagagtgggagagcattggtaaaaccccacgtgcgctcctgtgaatccccctgcagaatggatgggatagacaagcaaatgcccatggcattgttagggcggaaactgaaagtttcatgtttagtgtatgtgagactcagctcctaatttaggatgtatgggaaaagctgctttgccagcagtaagatgggctgtggagagattcccctgtggctgcctcagccctgcacaggtggccctgcctgcagggtgtggggcattgattccctcctgaatgctgtgcactgtctcatgctggtgcatgaagagtcttgatgtgcatcttaggcgtagaaggtaagtacagaacatccatttccttcatccagattagaagtcccagatagtttccaaagagagctgcaaagagatagtacctttcagtgtcccccaggaggtgacaatgtcacctgaaagcacgtgggacccaggccacacaggttgatgggactgcccttcagaagtcacactgacctggtgactgtccagtttgtaagagatttttaacttacagcctttgatgtagtagctaagggtaggaaagatgtatgtacctgtagaattaccagtgctgggggacgatgcgagagcttatttcccttcactgggaactgtttatgctgacatttatttatgtatttatttatttatttatttatttatttatttatttatttagagaaagattcttgctctgttgcccaggctggagtgcagtggcacgatctcggctcactgcaacctccgcctcctgggttcacgccgtcctcctgcctcagcctcccaagtagctgggactacaggcgcccgccaccacgtccagctaattttgtttttgtatttttagtagagatgggttttcaccgtgttagccaggatggtctcgatctcctgacgtcatgatccgcccgccttggcctcccaaagtgctgggattacaggcgtgagccaccgcgcccggcctgtgctgacatttatacaagaactgactttaacttcctagggccttaaattgcatttgtgattggttatcacagagacattttctaccagacaccgccactgttgacctacaacatgtagctcatgtactttgaacagcatgtactttgtagaagtgaacagtcctggaacgtgttcaccttggtgtacagtaggccttaaagactcacagcacatgtggtctctttgtaggtgaagtgcacacagggacctacaggcagctcttccacccagagcagctgatcagtgggaaggaagatgcagccaataattactccagaggccattataccatcggcaaggagaccttgtcctggaccggatccacaaactggtaagaagagaaggcttcatgtggacgttgtcctgcacaggagaataggccttggatggtgaaaggaaggtcattttcgcagcacttagagcagcatcttgagtccgactaagtctgcaacgtcttactatgaagtatgcgtggtgatttgtgcatagatctgtattgtctgcttttctctgcttcaaagtgtgatgcgtgttcattatggatagtctgaatccgtagcaactctcagaggcaaagagaagtggccccggcttggtggaggttggtggtgtggctcccacgggcattggctcacattgtctggtttctctcaggctgatctgtgcatgggactgcagggcttccccatcttccacagctttgggggcggcaccgtctctgggttcatgtctctgctcatggagcggctctcggtggactacgggaagaagtccaagctggagtttgccatttgcccagccccccatgtctccatggctgtgatggagccctgcaactccatcctgaccacctacacgaccctggaacattctgactgtgccttcatggtcgacatgtcagtgcaacctggacatcgagtgtcccatgtacaccaacctcagtcgtctgattgggcagatcgtgtcctccatcacggcctccctgtgattcgttggggccctgaatgtgtacttgacagaattccaaaccaacctggtgccgtacacccacatccacctccccctggccacctatgccttgatcatctcagccgagaaggcctaccacgagcagctgtccgtggccgagatcgccagtgcccacttcgagccagccaatcagatggtcaagtgtgaccctcaccatggcaagtacatagcctgctgcatgttgtaccgaggggatgtggtcccgaaagatgtcagtggggccatcgccaccatcaagagcaagcgcaccatctagtttgcaggttggtgcccgactggattgaagggaggactgggtgatgtggagtccttgtgccatcaggaagcagcagatctgcagaataatgctgcccccaaaggcccgcatcctttgcggttgcttgtctggaaccgtcaccctgcccctgttccatgggctaggctcatgggcataaatcaatgaaccagagtgataattaattcagtggtgtcttttgaacttcctttgtgagtcatcacactatgtatctgtggtgaggtttttgtgtttttttaagaaaaaggtattttttggaggattttggtgccccttgcttggacagcagaatttgtgtggaaaagataggttgaacttagtagaaattttatgggcattttggggaatcatgtgggtggtgtatatattttaacttgggcattattataaactgctctcactaagtcttgcttcatctaagtatgtccaggttgtgccgacatgtgtcataggtggcttcgttatcacccatgaaggcacagtcagaatgttcatctgtagaaattatacccaatttaaatgtcttttggagtgtttgatttaaagaaagactatcaagaatctttttgtgacgaaaacagcaccatctttatttctcttttgggaagcctagtaatgttggcctgtgtttgcctcagacagaaaatctgtccccaccttccactgacacatgaaagaaaccttgctgtcccctttcagcttttccaggagttggtgactaaatcctgtcgcttctccctctgctggacctctgcgtcctctgctttgctttccctccctcctctggctcagacatccactgcctctggggagaccactgcagtcagctctaagtgggaattcctactctgggcttctccttctctccttcaggggtgagcatggctgctggactagccgcccaattttgtaaataaggttttgtctgaacacagccaccacaccccttcatcgcagatcaattttgctgtccagcctcagagtggggtaggtgtgacagagtccatgtgcctgtaaggcctagaatttgtatgatcttgtcacttatagaacaggcttgctgacccctgctctagttgaccccatgcactactcaggatgtgttattctcaagttctgaaacttggaatgcttcccttttggttcccaccttggaatgtcacttcctactcaagcaagcacatggactactcttgctgctgtggtagctccattcaagtgatctttgacctgtcacctttgcatatttcacagtggcttgtttggtgggacagcagggggtatgaccttccccgtggtatcacagttgtgtactcacaatctatctgggtggaaaaagttgagctacagaatttcattactatcttgtaaaaccctttggagtaaataatctataaagaagacaagtagtgtacattttcagagggaagacagtctttacctgggcacctatcacatgtcacagttgctaggacacagcccttcgggcagcttgggatcctgccagggtggccacctccaaggctcttttctctttattccttggctggaaccgtcaccctgcctggcacagagaagggcttagtgaggtttgtgggggtgaactgagcattctcctcgtcacctacagggggtcttctgtttgaggaaaggtagccaccatttctaggtttgatacaagcttcacggaccgctttcttgcccttctctggcaggtgggcattaactaccagcccctgacggtggtccctgggggaaacctgaccaagttgcaatgggccatgtggatgctaagcaacatcacagccatcaccaaggcctgggcctgcctggaccataagtttgatctcatgtatgccaagcaggcctttgtgcaatggtacatgggggaaggcatggaggagggggagtcctctgaggctcgcaaggacctggcagctctggagaaggattatgaagaggtgggcatggattctgtggaagcggaggctgaagaaggcaaagaatactgaggggagggtgtggtgggctctcctgccgcccccagcatggctgctttcaggttgtttgcaattaaagtttctctataaaaccaagacctctgtgtgtcatgctgcttggctctgcctacaggagcaggtgggaccccagagcctgcatggacagtcagtggggtcccagcctgccctgctggcatgcggttggggtgcagcaggagtgtatgtacttaaggagctgccatggaagtgacttgacccaggagaaacaagccaagcgttgagtggataggtttcctaaattctaggaaagctaagtcagggtttcaactgaatttgcaatttttggggcttttctattgatgggatgtactggctaaaaagaagagcctagaagcagagtgtttaaatctgaggtctatgaatggggcgtgtccatgaaatccctaaagctgtaggtcaaatgtgtaaggtcaggacattttagaagggggaaagtgttactgagttctccacagtatttgtgacccacagaaggtcacaacacacccatcctgaccccccactgctccatggtaacctggaaggcagcatttaccctccacgcacacacacggtcaccttgcccctcagcattgtcaactgtcttggtagaaaaccttgcacctttcacttcaagtgaagtgtgttaacatctgtttgtaaaagacctgggaatccagatatcttttctcagaaccaaagtcagctccaggaagttgactcaaggtgaagtgacctggttagttcagctgtggcacaaccaggacctgcataaaaacctcattctatgtttgtgccataatatcatcaaaaaacagtagagaacatatgacccggaccctctgcatctcagaaagacttattatcaactgaaggagacaacacgtagcctttgctggggacagtggtgtgacaagtctctggcccatcctaggtgctgccccgcacctgctgccttcttccaggcccaccccacttgggcagcctggtagcgctgggctggcggggtgtcctctggctggatcctttgcggccgctgcattccaacagggccggcactctcccgagggaggtgctgtctttgtttctccctgaggagacacaaagcgcagccaataggaacggacgagccccgtaactgcagcacctactgaagtgtgctccttgagcaacatttgtgtctgcacatttccctcaaagccacttcaagctgaaagccctgtatcagtcctgagtcctgaggctcagaactgccaaaggcaggtcatgccccagaagcccttggccacgggtccatttagggaagggtaagggtggctggtccatacttggcctggacaaggaacctggtctgccctgatggcgccaagcagcagcagcagcagggacttgccacttcatcctccaggtgtgttcacgctgaactgtacatctgagctgccttagatggtgacaggcaggaaacactccagtcaccaagtactggaattgggtttctgattttgattttggaagctctcacattgtttcctacctacccgagtattctgcaaacagtggtcaagccttgtagggagacaccctgaaactattgctatggaataaaagatgaaatgctcctgattattgtaaatacaaaattgcatgcaggattgtgtaaagacaatgccagcttggactgccagaacgagccaacagcacgtgatgtccttccacctgcagagagcctatgaatggacgtgcagtcagggaggtttcacatcaccaagattcctatcccagaaaagcagatattcatagctctgggaatggaatgcaacccttgtggagagcctataaacggatgcatggggggcgcctgtccatatggataagatacggctataaacgccctcatcttgccacagctcttctaggcctctttagggtgaaggcatactcccttctgagaatttctggtctaaccagttgtctagcttcacgtcctgtttccatggattgtttgtaaccagcttttgttgcaattgttactgctgattaatatcttgctaatcataggttatggaaagactgtgtttctgttctaagactctgttagaaattactgatgcacacactatattgtaaattcttatctttgtataccgtacttctacatacaaatgtactgtacttctacatacaaatgctatgttaaagaattacttcatccccatgtgaccatctcacctcataatcaaatgaccctaaatccctcactaacctacccccgccctcactaaacttaatagtaaatgctggtatatccagtgcattgttggcaccatgggaccagaaggcagtgaccccctggacccagctttcactatcttgtgtgtgtctattatttctcaacctgccaatccacctaggagcaaagagagagccccattgcattgcgggctgctggccagatccctcaataaagcctctcactctggagtttagctactggattccatgactgggttcctcccgtggtctgaatgcttgagactttccttctgaccaccagagaatcccagatgaagaccactggttcagatttccctcgatttgtaatttgcttactcctttttgtgaagatagaaagatctgcaaccacacttgggccagagctttattttaacgggatggatttccctggacttggtgttgtcagcatcagcaagaccgagaggaccctctagaggacaaatgtgcttgggtagaaggcttgcccatggggtcacagccccccatgtggagtaccttggccagggctctcctttgctctggcctggtagagtctgccccatgggctctaaccagggcatgtgtcccctgcttgactcacagtgttgggtctcccattttgtccccccagctttgtcctgaccaagagtgtgccttgactgctctgtgacctggtcagctgtatgttccccctgcaggctcaaaccctagctggggccttgcttcttaccagacactgataaacatgttgtttgttgcctgaaacagtaaaagatctgacatgttgctaagcatgtggaaactggccccgccccagccaaattccttgcacccttatataaactccacactccaccccctcactgcagcatgcctaggcagaacctccatccttgccgtccctcgtgaggccatactgcagccttgtgtgtatggaagttcccctaacacatgctttggactgaccaccctcacattaagtgcttcttcctttggaattccaactggctctcatcccaactggctctcagtcacccaagtggaaggtctggggcagtcccttgcgggagctctcctgccaccacttttggggtgagaccagatgacggttcagccaacagaacactcagcctcaatcctggttcttccctggcctcttaccaagtttagtcaaatcacctgcaattggaaactgcgctcttgaaaaaaagatgcaaccaggtgttttagggatccatgaggacatttccgtttcaccatttgtcatcttgaacaagtggaggctcctgtgtctgagacgccatggatcttggctactccagaggccactccagctccctttccatgccaatactgaaaagaaaattctccccaaatccctgcagggataggatggccctccttgtgagagtttctggggagttcttcctcagagaatgagatctttgctgctcggtgggtggtgaaggttatggtggtgtcacgcttggaactctgtcagcttggcacactcaactcaagaaagacggagtcagggttgcccagaaccaaggaggggtgcagccagaagcatgtggtgggtgaagtttggccacctcagtctaccagtgactcgtggaaaaggcacaaagcagagaatggccacctcgcatttcctttggtacaaactgccattattttagtctccactgactggtcgggggaaggaccccatctcccatgagcagatgagccccaccaccctgcagcagctcccacaatgggccagcatcctcctctgaggccacagtccctctgcgggccaggccagacagagtcagagcgtctgtagccgcggtgtttaggtgtccccgtgctctcagggtgactaatgtccagctccccacagcacacggcagggcagtctgcagacctgggcctgactcagagctggcttcccttcagcttggcaccatctgagcttcctctcttcccctcagtaatgactcggtcccttctggaaacaaggatgagagggaagcagaaaggaggaagtaagggttttgaaattttttttaaaatttttttggtttttagagactgagtcttgctctgtcacctgagctggagtgcagtgatgcaatcacagctcagtgcagccttgaactcatggcctcaagcaatcctcctgcctcagcctccagagtagtgggactacaagcatgtggccacacctgactaataatgcttacctttaaatctgacagggctgacaaacccttaacataactttgagccataatggatattaagaaaacaattctggaacccttcaggaatcatgtgctcttggggttagtgaggagccctgttcaggcctcctcactttatgaaggacgaggaggcccagaagagaacgacctgcagcatcttgcagtgggaaaaccagcttttttttttagctctgctcccttgggaggggctactgagtcagatgggttggacagtggggttgaaccaagtgttactgcaagttgggggggagggtggggtgactgatgtccccaggcctggtccctggagggtccttctatgcaccaaaaacagtcaatgaccaatgcatgttaaaacagacttcatgctataaccccaggctttgggaggctgaggcaggaggatcccttgaggccaagagttcgagaccagtctgggcaaaaacgtgagaccctatctctaaaaaaaaacaaacccaaaaaacaaacaaaagctgggtgtggtggcctgcacctgtagtcccagctactcaggaggctgaggtgggaggatcacttgagcccaggagtctgaggctgcagtgagccatgattgcaccactgcactccagcttgggtggcagagggaggctacctctaaaaaaaaaaattagattaacaaaacttaaaaatacaaaaataaaacaacaacaaaaccaaaaacagcctggctcattctcttcaaggtcagtgctcctgctactctgaaaccagctggtgaccactcggcattttgtgagcccctaacgaagcaaatctcaaaatgcagcagcctgtcagcctctcatgatctggggaatccctgaagctgcggagtgggccagaccaagctgggacgccctctgccatttacctttggtgtggcctatgtgagcccaactccccaccatttcccatctgggcagagctggttggggaatgaagatgtgtcccttctgctggtccccaagggtggcctttcttgtttcgtagtggcagcgcgaacttgcggcaacatgggctgaccaacatttgtgttaggaaggaaaacgggcagaggtgacgtgagagaactgagagggaaggaaaccaccactggccctgcttgagaagcagccgcagccagggcaggtggcatcagcagtggtgtctcactggcaggggcaggggcagcacagcaggccctttagtctgtggctcgcctaatactcctgtcggacagtgctgctccaacacattcatgacatgccttcagcaaacccaagtcaggggcatgagccacacatgcaattttttttttgagatggagtttcgcttttgttgtccaggctggagtgcaatggtgcaatctctgctcactgcaacctccacctcccgggctcaagcgattctcctacttcaccttcccaagtagctgggactacaggcatgtgccaccatgcccggctaattttgtatttttagtagagatggggtttcgccatgttagtaaggctagtctcgaacttcccatctcaggtgatccacccgcctcagcctcccaaagtgctgggattacaggaatgagccaccacacccagccacaattttaaattttctggtaaccactaaaataaaagaaaatgtggaattagaattcaaataatatattttaattaacccaaaatatccaacatattatcatttcaacatgtaatcagtacataagtttttcatgaaatgttgcaatcactttttttttcctttttatttaaatagagatgggaatctcaccatattgcctaggccagtctcaaactcctggactcaagtgatccacccaccttagcctcccaaagtgctgaaattacaggtatgagccactgtgcctggccctgcattcacttctgttcttttgtttgtagacactggatctcgctatgttgcccaggctggtctcgaactccttgcctcaagtgatcctcctgccctgcctcccagtgttgggattatagccgtgagctaccacgccctgcattcacttttgtgccagtcctttggcacctgctgtgcataacacacgcagtgcagtgaccatgccagccatatatagctcgtggttcccgtatcaggcagcacagctcatgtgagactcatggcttccacataccaaacgtcatcttacatgctctggacaactttaaaaaatgtgtagtttccctaaacttagagaccgcttgactgcatttagttttccctcaatgactccagaccctcaccacaagcattgcccgtctgttctggtgtcttctgtttcccctccctgtgggtatgagtgagcctggtggcggtggtccccgcaggctgtctggatggctgggggacaggcatccagagaggctggggcgcctgctgcagttcacagaggcaggcttgagtgggcctggcccgcggcctggagaactccacacccaagtcctgtgtgaaatctatggcctccatgccctccagctggatcactctgacaaccccctcttatgttctccaccccagattctgccattactggggcagctggagctccgtgtgtttggatgctgcaacacgcgggtctcagagagctctcggtatcccatctgcgggctctgcctctcactccgcagcacactcctggtgtggccccacctctgccccactcccctccaccttctccccaggtttccctctatccccacggggcatccccccagggcctctgtgccctcatatcctggccttctgccacccagcctgcaggacagagcccttgaagagcaaagaccctgaggggcccagcatgccaggccgctccagtcctcgtgttttgggtatcctctcacttctctcggagcccccgttcacccacacggcacccctgatcctcctggcccctttatgcccgtgttcccagcaccacgacccccgcatacatcttttttttttttttttttttttgagatggagtctcactctgtctcccaggctggagtgcagtggcgtgatctcacctcactgcaacctctgcctcccaggttcaagtgattctcatgcctcagcctcccgagtggctgggattataggcatatgccacaacacctggctaatttttttttttttttttttttttttttgtagaaatggggttttgccatgttggccaggctggtctctaattctggatctcaggccatccgctcgccttggtctcccaaattgctgggattacaggcatgagccactgcgtctggcccccgaatacatcttgactatgtcctgccacctccctcctcctgccctgggcccaccagcgcctggacagcactctgcctcgcccaccccctcccaccaccccagctcacaccttcggggctctgctgacccctcctgtcccgccctgtgtaacccttactgctctcctgctcagaagcctcctcctacctccatcattggcggtttttctcgccacctctcattggaacgagtgggaccatctcacttcactgccacaccctctgcactgacagacagccgggcccggcacccagaatccctgggtgaatggcaacatcccttagaatgacaaggactctgttcccagtttcttcctccccgtggaaacctgcccttcaattgctcatctcagcctgcagtccgtgcacccctaccccagcctgtccctcagcccctcctcaccctcccttgggcctgagctctggttggcagtgaggtgggcgctgtggggaggagcgtacaggaggtgcgaccagagccccttgggctctcacaggcccctggctctgggcccctggtttcatcacacctggtgacacctggaaggtggccccaactcaggagtgaggcgggcaaaggggctgagtgctggagtgtggccacgggaccagcacacggcatctgtgtggtgctgcccaggaggctcggagaaggcgggagcctctgtttcagcctccagacttcctgtcggggtaggggacagcttctaagaggcaaggtgtttgtcacgcctggggctgtgctctccagcacagcacaccacccctcagcctgctgtcctcccttggggtgggtggaattctttacagggcacaagtctcactcaccacagttcgcctctggggtgtgggatgttgatcctgtccccagatgccagcccaactgtgggccataccatgtctctaataaacagagccagaaatcgtgccctgtcgctaagccacagggcagcgttggcctacatggtcttgcccttgcagcttacaggttttcctgcctcctggggccgggcactttccatggaaacaagggagagcaccaaccaccagagataagccaataaccacgacctgagaaagaacaggcagcaagagaggcggagggaatggggtggggtaggggctggagagaaaggtgagtgtgtggcagccaggctgtggggcagaaccggagagcccgcaggccaagggcccaaggaaaagaggggttcgcagtggggttattgttcctggcagagaaaaaggaggcctctggaggtcagagagagacgcaaagagagcagacagagcgcggggtcagtgaggcctctgcgcaggtgcctggggcctctcagggcagggggactgggtgcccaggccctgcccccatgggggcagccggctctccgccccttctcaggatgcctgtgtgggtgtcctcatgcttccaggtggggagccagctctgggcctccttccagtggccggggaggttttgctgcatttcagagggagccgtcaggagcagaagcaacatgtggggaggaaagcagagacggaggctccaccatgacacactctcagcctcagcatctgctcagccccagtcaccatgctggagagaggaggcccttcaggccccgcaggcctctgtaccctgggagttctgcctctgactcttgtcctgcaatcctcagagggaagctggccagggctggtcaagcccctgcataggacctgggcccaagtggggtacaggcagggggtggcaggaagacttctgcctgccctgctccctcggcactttcctggaggctgtaatgccacaagacaggatcaaaactgtgctgttgtttttttttcgagaggagtctcactgtcacccaggctggagtgtaatggtgtgatcttagctcactgcaacctccgcctcctggattcaactgattctcttgcctcagcctccagagtagctgggattacaggcgtgtgccaccacacccagctaatttttgtatttttagtaaagatagggttttaccattttggccaggccagtctcaaactcttgacctgaaatgatacgcctgcctcagcctcccaaagtactgggattacaggtgtgagccactgctcctggcccaaaactgtcttttaaaaatatttttgggggtgctgggtgtggtggctcacacctgtaatcccagcactttgggaggccgaggtgagcagatcatgagatcaagatatcgagaccatcctggccaacatgatgaaaccccgtcgctgctaaaagtacaaaaaaattagctgggattggtggcgcatgcctgtagtcccagctacttgggaggctgaggcaggagaatcacttgaacttgggaggcggaggttgcagtgagccgagatagcaccactgcgctccagcctggcgacaaagcgagactccgtttcaaaaaaaaaaaaaatcttttttttttttttttttttttttttacagacagggtctcactctgtcatccagactggtctcaaactcatggcctcaaacgaccttccccccttggcctcccaaagtgcttggattggaggcatgagcccctgcgcctagcccaaagtcgtcttgattcctgactttgtggaatggaggcatgagtgaagaggtggggagaggctgaggaggaggagccctagcccacctggagcaccgtggggcacgcactctgcgtccacctggcctggacatgcctcctaaggataacagcgaagccagggagcagagcccacggatgggccctgcagctgctgggctgagaccgacagacaggcgtggtcactccgggccatgctggcgctgtgctgcccctgcccctctccaccccacctcccgaccactggggcagggacaatgggcccggctctgacttcgggcacgctcgtcgtgtgcagagacacggccgcagagtcctggggctcgctcgccatcctctgcccggcacacatcgacttgagcatctggaagacggccacgggggccacgttcaacttcacctggctctgaagctggccgctgtgggctgcatgagaatggtgtttctataaaacatgggaattgctggtcagacacagtgactcatgcccgcaatcctaccattttgggaggctgaggcgggaggatcgcttgagcctaggagtttgagaccagcctagggaacacagcaacacctcatctctacacacacacacacacacacacacacacacacacacaattagctgggcatgatggcatgcacttgtagtctcagctactaaggaggctgaggtgggaggatcacttcagcccagattgaggctgcagtgagccatgatcatgccattgcattgcagctacttgggaggctgaggcaggaagatcatgtgagcccaggagtttgaggttgcagtgagctgtgcctctaatcccagcactttgggaggctgaggtgggcggatcacaaggtcaggagttcgagaccagcctgaccaacatggtgaaaccccatctctactaaaagtatttaaaaaattaacctggtgtggtggcgggcgcctgtagtcccagttactcaagaggctgaggcaagagaatcgcttgaacccaggaggcggaggttgcagtgagccgagatcatgccattgcactctagcctgggcgacagagcaagactccgtctcaaaaaaaaaagattatgctgaaatttaccactattggtatgaatgatcagtattcaccaagcatatctgaacatgcaaatgtttaagaaataagcataataaggatatagcttgggttaataggattctcatagtttttttcccctatgaaacataagtaataattttagcatatttattatggattatactcatttaaaaaggactttaagaagttgtgctttgggaggcagaggcaggtggatcacaaggtcaggagttcgagactagcctggccaagatggtgaaaccccatttctacaaaaaatacaaaaattagccaggcgcagtggcgggcacctgtaatcctagctactctggaggctgaggcaggagaatcggttgaacccaggaggcggaggttgcagtgaactgagatcgtgccactgcactctagcctgggtgacagagcaagactccatctcaaaaaataaaaaaaagaagttgtggatgtgaataatacatttctctaataaaaatttaaattgtataatagtttaataaagtgtttacattcattgatttttttttttttaagacagagttccgctctgtcacccaggctggatttcaatggcatgcgatcttggcttactgcaacctctccctcctggtttcaagcagtcctcccacctcagactcccaactagctgggaccacaggcgcgtgggttaccatgctgggataatttttgtaatttttttgtagagatagggtttcaccattgttacccaggctctgtgctcaagcaaccagcctgcgtcagcctcccaaagtgctgggattacaggcatgagtcactgcacctggcctcagttatcctttctattacatcctatgatgttttcatagcctacaaggcatcaatttcttcttaataattgtcagtctggccaggcgcagtggctcatgcctgtgatcccagcactttgggaggccagggcaggcacatcacctaaggtcaggggtttgagaccagcctggccaacgtggcaaaaccccctctctgctaaaaatacaaaaattagccaggtgtggtggcgtgtgcctgtgattacatgctacttgggaggctgaggcaggagaatcacttgaacccaggagtcagagattgcagtgagctgagatcgtgccactgcactccagcctgggcaacagagtgagactctgtttcaaaataataataataataataatagtcaatctggttaaagaggtaacaatgatctattaatgctttgggaaaacaatttgggttgcctttgaaggccagggtttttagttcattcaaaaatatttatttaatttatagcatgtgccaagcattttttagcttcacagtatacagttgtgaaccaatcagataaggccctaaccatttttggcattctgtctagttggggtgggatgggggcttaattaagatagagatatagaaaaatgcgcatctatataacataagtatggagttgagaggaagcaactaacagtatgttagagatgttagaagtaatattttgcaggtttgtaacctctatttgacttttaagtttgggtagtgttaatagttgaagatagtgtaaaaaagccttaattttcactttccttgctggtaaaggtatgtttatttagactgttcatttatttatttctcactctgtcacccaggctggagtgcagtgctgcaatctcggctcactgcaagctccacctcctgggttcacgacattctcctgccttagcctcctgagtagctgggaccacaggctcccgccaccacgcccgggcaatttttttttgtttgtttgttttgtatttttagtagagagggggtttcaacgtgttagccaggatggtctccatctcctgacctcgtgatccacccgcctcagcctcccaaagtgctgggattacaggcttgagccaccgcgcctggcctagactacccatttaaagtagtgtttaacatggctgggtgtggtggctccctgtaatcccaggagactgaggtgggcagatcacttgaggtcaggagttcgagaccagcctggccaacatggtgaaactcagtctctgccaaaaatacaaaagttagctgggtgtggtggcaggcacctgtagtcccagctactcaggaggctgaggtaggagaatcacttgaactcaggaggcagaggttgcagtgagccgagatcgtgccactgcactctagcctgggcaacagagtgagactctgtctcaaataaataataaatacatacatacataaataaaaaaagtagcatttaacacaacaatcctgtgaaagcgattctattacatatccacaagctaattagctgcacactctttcctgtattttacaatttagcatgattttaggccccagtcttctcttcaaatcactggtgttttacatttggcaaagaataggaagttacttttgatttatggagtgattatattattactttaaaaatgtgttaatattttaggacagtttggagcctctatctttttttgagttagtatttcaattctcattacttattctaacagcttctaagtgaaaatagtatttaggcaattaaatcggcatatgttttcaggaattttctttcatttttaagttttgtcatcattgaggttaatgttttaacctggtgttcagttatgatatatataaacagtttgtgaagtgaaatagtcttaagtatgatgtgtgatgcacctacaaataaacgaaaatggcgtgcaccatgtctctttactgtgggaactgtactggaagatttatgaaagcatgtgacattgcacctaaagttgtgttattagtgactataagcagcagtgctaaatttttctattgtacttgatgaatgaatgcatttagtctagtcacagttactttggtttaaatgcatttgtctttagggtttgtattagttttcacattgctataaagaccccagactgggtaatttataaagaaaagcaatttaattgactcacagttccacaaggctggggaggccttaggaaacttacagtcatggtggaagaagaggcacatcttacatggtggcagacgagacagaatgaatgagctaagggagaagagccccttataaaatcatcagatcttgtgagcactcactcactattatgagaacagtatgggggaaacacccccataatctaatcacctcccaccaggtcccgctctcaacacatggggattatatggattacaactggagatgagatttgggtgaggacagagccaaaccatatcaggtttttattttttttagtattttattttattttattttttgagacagagtctcgctggagtacagtggtgcaatctcggctcactgcaagctccgcctcctgggttcacaccattctcctgcctcagcctcccaagtagctgggactacaggcacccgccaccaccactggctaattttttatatttttagtggagacggggtttcaccgtgttagccaggatggtcccgatctcctgaccttgtgatcggcccgccttggcctcccaaagtgctgggcccatatcagggttttaaaaaatgtgtttgtaatttgtactctcggcagggtattcttgggctgcaggggttgttgtcaatgtgtgatttgtgtttttattttatagaataatgtgatgtaccgatttttataagtgatagataattcgaataactgtatatttgacaacctattaaaatattttgcattggaacttctttcattaattgtaacatgctaacaaactgatagtggtttaaaaataactcattcattgaacaacaacaacaaaagaaaaaaggttaaaagtaaacatttttatgggaaatctcttatccaaaattctttcaagattttaccttatttagtgactagttctgtatttttgcatgaggaataaatatgtctctggaaggaaaaaaactattgctattaatagttatatgaaccttctagaacctaatctaataccagacaactgaggctaaagaaatgctagattgcagccccagtggccagacatgaatataagaaggaaaacaggctgggtgtagtggctcacgcctgtaatcccaacatatatatgtatatattgtggtggctcacgcctgtaatcccagaactttgggaggccgaggtgggcggatcacgaggtcaggagattgagaccatcctggctaacacggtgaaaccccgtctctactaaaaatacaaaaaaaattagcctggcgtggcagcgggcgcctgtagtcccagttactcaggaggctgaggcaggagaatggcgtgaacccgagaggtggagcttgcagtgagctgagatcgcgccactgccctccagcctgtgcaacagagcaagactccatctcaaaaaataaaaataaaaaataaaaaataagagtttagtcctcacatacctatgttttacatcaatccccaaatagttctttcccacaaagcatactggaccaatagtacagaaatgatttgtcaacttccaactttgtccagctagaaaaacactagaagccagttaaaatgtttgagcaagacaggacaaatgctctgtttcttccacaaacaaattgcaaataggaaaaaaggagggagaaagagcctatagattaaaagagatttatgaagtgtgctatccaaatgccaggtgcagactttgttttggcttctatgaaacaagtcaactttttttttttttttttttttgagacgaagtcttgctctgttgcccaggctggagtgcaatagtgtgacctcggctcactgcaacctctgcctcctgggctcaagcgattctcctccttcatcctcctgggcagctggaattataggcacccaccaccacgcctgggtaatttttgtatttttagtagagatggggttttaccacgttggccaggctggtctcgagctcccgacctcgtgatccacccgcctcggcctcccaaagtgctgggactacaggcatgagccactgcacccacccaaaacaagtcaactttttaaatgaagaaatttaaacaaacactgaatatttgatgattttgaaaaattactgttatttattttttcaatgtcatattactatggctatgtttttaaagaaagcccttatcttcttgaggtatactgaaatatttaaaaatgagataacagatgactggcatttccaaaataatcctttttgggaaaagggataagagtgaaatatgactgattatgagttggtaattgttggaacttggggttcatttttctagactctactttttaatgtatttggaactttattactaattgctatcactttcattaatactgattacagaaataaaaaatcaacaaatgaaaaattcaagacacccccaaaaaggaacaatgacattttcatacatgatatcatctactatttcaataatatctaaatagaggacagttgaggatgtgacatggaatactggggtagaatttttttttgaaacggagtcttgctctgttggccaggctggagtgcagtggtgtgatcttggcttactgcaagctccgcctcccgggctcaagaggctgagacaggcaaattacttggggccaggagttcaagaccagcctggccaacatggcaaaatctcgtctctactaaaaataaaaaaaataagtcaggcatggtggcacatacctgtagtcccagctacttcggaggctgaggcatgaagattgcttgagcctgggaggcagaggctgcagtaagccgagattgtgccactgcactccagcctgggtgacagagcgagactctgtcccgtgccccaaaaaaagtccattgtgattcttgtcgttgtcttactgttgaaatgtttacctaagtctttcgttcaaatgggatgctcgagaacacttcaggaaaaatgagaaacaattaaaattctccaggccaaacttctttatttatttatttggaaggagtttctctcctgttcccaaggctggagtgcaacggcgagatctcggctcactgcaacctccgcctcccaggttcaagcgattctcctacctcagcctcccgagtagctgggattacaggcacccgccaccacacccagccaattcttttttttttgagacggagtctcgctctgtcgccaagctggagtgcagtggtgtgatattggctcactgcaacctccgcctcccgggttccagcgattctcctgcctcagcctcctgagtagctgggattacaggcatacaccaccactcccagctaatttttgtatttttagtagtgacggggtttcaccatgttggccaggcatgcaccgccaggcctggctaattttgtacttttagtagagacggggtttctccatgttggtcaggctggtcgtgaactcccaatgtcaattgatcctcccccctccacctcctacaatgctgggattagaggtgtgagccaccgcacctagtctttttttttttttttttgtatttttaatagacacgggtttcgccatgttggccaggcttgtctcgaactcctgacctcaggtgatcagccgactcagcctcccaaagtgctgggattacaggcgtgagccatcgtgcctggctgccaaactttatttttaaaaacatttaaggctgggcatgttggcttacccctgtaatcccagcaccttgagaggccaaggcaggagaatagtttgagaccaggagttcgagaccagctggggtaacatagtgagaccccatcccaattaaaatatatatatattaaaaatattaaaataggctgggtgcggtggctcacacctataatctcagcactttgggaggccgaggtgggcggaacacctgaggtcaagcgtttgagatcagcctgtacaatatggcgaaacccagtgtctactaaaagtacaaaaattagctgggtgtggtggcatgagtctgtattcacagctactcgggaggctgaggcaggagaattgcttgaaccaggaggtggaggatgcagtgagctgagattacaccactgaactccagcctgggcaacagaatgagactctgtctcaaaaaaataaaaaattaaaaaataaaaattaaaatcatttaaagttcatttctttagaatatttctctcaaattataaatgtaatattttaagcttcagtaagttaaagttacaatacaataaaaaagaattactgtagcaggagaaaaataaaccatgagtgatgtagggggactattaaatggatattaattcataacagcatggatttttaaagttttttccttttttttttttttttttttgtgacaggctcttgctctgtcacccaggctggagtgcagtggcacgatcatggcttactgcagcctcaacctcctgggctcaagtgattctcccacctcaaccccttgagtaactgggaccacaggtgcgtgccaccatgtcaaaatcattttgtgtgtgtgtgtgttttttgtagagatggggttttgctatgttgcccaggctggtctcaaactcctgggctcagtgatcatctgcccttggcctcccaaagtgctgggattataggcgtgagccactgcgcctggccttttccttaatattaaatgaagtattatttatattacaaaccaattatttggagaaaccccgtctctacttaaaatacaaaattagctgagcgtggtggcacatgcctgtaatcccagctactagggaggctgaggcaggagaatcgcttgaccccgggaggcggaggttgcggtgagccgagatcgtgccattgcactccagcctgggcaacaagagcgaaactctgtctcaaagaaaacaaaaaacaaaaaaatacaaacaaaccaattattacgaaaatgctattggagaaagaaactgtaaaatctgatcaactgaggatctagcagtactaaaaaatatcaccattcaatcaggacaactagcaattctatattatatttagggaagttttctaaataatccattgcaaagtgaacaattgaggattaacagtctttgaagaaaaataattaaaaaggcaaagttccaaggtgaatgaagaactgatgcagaggaaacagatacatcagagagcataagaaaactttaaaaaattccagtgagtgtggtcagaaagagggaaaggggtgtttcctcacctcaccagctacacaatcataaagcagtgtagccttcatgagggaaatatttcaacccaagaattccatactcagtcaaatcaactaccagaacactgagggcacaatgagacattgcgagacattcaataacttgaaaacattaccatcctcaatccctatgggggaaaaaagaaatgttacacaatcaagcatgtatgtgtatacataatatgtatgtatgtataatacatctacatacatatagatattcctgctgcccacgaaaagactagcaaatcatcagaagagtaatccaaaaaacctgccgtgaacataaaacagtggcagctgactatgatctagaagcagcaaagaaagttaggaagaaaataggaggagggctaggcgcagtggctcacgcctgtagtagtcccagcactttgggaggccaaggtgggtggatcccctgaggtcaggagtttgagaccagcctggccaacatggtgaaaccccatctctaccaaaaatacaaaaattagctgggtgtggtggcggccgcctgtaatcccagctactcaggaggctgaggcaggagaatcgcttgaacctgggaggtggaggttgcagtgagccaagatcgtgccattgcactccagcctgggcgacagagcaagactccgtctcaaaaaaaaaaaaagtaggaggagctcttcagtacccaagcctgcacagctctctgcaaaagcagcggggcatctatctgccttctctctgggtccagtcacaccacgacttggctttgcagggaataaaatgtgcattaccataattattataaatgctatttactggttttcaattcttatgaccaacttagacaaaacaaagaaaacttcattatagtcacagaacataaacattatacattttgacaacacaaaactgatatactcctaattctcaaatgaaaataaattttaaggtggcagccacagatataaaggaaattaattaaaatacgattccatgttaataagctagaaagtattgataaaattgatggtatttctaagagactataatgacaaaatcagcaaaagaaaatctaaatagaatactaattttggaaaatatttggaaagaagtctaacaatatctcccactgaaaagcactgtatttgcatagttttgtaaatgaatactttgaaacttcattctctgaaatattctttttttgttttcttctttttttttttgagatggagtttcgctctgtcgcccaggctgggtgcagtggcgtgatcttggctcactgcaagctccgcctcctgggctcacgccattctcctgcctcagcctccagagtagctgggacttcaggtgcacgccaccacgcccagctaatttttttgtattttttagcagagatggggtttcactgtgttagccaggttggtctcgatcccctgacctcgtgatccacccgcctcagcctcccaatgtgctgggattacaggtgtgagccaccgtgcctggccctgtaacatattcttgaacacaagactggacgctttatagtttttcctaaaacttgatcataactctgatactacagtattccaagggtaatatacaaaagttaagaccacagactacagactactcctcatttgggaatatcgtttaaaaaaataataaaacatgaatacaaaaggctcaactgtgcaggtagagaataaaatgccatggctaagtgttttattctgggactgcttgaatgattccatagtattaggcatattaatctaaacaagaaaaatagtcaaagacgaaaatcacgatggtcttgaatagccatatttcaatattaatttctcattaaaagtcttagacttttagactaataagagtttttttaatgtttaaaaaaatctgactgggcgcggtggctcacgcctgtaatcccagtactttgggaggccaaggcgggtggatcacgtgaggtcgggagttcgagaccagcctgaccagcatggagaaaccccacctctactaaaaatacaaaatttagctgggcgtggtggcgcatgcctgtaatcccagttactcaggaggctgaggcaggagaatagcttgaacccaggagacgtgagttgtggtgagccgagatcgcgccattgcactccagcctgggcgacaagagtgaaactctatctcaaaaaaaaaaaaaaaaaaaactttcaaattaacattcaattttaatggaaaaagtctagaatataccttaaaataaaaaacaagtaaaatatttatagtaactacgaggaaggaggctttcacttttcatggcataccctcctgtaatgtttcaatttattagttttgagcatcctttttttttttttttgagacaaggtcttgctctgtcacccaggctggagtgcagtggcatgaacgtggctcaccgcagccttgacctcgtgggctgggaacacaggcacaccacagccatgcctggttaattttttagtttctatttttagtagaaatgggctctcattatgttgcccaggctggtcttgaactcctgggctcaagtgatcctcccaccttggccttccaaaatgctgggattacaggtgtgagccacctcacccagcaataactgtcttgtgacacaaacaggtggattggtgctgtcatcaataataattgtgactaattagctcatcaggtcctaggatggctttggggcagcagttggtgcaacttctggtaacttctgtcatcaaactctggttatgtggatgtctctgagtcatatcaatgtagtagcctcttctgagtaggaatggtatttgtgtgtctctgggtctgaatccctcgtgaaactataagctccttgagggcaggtattatttctcattgctcttagcaagtcacctgttgtttggcatacccagctgtcctctggagactgtcctttactttctgcatccacatagctatagtaggagccaccatatttgcgcaacatggccctaccaatggctgctgttgactggactggagatagagcccatcttaagccaagccactgaaagcctcatggccccactcatggatgttgttgattggactgtgggtagggtccaacccaagctggaccaatggagctcttcctcaagattttggaattaagtttaagagaagggatcttactgacccagcttgagtatttagaggagctgttgacaccattatttttcctgtgaacagggaactagttaacgaagagaagtggtgctcatagaggagaaaaaagaatgagggacacagaaaaaatacatcttagatttcctggcatctctcagttcctgtttccaggcctgtagggaaaagaaagagagatcagactgttactgtgtctatgtagaaaaggaagacataagatactccattttgatctgtactaagaaaaattgttttgccttgagatactgttaatctgtaactttagccccaaccctgtgctcacacaaatatgtgctgtatggaatcaagctttaagggatctagggctgtgcaggatgtgcctggttaacaatatgtttgcaggcagtatgcttggtaaaagtcatcgccattctcgattaaccaggggcacaatgcactgtggaaagccacagggacctctgcccaagagagcctgggtattgtccaaggtttccccccactgagacagcctgagatatggcctcgtgggaagggaaagacctgaccgtcccctagccctacatccataaagggtctgtgctgaggaggattagtaaaagaggaaggcctcttgcagttgagataagaggaaggcctctgtctcttgcatatccctgggaatggaatgtctcggtgtaaaacccactagtacatttgttctattctgataggagaaaaccaccctgtgcctggagttgagatatgctggtggcaatgctgctctgttactctttgctacactgagatgtttgggtggagagaagcataaatctggcctacgtgcacatccgggcacaataccttcccttgaacttatttatgacacagattcctttgctcacatgttttcctgctgaccttctccccactatcaccctgttcacctgccgcattccccttgcggagatagtgaaaacagtaatcaataaatactgagggaactcagagaccggggccggtgcgggtcctccatatgctgagcaccggtcccctgggctcactgttctttctctatactttgtctctctgtcttatttcttttctcagtctctcgtcccacctgacgagaaatacccacaggtgtggaggggctggccctcttcacaggcccctcccaaaacctggctgcatcagatctccccccaccccttcactgcttgagtcaatttgagtgagtctgttactttcagccaaaagtatcccaaggaatttagagcctgagagaagtccaatgtcacactgcaggccaatgaagaactatcctctttctgctgactctcaaacgcaaagttctttggggcaagaaagaaacaaggaagaaaaaaatcactcacatctgttgaagacttactatgtgctaggtattttggaatgtcatttatttaatgtttaccatggcagaaggtagattttattctattagcttacagataaggaaactgaggctcagatatgttgaataacttgtctagagaagaaatggggattatatttaattattttaacaaattccatgattgtcagttacctcctgttgcttttttttttgagacagagtctcgcactgttgcccgggctggagtggagtggcacaatcttggctcactgcaacctctgcctcccgggttcaagtgattctcctgacccagcctcctgagtagctgggattacaggcatgggccaccacactctgctaattttctattttaaatagagatggggtttcaccatgttggtcaggctggtctcaaactcctgacctcaggtgatccacccaccttggcccccaaagtgctgggattacaggcatgagccactgcacccggccccatattgcctcttaaaaggtgtgctatcagcatgaggctgttgaaagataataaggtagccagtgagcaccctaggaggaaggtgactagtacgttggcagtcagcctcttgaaatcttgtagagtacagacagaaccaagagttgagacagccatgtctcccccacattttaagaccattctctttctagaactcactcactgccttctggttgctttaggactcccagtacccacccagacagccccagctccagcctctggagacatctccttagtgggttctctgcatgcccttccatccttgggaaaacccagaacaaaaccagatcttccaacagaggctctgcaatggaaaaatcccaggggactgaggtgcatgatctgctttggagcactcagggatatctgtctcctcacactgggctggttgtggtgaagggtgcaccgggctcttttaatgtacacatctggattgaactgagattcccacagcagatttcctaatggtgagtggaggacaacagataaataaatataattaggaacagtatccagactgacgcatgctgaagagtttcagcaggtaccaacagatatattcaggagtcagagaagcttgggaaattcccatagtcataaattgtaatctccgggtcaagttagctgaccatcagaaatcatcctggcaggtcttttaacactgcagtttcctgagcctgacttctgaggattctgattccataggcctgtggtgtatttgtcattttgagaagcctccagggggattctgacaactggccaaacttagagagattcacaaggcacattgtcacattaaaggcactgaaaagtcctgtaataatgacacccacatcatttcactgaaccagtttatcaaagttacttgaacacagatctctccctctatatattttgtacacctgtttttacaaggtctactgctcagggagcttgccaagatttcctcttaataattctatactaatatcataaatccaggtttttttatgtctttcctaccattttgtagtatccactggctgttctctccttgaaggcaggaatagtgtctgttttatttgcaatatcccttatgcagagtctgagtaaatgagtcttttaagataatctctgaacaggggatgtggccctctgcctccccggttcaatgaagtactttgataccagggtggaagagagatttaaagcagcatgtcatagtaggaaaggctgcagagccacttttggttgacagtcatggatgatgagtgccagcagtccagctccttctcctctgagctgtttctccactgctctgagatcaacctcttaacaaacttggtccccaggtaaaagccctcctgagacatttggttaagaagaggagtttcccatttctccccttctcctttcagccaccaggcattgaagggagcagtgctgaggccatttaaatgggcttctccatagaatgggcccttctgttggaaactgggttatgcacaaaccattcacaatggctttttacaccccagaagcactaagatccccctaatcttcagtcaaaacagagcatgaagggtggggtattcatcccaaaggcactgggcatctgaaagttagggaggggtgggaccacccacattcagggctttgattttccagccagaatgacaagaccacaagacccccaggaggactccatccttctcattctttatgtggtggacccttaaaaagtgcaaggtgggaggctgaggcaggcggctcatgagatcagaagatcgagaccatcctggccaacatggtgaaaccccatctctactaaaaacacaaaaattagccgggtgtggtggcacacgcctgtaatcccagctacttgggaggctgaggcagtagaatggcatgaacttgggaggcagagattccagtgagctgagatcgtgccattgcactccagcccaagactcagtctcaaaataaataaataaataaataaataaataaataaataaaataaataataaattaaaagtgcaaggcttttttttttttttttttttttgtgacagagtttcgctcttgttgcccaggctggagtgcaatggtatgatctcggctcactgcaacgactgcctccctggttcaagcgattctcctgcctcagtctcctgagcagctgagattacaggcgttcgccaccacgtctggctaattttgtgtttttagtagagacgaggtttcaccatgtcggccaggctggtcttgaactcctgaccactggtgatccgcccacctcggcttcccaaagtgttgggattacggggtgagccaccgtgctggccacaaggcatcctaacaagagttttgctaccattatctcccgttacagttgaggaaactgaggcatgcagaggttaaatgaagcacccatcagagccaagcagttagatggcaaagttgtattagtctgatttaagaaaagtttaatacaggtaccatttacagaggtgcagacagtgtattgatttttttttcttttctttttttttttttttttttgagacggagtctcaccctgtcgcccaggctggagtgctgtggctcgatctcggctcactgcaatctccagctcccaggttcaagcgatcctcctgcctcagcctcctgagtagctgggattacaggtgcctgccaccacacctggctgatttagtaaagatggggtttcaccatgttggccaggctggtctcgaactcctggcctcaggtgatccgcctgcctcggcctcccaaagtgctgggattataggcatgagccactgcgcccgacagtatattggttttctatttctccataataaataactacaaacttagtgactttaaacaacacccctccattaggtcatagttctgtaagttaacaggccaggtatggcctgattgtctcctcagtgtgtcacaagtttaaagtcaaggtgttgctgaggctgtgatctcatctgaggctcagggttctctttcagactttttccagttgttggcagaattcagttagttgtggttgtaggactgaagcccccacttccttgctggttgttgtccaggaaccacttttatcttttagagaccacactcaaagtccacaggcaattcacagcatggatgtttgctccttcaaggccagcaggtggctgtctctcactcttcaactctctttgacttctaagggtcacctgattaggccaggcccacccaggataatcttccttttgattaactcaaagtcaacctaataacagtgtgaaatgccatcatatttgcaagtccagcccatcctcaaggggagggcattatgcagggggtgttcaccaggggagcaacaatcttggcagccagtttagtattctgcaatgcagagacaggaagcaggaaaccaccaggaatactgcagctccctgggaagagcagtggcgggacttgattacaagccctagtcatgaatagatgaggagctgagagacacagaaggctgtggggagagggccaccaggaagatgctgggtcctttggttgaaggacacagctagtccatagttacttggcaaggagggagctagaaaaataaatagcctgacctcagtttcctttcttttttctttctttccctccttctttctttttttctttttttttttttgagacagagttttgctcttgttgcccaggctggagtgcaacggcgtgatcttggctcactgcaacctccacctcctggtaaaagggattctcctgcctcagcctcccaagttgctgggattacaggtgcccaccgccatgcctggctaatgttttgtatttttggtagagacggttttgccatgttggccaagcttatcttgaactcctgacctcaggtaatctacccgcctcggcctcccaaagtgctgggattacaggcatgagccactgcgcccggccttctcactttcttttttgagatggagtctcactctgccacccaggcttgagtgcaatggcgaggtctcggctcactgtaacctccacctgggttcaagcgattctcctgcctcagcatcctgagtagctgggactacaggtgtgtgccaccacacccagctaatttttgtagttttagtagagacaggggtttcactatgttggccaagctgctctcgaactcctgacctcatgatccgtatgcctcagcctctcaaagagatggcaaagatcccaaagattacaggtgtgagccaccgttcccggccactttctcactttcatcttctgttgttgctctcctttggctgatcttaacatgaagctgagtaagggagccagcttattgatgcagtcagtagaagccagcttcccagggagatccaggttgggggaatatggagtgtggatcaggagaggtaaggagatgatatttggcaaaagtacttcttagagtcacacatcttgtaatgatagacctcagattcaaattcaagtctgtttaaagtcaaattataccatctatgcatccttccatgcatccatccatgcatccatccatctatccatccatccattcttccatttcctgagtgcctactgtgtggcaggcattctgctaacctaacaacccagtgagagacatacttatattcctattttataaaggcccagagaggttaagtaaataatccagagtcacacagccagggagtggcaaagctagaattcttatttaattccaaacttgatttctaccctctccaccaccaaccacccatatatatccactgaccaacctattcattcatcagacttttactgcatgtctcaagtaagctatgcactgtgtttagagctgaatgagacaccattcttatgtctccatgatattcacagtctggtaggagaaacagacctgtatacaggttattgtgcagtggtcggggacaggaactttgagagaggaacgtatggtgcccacttgtgggcatataggagtgagaggtctgctcagctggggaaagacagcatccttttgaggtgggttttgaaggatgcataagattttaaggggacagtgcatcttggaagggcatcatatctttgtagtccagctgcctctcctttgctcgagcttccttccttccttcaggggttaatttggaaggactgagttttgctgttattgagcaaacagagtcctctaaagtgcatagcccaggggctggaatggagctcacgatgtatgtgtgggggagaaaaactactttgatttgaattcctgtctggctatttttgagatgttatatatgaccttatgagggcccttccctatgtggtcatgtctataagagatttcgtatctttacccactggtgtcaggttggctgggtgactttcagccaatgggatatgagtggaggtggtatgtgctaattctgggcagacccattaagggcccttctgtggtcaccctttggtctccctttttgtgatactatggatagtctttatttattattctccaagggttgtgcctcaccttccctttttactgctgccccaagaccatcaggtttccacaagggggttgcttctttagccttaatcctggaatgaagtgatgagggtcagagccagagctgagctgcaagtgtgtgtcacattccagaggaaggaatggttgttactctaagacatggacttttgaggtcatctgttatcatagcatagtgtagcctaagctgaccacagcaaggcatctcacctttcgacatgttagtttgctcatccatagaagtggattaatagttgtagtcgcatggcaaaaacccatccctacaaaaaaaaaaaaaaattagccaggcatggtggtgcacgactgtagttccagctactcagggggctgaggcgggaggatcatctgggcctagggaagttgaggctgcagtgagctgtgatcacaccactgtactccagcctgggtgacagagtgagatcctgtttcaagaaaaaaacatatctgtagtcatgttattgggttttgtgaaaattaggtgaaattgctcagtaaaagcacagtttctagcccaatgtgtgtctgcactttgcagatgttcaagactcttcttccagtccctttctctgtcatacttatttctccccagggcctttgcatgtccatgctcttcctttgcctgaggctttttctcatttccttctttactcaagatcccatatgcagacctagctcccccagggggccagataaggatgggcttagagccccagaaaagtcaggacaggaaagggatgagaaaggttgcacttcagcaaccagaatcaggaaatctagaagagagttcctttaacctcaacatgtgcatatattttgtgctttatggttttgcattcttttaattttgatttacatcgggtatcttggctgggcgtggtgactcatgcctgtaatcccagcactttgggaggccaaggcaggtgaatcacttgaggtcaagaatttgagctcagcctggccaacatggtgaaaccccatctctactaaaaatacaaaacttagccaggcgtagtggtgggcgcctgtaatcccagctacttgggaggctgaggcaccagaatcacttgaacctgggagggcggaggttgcggtgctgagatcatgccactacactccagactgggcgacagagtgagactctgtctcaaaaaaaaaaaaaaaaaagtgacataattaaaagagccatcatctatggcctttaagtgtcatgtgtgtgctcatctttccttgctttactactcaaagattatcttttccatgtgacctgctctttcctgcctctgtcaccaccaaacatcaaagccttaagttttgtttggctgtttgttatctcttgagaattgagcaccagagctattgggtgggcttgatgttgacctacaatgcaggatgtctgtgggcatgactctctcctaggcactcacagacacttgaagctggggactgaggtcctctagtgtgtgtctgtgggggtgaaggagtgcaccctcatcctcctgcactttcgggtcttgtagcagcaactccctgtttctgtcctttctacttactgctggtttcatcacactcccagggttaatttaaagaaccagcctcggtgtgatgcacctacaacaaacagagccacttctgtggggagctctggagctgggatggcccctcagagtctagaggtggtgagagcgctggagcttcatcaccgtgctaactgtgtccctggaagagtgagggagcttgagtgattccttacccaagggccgtcataaaaggtctcagctgatgcctactgccgatcacattcagctatttgggaagagatgttcagtccttaagaggacattattagtggacatcactctttccacaaaagccccagtcttgtgttacttagtcccactagcttctttaaagaaaccccaagagcatttcctccaggaatctgtttgatctcttttcctgggggagatttccaggtgattctcattggaatgaatcctaggtcctgttgctgctgctggtctcacactgtgactgatgctaagtccttctcttccaccaccattctggattttccttgctatagcctaagtgtttatgtctccccaaattgtcagcgttggagcaccaagaagacaggcagcactgacagtagcagaagagtaggaggtggctgtggcaccccacgccgagcaggagcgggaggagttcctgggcgatggggccgcagcctgggccgatgctgaccatgggatgagatcattcttcactctgcaccgtgaccatcagggggcgccccaaccaccttttctgccccacatcgtgctcttgcagtgttctccccgcaggtgctgcatggagtgagtggcggcatccaccgtgaggaggagaggagctctgataccctcaggacccgccaggaggggcatcacggaggcttctggacgacttggagctgtgtcctggggagaaaaccgctcctgtctgggccctgagtgctgaggaggaagctgccatgcacttttccctggcatttttcctgcatggtgagtacagaagctttagttttctggtatgttctgttcattcctctcctgttctccctggttttcctctttctcttgtagtgttttagtatttattttacagtggtattcattctctgaaggcttttgagggtgtcaagtgtagcagactgtggtatttttaggggtttaagactttttctgggtgggggggaggggggagggatagcattaggagatatacctgatgctaaatgacgagttgatgggtgcagcacaccaacatggcacatgtatacatatgtaacaaacctgcatgttgtgcacatgtaccctaaaactttaaagtataataataataaaaaaatcttggtttttattaaaaataaataaataaataaatacatttctagttctgaaaaaaaaaaaaaaaaccaaaccaacaacagaaaaagactttttctgagggaacctcccctgtgtagagggagagagagggaagccccgctcaggttggagtcagggccaggcccagttctggctggctgcctcgtgtccaagcctcagagggaggatttgcattgggccttgctgcatttttaaatcttcgttcctgccatcaggacccaggggtcactcttcttcacttttgggcagcgcgtgtcctctcgtgtccctcccaccgtggccgcctgaccaggggcgagggactcctcggtgtgggttttttgtcctctttgcagaaatgtctgttctgggcctctgcccagtttggggtggattattttttgttgttgttttaaattgctatttagtactgttaatgtgttgtatattttcggtaagaaccccttagcagttatatgattcctcaaaactttcgtccaaacttcgggctcattttttccgttgtggcacagaagcttttcagtttcttgtagcctcacatggttgttcttgctttccttgcttgtgattttggtccccaatttaaaaaaatcattcacaaaccattccattctccatgaggtttttaccccttatgtattcctctttttctttttgaaactctttccaactgatgagcatggattcaagttgtcctgaaagtaagctccccctatcttttcttacaggaatttaataatgttttgtggtttcaggttttgtgttgaaatctttaatccattttgagttgatttttgtgtatcgtgtaacagaagggtcctatttcttttcttttcttttttgcatatggatatcagtttcctcaaaatgatttcatgaagaaactctcctgtccccattgtgtctttctgatctctggtgccgatttcatttgctctggagttatacccagtagtgggattgctagatcttacagtatttgcattttctgtcattttctttgagacggggtttcttctgtcacccaggctggagtgcagtggtgcaatcacagctcactgtggcctctacctccacagcccaagcagccctcccacctcagtctatggtagctgagaccacaggcacacaccaccatgcctggctaagtttttaaattttttgtagagacagggttttgccatgttgcccaggctggtctcgaactcctgagctcaagtaatctgcccacattgaccttctggtaattgtattttcagttttttgaaaatggcaacttccaactttttaccatagaatatgtactaatttatcttcccatcaacagggtataagagttcccttttctccaaatccataccagcattctttttaaaattttgtggccaggaacagtggctcatgcctgtaatcccagcactttgggaggatgaggcatggtggtgtgcacctgtagtcccagatacttgagaggctgaagtgggatgatcacctgagctagggaggtcaaagctgcagtgagctgggatcacgacactgcacttcagcctgggtgacaaagtctgagtccctgtctcaaaaaattaaaaaaaaactttttagtaacatttatttcaataaaagtgaaacggcatctgaatgtggttttgaggtacattttttttctgatgagagacgttgaggaccgtttctcttacatgttggtcaattttgtgtcatctttgcagagatgtctactcaagttctttgtattggtttggatatgtattttgctacattgtattttttttctgtgtatatgtttgataacaaccagtgattgagttatcgcttacatgattccctttctttttttttttttgagacagagtctcattctctcacccaggctggagagcacagtagcacatcacatgaccatatatattggctacctacagctttgcaatgtaatttgctatcaggaattgtgagtctcccaacttagtttgtatttctcaggattccttagaggttcagggccattagtggttctatgtgaatattagcattttatattcatatttcttaaatttttgccatgtataataacatacacaattagaagttatgctgggacatgtttttttctttggggacattttgatacatgtatactttgagtaatgatcaaatcagggtacttatcataactattccctcattgaggtattatttctttgttgtgagtacattcaaattgctcccttctagttttttgaaaaatacaatattttgttaaccagagttacccagctgtggcatagaaaaccaaaatgtgtttcgccaaactcactgtaactttgtttccataaccgatccctcccatccccctcctatccccctccttcccctctcctcaggaaaccgctactgtaccttctgcttgaaggtaaagttttttggattccatataagtgagatcacatagtgtttgcctttctctacctagtcgatttcatttaatgtaatgtcttccaggttcgtctgtgtttttgcaaatgacatgttgtcatgaatttttatgcatgaggcatatttcatcatgtctgtatgctgaagtcccttcatcctttcattggttggtggacaggtaggttgatttcataccttggttactcattgttagtgagtagtaggtcactaaacctcagaaggcagctgttgcttcaacagaccgatctcattttctttaagctcacaaccacggttagaattactagatgaaacagttcttgcatttttaatttctgagggtgctccaagtggttttctcagtgcgtttcatcattgaaatttctcccaatagtgtataagaggatctctatatctaacagcaccctgaacttttatttttaaattatttctgttttggtattattcattttacttagcgttagatagtatctgagtgtggtctttatttacagttttgtgatgaccagtgatgttgagaaacaccttttttaccttttaatcaatatcataccttcttttcagaaatgtctgttattcaggtttttttgcccagtttttttgggggtattgggtcttgtatgttttgtccctctgtagcgttagtttctgctgttgtcagataacactccctttcagatatatgattcctcataatttcctttttttgatgtgtaaaaagataaacctattgtggcaacagccaagaacggtaataatcaaatgcaggaattaggtgccatttatatttccccactcagagtataagacttcctgcctcacagaagtaaatgagatttttctgtgcatatagtaaaattttacttttcatattttaatttttcgtgtcctaaaaagttaacacaatttaattaaaaattaaagccactaaaacatttatgtaacaatttctttttaaattttactttaagtcctgggatacatgtgcagaatgtgcaggtttgttacataggtatacatgtgccatggtggtttgctgcatctatcaacccgtcatctaggtttcaagcctggtatgcattaggtatgtgccctaatgctctccctccccttgcccccaaccccctgacatgccatggtgtgtgatgttcccctctctgtgtccatgtgttctcattgtaacaatttctttaattaccacataaggtactatgttatctgacaaatctatgttttacagagaaattgtagaaaagtcattcacaagtttcttcttgatttcaaactgtaacacaatgttgtaagtaatgcaactagacagaattcggctggatattgaaattcaacataataaaaaatatatatgctggtttatccatactactcacactgttagtatgaatgctctatcctaaagacagaaacaagtgtcttagtgaatctatatcattacaaactagattagcttttctccttttgaattttagaaaaatacaaaaattcaattgcctaattattgtacacagtgtttcaatatatgcatgactaaagcaattataggatttttttttttttttttttttgagacagaatcttgctctgtcacccaggcctgagtgcaggggcgcgatcttgactcactgcaacctccacctcctggctttaagcgattctcctgcctcagcctcccgagtagctgggactacaggcacacacaccacacccagcttattttggtatttttagtagagacagggtttcaccatgttgcccaggctggtctcgaactcctgacctcagatgatccacccacctcggcctcccaaagtgctgggattacaggtgtgagccaccatgcctggccacaattatagtttttatataggagtaagaaaggtcttaaatggaaagattaaaaaggattgcaaatcacatggcagcagaagggagctataattataacatgtcagcaagaaaaccaaaaatcacctttcaaatctagaggattatggaaagatatctgaaaaaattgtacacttctgataaaggcagtttattttacacaaaatgcttaccaataatgtgcatgaggaaaaagtgaactcagaagttgacaagggaattcaaagagggaagaagaatttttgtaccaaatgctgcttgaataacaaaatataaatatttgcatcccattctcactccatacggaaaacaaatgggtacttctttctaaccttggaacaggtagaagtttcttgtaaggacacagaaagctctaaccctacataaagacatttataggttaaacttcagtgaaaattaaaggttatcaaaagacactataaacatgaatatgcaagccacagacttggggaaatatatgtaatacatgcatttgtcaaataattcatctcatataaagaacttttacaagttaacaatacagaggcaaacaggccaattaaaaagtagaaaaacttgaacagacagtttgcaaagcaagacatacaaatagccagtgggtatattaaacaatggtcaacatcactaacagtcaggaagatgcaagttaaaatctcaagatacaatttcatttgatttcacattttagccactgtaatggcaaaatcaaaacgactgataatactaaatgttgatgaaaataagaattaaccaacactctcataaaactggtggaattgtaaaacaactactttggaaatggtgtagcaatttcttgtaatattaaatatacacttaacctatgactcagcacttttactccaagctgttgatccaagaaaaataaaaatgtacattttagtacattttttagtacatttagtacattttttctagtacaagtctatgtgtgtatgtatgtgtatgtatgtgtatgtatacacacgtacacctacgtagacttgtactagaatctaacatagcagtcttatttacgttaacccaaacttggaaatgagccaatgtcctttgacagtgaataaataaataaaccatggtgtatcacacaacagtatatattcagtgattaaaagagaactatagaatcgcacaacagcatgggtgaatctcaaaacagaaaaatgtatttagagaaggaagccagacattgaaaagtgtggatgtgtgattccatttatttgaaatgcagccataagaaaaatttatctttggtgacagagctcagaaggtagttgtttttgacccatgaaggtactgactggaaagagatgtgagaggattttctggaaatgttctatattttgactgggatagtaacatgagggtctataactgtcaaagctcacagaagtgaacatttaaaacttctgcattttacaaagtataaattgttccataatttaaaacaataaacagtctcatatcattcattccttcaacaagtaattatacaggccttgccttttagtagttctgcagccttgtgaagatttgaagatttcttaacctctctgagatcatctagctcaagccaaatgggataatcataaaaaccacctcaccagggtattgaaaaaattagttataaaatgtttaggtcagtgtgaggcacatactagatcctcagtaaacattaactgattctatatttaccattcagcacccagacttgagaaaggggcaaggcaaagaggaagctcagccaatatggtttaaagaacactaaactgtgtaacaaaactattttacattttatagagtttatttttattattttggttgacaagtcaattgtatagatgtcttgagtacaatgtgatgttttgatatgtgtacacaatgtggaatgattaaataaagctaattaacatatccatcatccagctcacctttgtggtgggacatttgaaatttactcttagcaattttgaaatatatgatagattattatttactatagccaccatactgtgcaatagatctcaaaactttattcctcctaatgaaaactttgtaccctttgaacagcatctccctgtctgctgtaccccccaacacaccccagcctctcataaccccttttctacctgttatttctataaatttggcttttttagattccacatatacatgagatcatgtacttatctatcctgtctggcttctttcacttagtgtaatgttctccaggtttattcattttgttgcaaatgacataatttccttcttttaaaaaaatgcccagcagcactaatcattagggaaatgcaaattaaaaccacaacaatatcactttatatctgttagaatgattaatattaaaaaaagaaaggtaacaagtgttgaagaggatgtggagaaaatggaaccctagtacatgttggagtgaatgtaaatcagtacaggcattatgaaaaacggcacaaaaattaatcaaataactaaaaatacaattaccacatgaggtcaggtgcagtggctcacactgtaatcccagcacttcgggaggctgaggtgggaggactgcttgagcccgtgaggtggaggctgcagtgagccgagatcatgccactgcactccagcctgggcaacagagcaagactttgtctcaaaaaaaaaaaaaaaaaaattaccacatgacccagcaatcctacttctggctatatccaaggaaattgaaatcagtatgtcagagaggtacctgcacccccatatttatggcacattattcacaacagccaagatagggaacaacctaagtgtctatcaacagatgcatggataaagtgtatgtgtgtatgtatatatatattattatccttttaagtcctagggtacatgtgcacaacgtgcagatttgttacatatgtatacatgtgctgtgttggtttgctgcacccattaactcatcatttacattaggtatttattctaatgctatccctcccctatccccccaccccacgacaggccccggtgtgtgatgttccccaccctgtgtccacgtgttcttattgtttaattcccacctatgagtgagaacatgcgctgtttggttttctgtccttgcgatagtttgctcagaatgatggtttccagcttcatccctgtcgctacaaaggacatgaactaaactggctagccatatttagaaagctgaaactggatcccttccttacaccttatacaaaaattaattcaagatggattaaagacttaaatgttagacctaaaaccataaaaaccctagaagaaaacccaggcaataccacttaggacataggcacgggcaaggacttcatgactcaaacactaaagtatgtatttttttaaagaaaatcctcttcagtgattttctaatttttctagattttctagtttttccatgcctattttcagcaggttgcattgacatgtacgtggtgacttagctttctgaaaagagctatggtataatgaatatatgccacttgccagaaaccatggtcaacaccatacatacctcattcctaagtgacctataaacatagcaaggctggcattaccatgcccattttatagatgaaaagatcaaggcttggtgatgctaagagacaggtctaaagctacaagtttacaaagtaacaaagtcaatttaatcataagcacattcatttctttgttcacttttcagatacaatgtttaaaaatatgtcaaatgataagcattgcctatttgttttactctgaaatatagggatgtcctttgccagctacttaaaaatgttttgtccttactctgaaatatgaataactgatgtgtttgtttttgagacagggtcttactctgtcactcaggctgaagtgcagtggcatgatgtcggctcactgcaacctctgccttccaggctcaagtgatcctcctacctcagcctcccaagtagctggaattacaagcatacaccaccaggcctggccgattttttgtagagatggggttttgccatgttgtccaggctggtcttgaactcctgagtgcaagcaatttgcccaccttggcttcccaaaatgctaggattacaagcatgagccatagtgccctgcctactgttgttttttgataacttgtctgccctcttcctccctttcttaccctccctcccctgatggtctccctctcctttatagatacagggccagtggcctcaagccagtaccttggatgtttacctctactgtattttgggctaggacattataattaaatttaataactattgaaacaaacgtcaagttaagattttgctacaagaaaggtgggtggacatatattaatagtttgggagtaaatgtcaatctttacgttcctgagaccttatattttatttatttatttattttgagatggagtctcgctctgttgcccaggctggagtgcagtggcatgatctcggctcactgcaagctccacgtcccggggttcacgccattctcctgtctcaacctccccagtagctgggaccacaggcgcccaccaccacgcccggctaatttttttttttttttttgtatttttagtagagacggggtttcaccgtgttagccaggatggtctcgatctcctgaccttgtgattcacccgcctcagcctccccaagtgctgggattacaggtgtagtaagccactggcccagtctcttttttttttttcctggcagttactttctaaattacatgttttttgttttttcctttaaaacctttattgttgacaggtttttccacttacattatttatcttgcctgggccatgctcttccctaaaaattccactagagagaaactagcttccaagctttttcaggttgttagcagaagtaacttccttgaggctgtagctccaaggagctcagctttttgctgcctgttggctgaaggctgcccacagttccttgccatgtgggcttcctcaacttagcagtttacttcatcaagccagcaaagtggatatgtgtcccagtctcctacgacgcagtcctaaataatgtggtgaagggaagtcgtaatcaatgtcatcaatggactcagataaatcacatcatttttgctgtgttctctgggttagaagaaagtcacaggtcccattcacatggaagaggaagggatttcacaaaagcatggacaccaggcactttatatctatccatgcccacattttacagaacaagagaaagaccataaaatgaaactcttgagaaatgatcattcaacatatgactttagttgccaacctctcaggctacttttaaaaatataaacatatgttccagtttagatatatgaatatttgaacactttcctggagtccttcttttaagatcacaaatagggaatataactttatagcttagatgatatataaaaaataaagatcagatgtaaccagaaactgagtttcttttttttttttttgagatggagtctcactctgttgcccaggctggagtgcaggggcatgatctcagttcaccacaacctctgcctcccaggttcaagtgattctcctgcctcagcctcccaagtagctgggactacaggtgcctgccagcatgccgggctaatttttgtatttttagcaaagatagggtttcactatgtcagccaggctggtcttgaactcccgaccttgtgatctgcttgccttggcctcccaaagttctgggattacaggcatgagccactatgcctggcccagaaactgagtttctactctggcaagttaaacaaaaaattagtacatatcaggctgggtggctctaggccacatgcaagcaagctgcaaactgaattgcctctgcagctgcagaaggctaatttctacattgatatttggaaacactaacagctagaaaacaccactctactcatttttaaaaataagatcatattaaatgatgttacatgcatcatttatatattgctcgcagtgccagcatcctcaaatatggttttaattttggtagatatcttgctagggggagcacatttccaagttatccagatatagggccctctttccttctctttctgtccacgtgcaaccagatgctttgtggagttaaagttgacatttatttaaatgccacttggtgtctggtttttcacctttaatttagggttttctagctgggatgtaaaagaatcacttggagggatttttcaaaataccaatggccaggccactagccagtcaatcagaagcaaaatctccttggatgggacctggaagtctttacagttttccagcattttaatgaacatccctgattaagaaccaccgggtcttaagagtgtggcatatgtatttttcaagttcctagaggctctccaaaacaaaacaaaaaaaatctgctttattctctgcctggtgttgatgcatcagtctctttagccgttagtctgatcctggaaatttatggtcataatttgatgagcaatgttgggaatgacttcttcctttttttttttttttttttgttttgagacagagtctcactctgttgaccaggctggagtgtagtggggcgatctccgctcactgcaacctccaccccaatactttcatttttaaatattatttatggcatccagatttgcataagatggactgggtcaatggccatgccctttataaatcaatattcttaagttctgcaaattcagtttcctaaagagccaaatcacatcctactcatcagcaaggcgggtagacatcattttcacaatcacttctaattttccaccattgtaaaaaaaataaaatatgtaatcactttcttattgtaaaataaagaatttacttttccaggacctactgcctccctgttcccccccttttttttttttttcaaacaatcttgaaccctttgtcacgagtcagttgccaagagaagcctatttgttggtttgagagcagttcatacagacacagaccacttcctctgagaattcatttgcttccccaggatggaatctggctgggcctctgaccttgctggtcacgtgggccggggcctccatcagtcataccctggactcctatctgtgtctaaacaccacgccccacccccaactgcacggcagccactcgcatagcactctgggagggctgtgggcatgagcagcgaggactccatcagcagctcccccacataagccctgctgatgagggggcttgcgaagcagctttgatgtgctggtaaatccaggtgcaaaacagaactcaagttaaggcctccgcacagcactgcgttctaactgtgaaggattcttactctagtgtcctgtgtggaggtattggaattgtccattgctaagactcagaggagaaaagcacttagcatcgcaggacttggagcaccggtgctgaggcaacccttcattcattcgtcggatgtgtgttaaggcccagggcaggggtcagggattctcctctcacacagcacgtgggtggcaggaccaacaccgggtctgacctcccagccgggggcacaggctgctaaccccaggcctggaatctgtcagatgcccttcccgtgctgacttgacttagacaggcctcctgaccttcccacaaaggtcatgtgtgattcgcaggggttctggccgcttgaaaggttcctgagaaagtacatgcaatgaggacagagcttgcagagggaggacaggcatgcagaaggctctgtgtgcagccccagacctgggtaccttcgtcaccgtcctcaccccacctccgggtgcgcagatagggagcaggtctcctgtgttatggcccaagcagggctgttaggacactgagaacattccctcctcccgcaggagagagaggtccaaggtgccctacatcgtgcgtcagtgcgtggaggagatcgagcgccgaggcatggaggaggtgggcatctaccgcatgtctggggtggccgcagacatccaggcactgaaggcaggcttcaacgtcagtgagtgtcggcctgcgcaggacgggatggaggtgtgggcagtggtgtccacgatgagatctcagagtgctccatggcccaggcatgtcacatccttctctgtgtcttttcttcatttactgttttattatttttaaaaaagagaaaacaagagttgtacaaacagcttctatagaagccagtttttacaccatcgtacccactcgtgccacttggtgcagtggaccaggggcttctgcggggccttggccttcctgccttggggttggacaggaggtggaagcccaggactcagtgcggtctgtccactgccctgtatgaggatgtggtgggcagagggcactgatgaaattcagcgcaggccggggctgcagcctctccgcctccatctcaccaaccctcacaggctttgaaggacccggacctgcctcaaatgccaggggagggcactgagaccccagagggtccttcccagcatcttcaaagcaacaggattttgtgcctgcagatccttctttgcagcacacaccacccaccctgaccaggacccctagaatgcccagcatccctgggagggccctgtggtagtttcagctccctctgagggcccagaatgaacctggcctgtggtgaggatgtaagcaccaatggccaattgggtccaaaggaagacaccggttcaaacactgaaaccaatcagattctcccacggccttcctgctatcagaagacactggtgcaggggtggttgctatgtacagggcagagccacccaatccccacgcaggcgctgtgtcctgccatgctggcctcctcctggccatcacatcaggccaagcaggggagaggaatgggaatgcccacgcacccctatcaactctgcagacacagaaccatgcacagctcttgggaggagtcagatgagctgctcaaagcccaggagggacccacacagtggtcagcatggcagggacggtgctttagccaaggcagggatggtgggtgactcactcaggatcttcaaggaggccgctgcatttccgtgctctttccagataacaaggacgtgtcagtgatgatgagcgagatggacgtgaacgccatcgcaggcatgctgaagctgtacttccgtgagctgcccgagcccctcttcactgacgagttctaccccaacttcgcagagggcatcggtgagcactggaggccttggcctcatgggagacgtctcctccacgtgcactgctgccctcagaggctgtgaaaagtgaggtgtgggaacccgagctgtgcttcctctgccatggtcggaattttaacccaacctcaaaaagcaggggaccaaaactgagcctatcctggaaggccttgcccatccccagagggctccccatccatatttctcaaggaggccaagtgggtgaaatggtcagcactgccgtgctgtggggtcctaaagtctgctgtcctccttcctgcagaccagggctaaacactggtgcccaggtgctcttgccatgggtcctggtccagccaagcatggtttcaaacatgacctgacccttagtcaacctggaggctgatgtctagagtgggcgctggagcgtgcagcacctgtagcctgtgcatcacccttagggcaggtctgcctcccgggcccatgcacagaggacctggtctcccagcctgcaggtgcccctgtggtgtccaggatgtcgagggggtctctgcgtacttggtggggctgggaccctcccacttcccacctccttgtgtccctcactcccctgtttcattccatgctgagcctcccctgccttgggctccctggggagggggtggtggcaggagttgcccgagggcagctctgcccatgagcagctgctctagcggctcctcctgctgctgtttgccgggtgctgctgacccctgcgaggtagagaaaaggcgttcaggtggttcacaccccacacaggtgcccctcacagggtcctcactggcggccagcgctgtgggtgtgacgatgatgacaagcctaaactgcgcaaggactcgtgtccctggcgctccatgtgaccacctcgggagaggtctccggcttgtcgtaacccaggggagtgacccactgcctcctgcagctctttcagacccagttgcaaagaagagctgcatgctcaacctgctgtcgtccctgccggaggccaacctgctcaccttccttttccttctagaccacctggaaaggtagcccagctctcttgtggctgcccaggactccaggtctccaggccgtggggtgcccctctgctcccaccagacccccagcaccaaggaccttttcccccgacccctgtctgcagtaactcactgcttctaaggactagcaccactgccacccccgcccctgcctctcctctttgccaccctcctccctctgcactgtggccttaacaaagagctcagagctttggccgtggccagcagtgcatttggaccgcccccccttccctcccaagcacatcaggaagacctccccatcagcccagagctggccccttgtcctgggccactgagacccagaagtaccaaggctggagtcagcttgcagcacagccagggtcgaggtcactccctccctgaggactctagcacggcacagcccctctgcctctctcctggtggtggcgttgaaacagcaccctctgcttcggtcctctacaggatggcagagaaggaggcagtcaataagatgtccctgcacaaccttggcacggtgtttggccccacgctgctccggccctccgagaaggagagcaagctccctgccaaccccagccagcccatcaccatgactgacagctggtccttggaggtcatgtcccaggtatgggaagacagcctccagcccatgcaaccccagcctgacagaggtggcctctgcctgccccacccccagtcctgcccatcttccgacttgcattgtatgtggtggtggctgagattcagagacagggacttgcctaggtttgcatggatgggagtgatagggggtgcctaggccacctcctggtcctgctggtgcaccttgctgggggcttaaaaccaccccaagtgttcgagtgtggtggctcatgcctgtaatcccagcactttgggaggccgaggcaggacaactgaacccaggtgtttgagaccagtctgggcaatgtagcaaaccccatctccagaaaaaatacaaagaaaaattaggcaggcattggggcacatatctgtaatcctaggtatctgggaggctgacacaggaggattgcttgagcccaggagttagaggctgcagtgatccatgatggagccactgtactccagcctgggggacagagcaaggccctgtgcatctctaaaataaataaccaccccccacccaacaagtcatgccttgtcaggaccccaccccacccccgtctcactgtaaggggttcatgacaccagcaggggtttctagcacctgaggtggacttgggatcttgggccccaaagacctcccaccagcagctgtgcgcccccttccgagccactctcctcttccccactccgcgagggcaggtcgaggtgctgctgtacttcttgcggctggaggccatccctgccctggacagcaagggacagagcatcctgttctccaccgatgtctaaaggtcccagtccatctcctggaggcggacagacggcctggaaacctctggctaatcaggccatctgtagagtgggaatcaagattttctgaggcatccttgggccacccccaggtgtcaggccatctgccaagagacagcggcccaaagcagaaggacaggtggcctgggcagatcccgcccaggtctgaaagccccaggctggcctcagactgtgggttttttatgtggccacccgagggcgccccaaaccagttcatctcggagtccaggcctggccctgggagacagggtgaaagcagtggtttttatgaacttaacttatagagtccaaaagatttctactgaatcacttgtcaagaagcgccctctctggggagaagggaacgtgactggattccctcactgttgtatcttgaataaacgctgctgcttcatcctgtgggggccatggccctgtccctgtgtgggtggggcctcttccatttccctgacttagaaaccacagtccacttagaacagggtttgagaggcttggtcagcactgggtagcgttttgactccattcttggctttcttctttttcttcccagagggatttttgtgcagaaatgggtcttttgttgccgtgttagtcctccttggaaggcagctcagaaggcccgtgaaacgtcgggggacaggacccccagggagggaatcccaggctacgcactttagggttcgttctccagggagagcgacctcgtcccccgatcctgaccgcccttccggcccacgctctcctgtttggcttccacaggcctggacttctctggcttctctgcccacacactccctgcccccagtgtccctgcccctgccccagcacaggtgacttcatttctgtcctctcagctcagtggactcgctcaacttttgtataagtctccacttggtggtagcagcttgctgatgacttgttttaaaactttcatcctaaataaccttttgatacttgaatatttgtaagttttatacatagtttctaattttttccccaacagatccagatacctaataagatgctggaatgtaatccctggacaatccgtgtcctggcagcatttggtcttcctctaagcgcctggctccgctgttctcaggagtgggttctgaagtctctggagaacaggatacgtggagggttaggaaggggccaggcctagagacgggagactccctcccggagcaggtggaggcacaggaccattcgctaccccatctgccggcacctgcgggggagcccaggcattgtttgtaaaccctcctgactacctgactcaaagaaaacagaagcatggaggccgccaagtattttcaagaaataatcccatgaacgtggcatcacttttttagaaagaggggcttggggcaggcagaggagagaagggagagcaaactgagagccaagtttccagacggtcctgcaggaggagaggatgcagctgcgcagagggaagcaggatcacatttaaggaagtgtgtggggtccctggatgacaccagcacccagtacggctctgtctggcaaccgctcccaaggtggcaggagtgggtgtcccctgtgtgtcagtgggcagctcctgctgagcccgcagctcactggggagcctgacagcggggccatgtgcctgacactcctctctgcttgtggacctggcaaggcagggagcagaaaacagagccacttgaaggctttctgtctgcgtctgtgtgcagtgtggatttagttgtgcttttttcttgctgggagagcacagccaccatttacaagcagtgtcaccctcgtgggtggcgaggacagaacaggagcctctgctctctgtacctatctgggcccggtgggctcccttgtcctggcttccatctctgtctcagcaaccattcagccctgcgcaggaacacgtgttgcttagaaaagccaaatccagccttgtctctgcctcctctggtctcatgatgtgcatctgttaccttgaaactggaaaccagtctatcaatgtctgtgccaattttttattccctccccaacctccttccccatacgactttttatttatgtaggatgtgtgctgtctaatgatgggatgaccacacttttccatgttctaaaagtgctcctctcccgcagggtcccagggctggtggttgctttgggtctacagctacgtcttacccgcctcctgcctcaacagcctgtgtggtggcaaagccggtgtggggctggggaacgcagcgttctccaggagggggacccggctctccttctgcaatgcaggcgaaggcctagatgccagtgtgacctcccacaaggcgtggcttccagactccccggccggaagtgatgcttttttgccgtgggccctgggtttgaagcagcctggctttctcttggtaagtggctggtgtcttagcagctgcaatctgagctcagccacctacacaccaccgtggccgacactttcattaagaagtttcctgagacgacttgcgtgcatgttgacttcatgatcagcgccgctgggaagaacccctgagccggtggggtggggctggaagcagcaggtgcagtgatggggctgggtgcccaggaggcctcagtgctcaatcaggccaaggtggccaagcccaggctgcagggaaggccggcctggggggtgtgggtgagcacaggcaggcaccagctgggcagtgttaggatgctggagcagcatccgtaaccccactgagtggggtagtctggttggggcagggaccgctgttattttggcagagagagatgatccccactggggagaggctgttctgactctgcaggtgggacagggacagatggccaccagggtgacccggctggtcttcctttgctatgctaagccctgggacatggaggattcctgccacacagcctgggcccgggttcttacctgtggccaccgctctggcacgagcccctcagtcttgggtggtttctgcctggtccaggatttggtgttgctgctgagtccagcctttccaccacctccgcatgggctgtgggtgttgtcagctgcctcccgccttggcttcagtagctcacccagcttacaggggagctgccctgggctggagatgggcatgcaccctgggtcctacttgaatgaatgcagcttgaggagacccggccatatacactgggccacaggttaccttcggcaatgcccacatcagccgtcagcctgagcctccccaggagagcaaggctcacacgacaaaggctgcccgtggccaatgaggtggctgagcccagccaggacctttctcggactcccgggatgtggctctgctcgtgagctgcctggtcagctctctcggggtgagaggggcttgtcacacgggcccctgcctgcggtgtgacccttctcagcttctctcagcagccctgcctgcggagtgtcaccgccaccatgatcatttccctgacactgcgagggtgtggggacgtcctgggtagagacagggcccgtggcagcagcaggctcaggggcgccctgcactggtgggctggggacctggtggagaccacgccaagggctggacaaggggacgagcctccaccctggcctctccgcaggcctcagcagccccttccacaggcagaagggttgacactgggttctgccctcactgcaagagctgcaagtgccacgtgctgttctgcccaatctggtgtctgcaggtgagggaagggctgccgctggcccgtttctgagtgttcagcacctaagggtgacagcactgtctgtccctaccctccgggtcctgtttgaaaatcaagcccatgctcacaggccgatttttttttcttttagagacagggtctcactttgtcacccaagctggagtgcagtggtgcgattatagctcaatgcagcctccaattcctggacacaagggaccttcctgcctcagcctgccaagtagcttggactatagctgtgtgttttcttattattttgtagacatggggtctggctatgttgtccaggctattctcaaaattcccggcctcgagcaatcctcctgccttggcctctcaaaggttgggattacaggtgtgaggcaaggcacccagctcagccacagagccctgttgcatctctcttactaggagcaagagctgactgccccctcatccccattccagagtgttggggctgtgttcagccgaggccgggccactggcatggcccagggagcgggatcattcactgctgccccaaatctgagatcattccaccttgacaagacttcctcatccaatccctttacttgacagctggggaaaccagtgcacacagagcacccccagctcactcggggtctcagagctgatccatgagcggaggctgagatcctgggatcttgtcccccagcctccctgcaagcttactccctttctgctggaagagatggggccggacctcgaccagcagccctggcctggacatgactgtgctcatgcaggtattgaggccgagatgctccagcatcatatgtttttctttttttttttctttcttttttgagattggctcactgcaacctctgcctcccgcttaaagtgattctcctgcctcagtcttccaagtagctgggcctacaggcttgtaccaccacacctgactaatttttgtatttttactagagacggggtttccccatgttggccaggctcgtttcgaactcctgacatcaggtgatccacctgccttggcctcccaaagtgctaggattacaggcatgagccatggcgtcacttaaatgtagtgagaggccgggcttggcggctcatgcctgtaatcccagtgccttgagaggacgaggctgtcagatcacctaaggtcaggagttcgagaccagcctggccaatatggtgaaaccgtgtctctataaaacaatagaaaaaaatatccctgcatggtggtgagtacctgtagtcccagttactcaggaggctgaggcatgagaatcgcttaaacctcagagacggaggctgcagtaagctgagatggcgccactgcactccagcctgggtgacagagcaagactttgtctctaaataattaaataaatatggctgagcatggtgccttaggcctgtaatcccaacactttgggaggctgaggcaggtggttcatgaggtcaggagcccgagaccagcctggccaagacggtgaaacactgtctctactaaaaatacaaaaattagccagctgtggtggcaggcacctgtaatcccagctacttgggacactgaggcaggagaatcgcttgaaactggaagtcagaggttgcagtgagccgagattgcaccactgcaccctagcctgggtgatggagcaagactccatctcaactaaataaattaataaatacagagcaagattccatcttaaataaataaataaacatacacctgtaatcctagcacttcgggaggctaagacaggtagatcacctgaggtcaggagttcgagaccagcctgaccaatatggcaaaactccatctctactaaaaatacaaaaattagccaggccttttgacgtgtgcctgtagtcccagctacttgggaggctgagacaggagaattgcttgaacccaggaggtggaggttgcagtgagccaagatctcggctgtacttcagcctgggtgacagagtgagactctgtctcaaaaggaataaaaaaaatacaaaaaaaaaatgtagtatgattgcagagtcgtgccacggaagcgtgctggtcctatccatgtagtgaaggctgatttcatacagaaatgtcacaataacttttttttctttttctttttttttgagacggagtctcgctctgtcacccaggctggagtgcagtggcgcgatctcagctcactgcaagctctgcctcccgggtttatgccgttctcctgcctcagcctcctgagtagctgggactacaggcctgtgcagcagatgctggggggccactaggcccaggcagtcttgggacttgtgtctctcctgctgtgcatccatactgggtgctttagaaatggcaggcagaccagaagcccctgttgcaagtgaggacaaagtgtgggaaggccgtgagggtctgcagtactaaatggccttgtcctcaacctgcagtgcactcctgatgcgctggaaagccgcctccttctcctggtccaggtcttcagcagtgacccggtaccccagctctaagggaggtggcagcatcaaaggctcccctcgcctgcgtggcagcaggggaaacttgcatctacagggcctagaggcctgggatctgggggagccacccctgggggcgagtgtctgccctggtgctgtatctgccatcttttcacactgggtgtgacctgaagagacagcctgaggtccgtcctcactcactgtgtttcaggaactgagggtcagctggcagtgggatgaggctggcccccttctccgctttcgttccgggaggcctcccgtagagcggtaggggctcgagatggcatttcgtttggggcacgagctggtccgggaggtctgggatctctggttctgacctctgggcacctgctgcagctgtggctgaggcccagaaatgtgaagggcctccatccactccagtagtgaccccaacgtggggttcaatgtggaggggggaggggctgctgcggcagctgcaggagcagaagtgccacaccttgttcttctcatgcccgcatccatgcttgcagctgggaagggggcaggaatcagcgaggtgacctgggctgagtcctgggaatgggaagaggtggcaggaaggggatctgaggaggagaacagggggcctggtggtctgtgcttcttcccagacatgggagctgtagaggggacccctgcagcagatgctaagggggccagtaggcccaggcagtcttgggacttgtgtgtctcctgctgtgcatccatactgggtgctttagaaacgggaggcagaccagaagcccctgttgcaagtgaggacaaagtgtgggaaggccgtgagggtctgcagtccgagatggccttgtcctcaacttgcagtgcactgttgatgcgctggaatgccgcctccttctcccggtcaaggtcttcaacagtgacccggtaccccagctctaagggaggtggcagcatcaaaggctcccctcgcctgcgtggcagcaggggaaacttgtgtgtactgggcctagaggcctcggatgtggaggagtcattcctgagggcgagtgtctgccctggtgctatatctgctgccttttcacactgggtgtgacctgaagagacagcctgaggcctgtcctcactcactgtctttgaggaactgagggtcagctggcagtgggatgaggctggccccctcctccgctttagccccggcaagcctcccgtggagctgtaggagctggagatggcatttcggttggtgcaggagctcgtccaggaggtctgggatgtctggttatatctgatttctgacctctgggcatggaggtctgtctgcagaggcccgggcccgggcacaaagggagagaggcctccattgtcccgcaggggccgaaatgcagacggtgcatccccggtgacctcggggacccttctctgatcaccaggattctcttggactctagggtccttgtcctgctcaggcatccctgccccgctctccttgagggccctcaacactatcttccctggacacaagtctggggacagccgggtgttgtggaccccaaaggggtgactcccggctcctgggccccacagagagtccatgttctcagtgcagtggctgagctggaggacgccctggaactcggagcacacagcactggcttgctgtggtacctgtgcaatcaaattgaaggcaggatcccaggaaggaaggcagggcttgcaggatcacggaaaaccttcttagagttgtcttgacaccactgatgtcaagtgtccgggtgcttgtaggatggcctgccactcagtccacgggcaggagcaacggggagatcccacaggcaaagtgaactgggggatgggctgaacgggctccaggcaactgagccctactggcaggtcctcggcctgggcccgaacaggaaggaggggcacagagtgcccaggtaaccgctcctgggagcagtggggaaccgtcggttgcttgaactctcgagagctgggctctgagcgtcctcgtccagccgccaactcggccaacggctaagccagcagtttcttctgttgccgggcaacgcgccttttaaacctgagggagcgggcgcgtgagcacatcagggcgcccgtgacagagcgagcttaacggattaataagcgcagccaggtacccgcgcgaggcacttgctggcaatggcgggaggcggacgtggggggtcatgcaataggtactggaaggagagaggcgagcacaaaggtcgcgggaggaacaggtgcccacaatggtggcagatctgcccgtggatcactgaagattcctgctctcctgctgaggtggagattgcagtgagctgagatcgcaccattgcactccagcctgggcaacaagtgcaaaactcagtctccagataaagaaaagaaaaagaaaaaaaagaggccgggcgtggtggcttatgcctataatcctagcactttgggaggtcggggcggacggatcacgagatcaggagttggagaccagcctggccaacatagtgaaaccccgtctctagtaaaaatacaaatttagtcagacatggtggcacgcccctgtagtcccagctactccggcggctgagacaggagaatcacttgaacccgggggctgggaagggattgcgatgcgccgagatcgcgccactgcactccagccctgggcaacagagccagactctttttttttttttttttttttttgagacggagtctccctctgtcgcccaggctggattccagtggcctgatctcggctcaccgcaagctccgcctaccgggttcacgccattctcctgcctcagcctcgggagtagctcggactacaggcgcccgccaccacacccggctaattttttgcatttttagtagagacggggtttgaccgtgttagccaggatggtctcgacctcctgacctcgtgatcagcccgcctcggcctcccaaagtgctgggattaaaggcgtgagccaccgcgccgggccgagactctgtcttaaaaaaaaaaggcctgggctgtggcactttgggagtcggaggcgggcggatcacgatgtcacgagttggagaccagcctggccaacatagcgaaaccccgtctctactaaaactacaaaaaattagccgggcgtggtggcgggcgcctgtagtcccagctactccggaggctgaggcaggagaatggcgtgaactcgggaggcggagcttgcagtcacccgagatctcagcactgcactccagcctgggtgacagtgcgaacctccacctcaaaaaaaaaaaagagagagagagagagagagacagagagaaaaaggtttattgatttaatgtacttttatgcctgtgttcttcaatttgcttaggaaagacccacacttgagagctgggactgtgtccctgattgtggacatgaaatatgtggtttcttgccaaaactagacactgaataattacgatttagttgagctagaaatccatttggtttcttccatattttcccaaaattttcatcctttttttttttttttgacatggagtttcgctcttgtcccccaggctggagtgcaatggcgcgatctcagcacctgctggcaatggcgggaggctaggggacgctggcggcataggtactggaaggagaggcgcgcgcacaaaagacttgggaagacctggcgcgcacaatggctgcagatccgccagtggatcactgaagattcctgctctcctgttgaggcggggattgcagtgagctgagatcacaccattgcactccaacctgggcaacaagagcgaaacttcgtctcacacacacacacacacacacacacacacacacacacacacacgaaagaaagaaagaaaaattagtggccaggcgtggaggctcacgcatcccagcactttgggaggtcggggcgggcggatcacgagatcaggagttggagaccagcctggccaacagagtgaaaccccgtctctagtaaaaatacagatttaatcagacatggtggcacgcgcctgtagtcccagctactccggcggctgagacaggagaatcacttgaacccgggggcggggaagggattgtgatgtgcctagatcgcgccactgcactccagtcttggcaacagagtcagactctctctctctttttttttttttttttttttgagatggagtctccctctgtcgcccaggctggattccagtggcctgatctcggctcaccgcaagctccgcctaccgggttcacgccattctcctgcctcagcctctggagtagttgggactacaggcgcccgccaccacacccggctaattttttgtatttttagtagagacggggtttgaccgtgttagccaggatggtctcgatctcctgacctcgtgatcagcccgcctcggcctaccaaagtgccgggatttaaggcgtgagccacagcgcccggccccgagagtgaatatcttttaacagtgtttttcctgatcttttccaacatcttcattgtggttctgtcctttattttttggttaaatccagaggtttacttctgcctgtatctttccaaactattaatctgttcacaatcactctcccatttaaacccttcagcagccccagtaccttcgtaataaggtctccttagcttggtatccagaacacttcaatactgggctttgacccctgttctccttcccccacctctgtttaggtgcttcactgagctgcaccgaacagctcttggccccttgaaatctctgcagtctccttgtctccctctgctggaatattcttctctcacttcatctgatcattgccttcaaaactcagctcattttcttatttccttgcccttttcatgtcccttgttttcctccgattaaattaatgttccaaactcaaaagaaaaacaactcagctcaggcatcaccttgcctggaaggcttccctagtcctcctgcctcccgcagacttgtctggcaccctgtgcatttgggatttggcacactatgtctcatctgcggcctccactggacgatgagaccgtaagtgtgtggcttgacggaaagttgttgactctgctggggtgctggtacagtgctgggcacggcagtgttacagaggaagtgagccacttagtttctgcccttaggagcttttcttctagttgcagttgaccctgccagctgtgagacacctcccagtagtgcataccaactttcaaagtctgtttaattgtatcttagtgtctgattccaattttatttcttgaaggaggggagtgtctctaatgtcttattttggcacccagagaccaggtaggcatcatttttgtcccaaattgtggaaggaatgtacatttggcacagattacttcccttttttctcttgtacacctttcaccttttttgtttttgtcttttttttttttgagtttgatgtgtttggacagtaagggtttacgagattaagattaaatttcaactttgtctattgtgcatatagcctaaggaaaacaaaaagaggaaaaatacattgcctctaaaaagaagactcattattcaactttttttatttttaattgttttcagagactgggtctcaccctatcacccaggctggagaggtgatcacagctcaccgtagccttgaactcctgggttcaagggttcctcttgccttagtcttctcactagctgagactgcaggcccgcaccagcacacctggctaattttacaaaaattgttttggagagatgtggtcttgccatcttgcctaggctggtgtggaactcctgggttcaagcaaacctcccaccttggccaccctaagtgttgggattacaggcgtgacccattgtgcccagcctaaacttttttgttttttttcaatgctgagctgtacacagaagaaagtaaaggtcttggtcaagcctaggaaagaagtatgcaaagaaactggtggcaggctggatgtgggcatatttcggggctttggaaggtgaggaggagaggattgcttgaggccgagagttcgagaccagcctgggcaacataacgagaacctgtctgtacagataaacattttataattagccaggtgtatgtaccctagaacttaaagtataataaaaaaaaataaaataaaattcgccaagtgtggtggtgcgcacctgtagtctcagctacctgagaggctgaggcagggggatctcctgagtccaggtgtttgaggctgcagtgagctaggatcacaccactgttctccagcctgggctacaaagcgagactctgtctctaaagaaaaacatactggtggcattgtcaagatttgtcaagaaatagccattatgctgggcccagtggtgtgcacctgtagtgccagcttttcaggaggctgaagtggaagaatctcttgagcctaggagtttgagttcagtctggggagcattgcaagagcccagtctcaaaaatattaggtcaataagatttattttaattaaacaagaaaaagaaatatctgctaaaatttaaagctcttctattcttcctctgtctcttctattcttcctctgtctcttctagtgttcttggggaagatcccgacttagccattttccagtggcacctcttccaccatgagttcctgaggcagtccgatggggctactttattccagaacaatcacagtgagaccttttctctcaataaatgccccttttctctccttaatatattctcttgcttacaaaacactggtgtctccttatcatggtttggttctaccccactgggcccaagaattcttgcccaggagcaactgaattttcttcttgcttgctttttaaaactttggtggggtagagccaattttaaatcttctgatccattttttcattgcttttctcgcccttctgcattttctgcaaattccgttgaatcattgcagttacttaggtttgcttcatctcccccattacaaactacttgctggagttttcaaccctagttccctcatttttatgatttatgctcatttctttgtacacttcgtcttgctccatctcccaactcatggcctctggccctggattattgttttagccttttattttttgtcttcttctacctcaacacttatcttcctctcccagtctcctgtaccctatcaccaaggttgtcattaacctttcatattattcctcattatccatgtattcatttgcaaataagcgtatattaacaaaatcacaggtttatggagatacaattcacataccttaaaattcaggcttttaaagtgtacctttcatgtggtttttggtatattcacaaagttatgcattgatcaccaccatctgattccataacatgttcaatacctcaaaaagaagtctgtactcattagtagccatttcacattcaccactccctctggctctgggcagtcactgatctttgtgtctctatggatttgcctagtctaggtatttttatgtaaatggaatcatacaacatgtgaccttttgtttggcttttttcatttagcaaaatgttattaaggtctattcctgttgtagcatgtattagcacttcatttcttatatgctgaatgatatactttatttgtccatcagttgttcatgctttatttgtccatcagttgatgaacatttgcgtttttgccactttgggctattatgaataatgctactgtgaacaagtgtgtacaagttcctctgcaaatttttgtgtggacatatcctttcagttctctcaggtgtatatctgggagttgaattgctgggtcgtgtagtagctacgttaaacattttgagaaactgctaaaatgttctccagagctgtaccattttacattctgtgtgtgaggattccacgttctccacttcctcaccagtgtatggatttgggggtatactttttaaaaagtgggattgggctgggcacagtggctcacacctgtaatcccaacactttgggaagctgaggtgggaggatcacttgagcctagtagtttgagaccagcctgggcaacatagggagaccctgtctctacaaaaaataatttaaaataaattagctgggcgttgtggcacacacctgtagtcccagctacatgggaggctgaggtagaaggattccctgagcccagaaggttgaggttgcagtgagccatgatggcagcactatactgtagcctgggtgtcagagcacgactccgtttcagggaagaaaaaaaaaagtgggatgatatttttgacacttttcttcttgttttcttaatttcatacttctggaaattccattaaattagctggtaccactctaactcattgtgtttcatggctgcatagtaatattgcataatataaatataccattcattcatcaaagttagcagatattgactgttaggtgccaggcactgctctaagcgttgaagaaaaacacacaaaaacttttgcattcttagagtttattttccaatggagggggtggagggaggtaagaatttaggaaataaattaattacatatatagcatagggtttcaccagtgagtgcagcttgaatcgttggcggctttcttagtagtataaatacagtactaaagatgaaattactctaaatggtgttacttaaattactgtaataggtattactattagtcactttgcaggtgaaagtggaaacaccatcgtaaaatgaaaaataggaaacagctggttaatgtggctctggaatttttctaggacataaactgatgagctagaaaagtaaatgtgtcagtccttggtagcaaagtttgtacgtttataaattttatccaaatcctcttaatctagtgattaatagacactcttcacaaaaggatgagtgaggtatatgtgtatgtgttgaaaggttccgaaggatgcaactgagagtactttttttgtgtcatggatccttttggcagtctggtgaaacctatagaccccgtctgagcataacgttttaaaatgcatacgtggccgggtgtggtggcttacacctgtaatcccagcactttgggaggccaaggtgggtggatcacctgaggtcaggagtttgagaccagcctggccaattagctgggcgtgatggtgcgtgcctgtaatcccagctccttggaaggctgaggcaggaaaatgccttgaacctggaggttgccatgagccgagattgcaccactgcactgcggactgggccacagagcaagactctgtctcaaaaaaaaaaaaaagaaaagaaaaaaaaaagcatacataggccaggtgtggtggctcactgctagcctcctagcactttgggaggcagaagcagggagatcacttgagctcagcagttcaagaccagctaggcaacatagtgagaccccatctctatctacagtttcctgcagagatcaaagtaaagttcagtgtaggtggtggttgttggggaagacactcaggaagaggacatgggctgagtgttcagaaatggtcaggatttggatggggagggcattctactcccagttaagtcctgataatgcaaaggcctcagcaggccttttacagattggagaaatgactgtcagtggttttaaggaccagtttaggtgggatgatgctggacacagaaaattggtttgaatgataatgagtttgggatttcggcttaaagtaagtccccagagcccaggccactgctgctgagccccagcctgggaactggaggaagcagtcccagttgctgacctcttgtggtccctggcttcgggtgtgcagtgcatccttagttatgactccttgattaatatttttagcttctggctgggcatagtggctcatgccgataatcctagcactttgggaggctgaggcaggaggatcacttgagctcaggagtttgagaccagcctgggcaatataacgagacctcatcttactaaaaatcaaaagcattacctgggcatggtggtacacacctgtagtctcagctgcttcagaagttgaggtgggaagaactggttgagcccagaaggttgaggctacagtgagctgtaattgcactactgcactctagcctgggtggcccccatctcacacacacacaaaaagagcgagaccccgtctcaaaaaaaaaaaaaaaaaggggagttcctcatttgccatgagtggacacctgcttctttactgcttcaaagtgaacacagctattccttgtaaagggttggttttactgtaaggaaatctagaacacctgtgtgtgaatgccccctgattttcaaagaaatgagtggttgcatcaaaatcaagcttatatttgtggaaaatcacatgttgccaaattctctcatcaagaaccctttattaactgactaattgtgggccatggtggcaggcacttaacaaagaccatggcagcagacctccctcaactggaaccctcagttaagcgggattttgtttttattttggaactccaccttcagaagggcaaaaatcacaagatgtggtagcaagggtttattctagaaattagcttccaagcagtcgtcagcccagtctgtatgtcttccgcatctataattatagtagcagaagagaatggtgagcctggggcactgcaagatcctaaatcaaagattaaggcatattaactctaccctcgctggaaagtggtcagttgtattttaaaaagctttacaatagactttctaataatgagagttgaagcaaagtttccacctaaccctgtaattaaattcaccagaagaccccatttcccattatccagacgaccaaggctttgccgaacaccaccgtccctgccctctaggagaggtcatccaaggccagcaatgaaacagtcaatcaatttgcaaatggacgggaggacactgacaggatgtgttcactgggggtaggtgtctactgggggagagaggccaggcaagtctgtccttgttttcagtctagcaggagtgaaggggaggccagagtaactcctgagtggtcaatctagaaaggccttttggaagggctggaattttaggcatttttcttaagtaagaggagagtgacgtcctgttggaattgtggggtaggggatattctgggcacttctaaaggggtggagaaacctgaacgtcctgggatgggaaccctaagggcgtagatttgtaaaaattgctgcagtcacttgccatgaggactgggtatctgggctagagacaggtgggcgacatcagaaagctgtgagtggatatcctggaagaccactgagaggaggagccaggaatggcaccagacatttctgaaggtggggggcccagaggtcgaagcaaagcggggcctgtttctgtaccaaagcaagagcttctgtatatccatcaaaacataatcaggccaggcgtggtggctcatgcctgtaattccagcactttggggggctgaggcgggtggatcgcttgaggtcaagagttcaagaccagcctgaccaacatggtgaaaccccatctctactaaaaacacaaagaagccagacgtggtagtgggtgcctgtaatcctagctacttgggaggctgaggcaggagaatctcttgaacctgggaggcggagtttgcggtgagccgagattgcaccactgcactccagccagggcaacaaaagcaaataaaacaaaacaaaaaaaactccatctcaaaaaaataaataaataaaaccataatcagagcaaagacattctaacaaaactgtgaactcggagaaattagtgatgcctgcttcccgtcaactttcaggtgtccaggccttctctttattaaaacagaaaaaaaaatctgataccagttgtgtgttctttctttgatgtagtgcagtttgcccaggcttgccttaagttggtgctatttttgtgtatttaattctgtttccgcatgtgacccattgtctgatgcttcagaatgcagtctgctgcctcctttttgatagcaactctgagaacaccgtctctgctctcggcagggcactgggtacacctgtggcatcgctggtgccatggcatgaggcaggcttcccacttcacttctcaaggacccattttattaactctccttcccccaggagctccgtattttgaaatcttttgtttcccagacaattagggagtaattaaaccttttttcccacatgataacaagtatgatcgttcacacttgatatagtccagttctaaagcaaaattagtctagtggtctgggttgcggatgaccaaagcacacatatgttccatccattaggttgcttagccctgtggttagggaaggcggggttattgttaggtgattttgaaatctccaaggtcatcagtttcccaaccccatgtgctgctttggataacctgggtggtgtttgcccactactgctttgcattggtgaccttgattgaccatgctaggtggcacttttcagcagggtgaggaaaggagatgcacagttgagcagccgtcatttcctccgggtccgatcacacctaccctatcccagccagatacaatctatccctttttaaaaagactttcggagaatgaaattttacagtcttttttgtataatgcccccaaaaggaaatcttgattttcacttaagatttgatttgaagtaagtcatgatttagaacagcagataaaatgcattagggtaaagtattatgtaaaggtaaggtgaagagatactggtttctacttcaggaggtagcttatatttgtttgctttaattaattaattcattcattcatttttgagatggagtctcgctctgttacccaggctggagtgcagtggcacaatcttggctcactgcaacctccgcctcccgggtttaagtgattctcctgccttagcctcccaagtagctgggattacaggtgccctccaccacgcccggctaatttttgtatttttagtagagatggggtttcaccatgttggccagtcaggctgctctccaactcctgacctcaggtgatctgctgctccagactcccaaagtgctgggattacaggcgtgagccaccgtgcctggcctaatttttgaattttaattttttgatggaggtaacggtgactataattctgttacaagaatgtagaaagtcacgcctgtaatcccagcactttgggaggctgaggtgggcagatcacaaggtcaggagattgagaccatcctggctaacacagtgaaaccccaaatataaaaaaattagctgggcgtggtggcgggtgcctgtagtcccagctactcgggaggctgaggcaggagaatggtgtgaacccgggaggcggagcttgcagtgagccaagattgcgccactgcactccagcctgggcaagagagtgagactccgtcaaaaaaaaaaaaaaaagaatgtggaaagtaaaatgtgaaagttcccctccttgtctatgccccttattgactttgatatagattctttatagtttggtatatattcttccagacccttttctgtgtatatacttacacaaatatattttttctgacataaatggaatcatgcagaacatattgttcaacaacttgattttaaagggatgatttacttcactattttttcaggcttaattttatggctatatcagaactgatttggttattttatagctggctgaagctgtaatttgtgaaatcattggggagtagtgagcctccttccataactatataacaataaattttgctatatcaggagagcaagtcataataaaaatattacccttaaatcttaatgtatttagtgagaataattgacttgtttattctgcatattttcttcaaaaaacacataaattcatcaaattaagcacgttcgtattttattgactattttgctataattttgaaattatgttaaattaaaatgaagcctgtttgaaacctgttaagatgacaaccataaatacttagttttgtgtctaattcagttaagcgttcttgtttgttcatggaccagaaaaaaagttttcctgtgttttcaattcccaagtgactcctccagatagaatgaactggacccgagtagtctttaaggttgctggctacgggctcagcatttaagactttaacccaaaggaagagaactttttttctcaagccctgcagcaacagttattgctgtaaaaagattatcatttcaaagtgttgggttacttctcacgttcatgggaatgactttctttaaaacctctgggagcaagagcagtttcttggatggctcatctttagacctgatttttaaaatagttgctcttttttttgtttttttttttgttcagacatttattgagcacttcttaagggccaggcatggtgtgaggcactgggatgtaacagtgattatgacaaagtccctcaaggagctcacagtctaatggtaaactacagagtaaactgaggcacagagtggtaaatgacttacccaatgaggtagaaatagctaggtatgtgaaaatgtgggagcagagctggagagagggcaaggtacaacttgtcctaagtaaaaccccttggactgactcaacagcaaggctgcatacacaaacattacaaaatctacttgcaaaaacctgaaaggagtttccaattatcaccatgactgaattcatgtttcacaatgaattcagctatttcctgatgacatttctatccttgcccccaaagccactgggcatgccaccgatctgctgggagacagcaattaggtagacagcttaaaaccaagaagtatctgactccaattttagcactgaaaaccatattaaaatactttaattaaatccacaaacataaatgtgtagcacatttatgatacttctacatgtagaagtttggaaaaagtctcttctaaccctcatccagaggattctaataagttatagataccaaagagattagagaatttgtctgtcactttccatatatacattattttggctgtacgagagtgaaaagtgtcactcagacatatttcgtaagtaatctcaacattatacagatatatacaaagacatcacatttaaattcgtgtgtacatctatgcaatgtacaacagtaactgcaaacatgaaccagtgtaaggcaatttcttttgtgacatatgacatactccttgaagggaagggtagagtccacaaagaactgtccttttcagcctgactgtctgtcttcatgacactctgtgatgaagctacttcaggaggcaagatgtctatttcactgacaaaaagcagtgaataattataaaaggagttgttttcaaatgtggaaaccacaattactcagtaatctaagtggtgaactcctcaaagacactactggccatgatgccgctactgagaacgagagcacttcatggataatttattgctctgagaatcaaatttgatgcgtaattctccaggaagatattcccaaaaaactcagtgatacataaattctcaaatgccatcagttgcttacttcaagcaattcttcactttgctgaggattttcttcttcctcagggccttctggatgagtgctctcagatgaagaggtcctgacaccttcagaccttttgttactggtctgaccctgctccacttctcacaaatagacatcgataggtccgttggtgctccttatgtgcactgtgatagagtcttctctgggagctggaacatccaatctggtttctgctggagctttaactgcaatgacgatctgttcatggaaggcctgaatgctatgaatgtcttgataggtcacatatgctagtctttcattttctttgtcatctgttaactcaaacagctgctgagcacaatccttaattaactcatccaaagcatcttccattgctggtaagtcagcaagttcctcctgtagcttcttttgttggggaactgctccaaaattgctaagatcagatcctatccatctaatatggttcttggatttcttttcaacgaggtcgattccatctaagacatcggtgatgtcatacactctccgctttcggactcccagtttcgttgcaaccttgtttaagtcaagaatacccccgggagcagatttctcatggacacatattgtacattatcttctaaattaatccttatttttgatggcagcaggccctccacgttgatggggtctcctccgtcgggtgcaggaggagactgggtaatctcctcgccggccgctgctgactcatgctgcccggccgggcgtcctgctcccctcgcaccccacgagctctcccgccctctcgcgctcagctcgagcaccgccccccacgcgccgatttccaagggcccagcacctaaggggtccgcggcctcctccgaggcgtcgcccggctaggccgtccctcccgccagtaaacgcggcacggcctcacgtgcccgggagctcccgacgcagacggaaaaggagcagggagacccgcggatctcaagtcgcccggcccgccatcttcccgcatgcgcagtcaaaatagttgctcttctggagagatggctgtgggattcatgtgtcatagttatcccttcttaaacatcagtgtttgactttctatcccttgtcctgagacctctgagggtagcccctgttttagcagaatctacttctaatactttcctaagaaggctttcccaagaagttcattcaacaaataaccgagtgccttctacaagcactcattgttctgttatctccggtgccacagaattcacagttaaaatcatgactaacattttaagtcgtcacctgatatgtatttttaatctttaataaatagaagcattaattaaatacactgtgacattcgggaactcttttttattcctaaggtacatcttttttcttgccattacttaacctcttttcttcctgttttgttctcagctctcctttacagccatgagttactagtgcccggtgccaccacgaagagggggtatctgtaggagtaagatgatgaatagcagtggtaaggggagagcgaggagaagggagggggctctgaggaggctaaagggcaaacttttattcttgaaaatacacaaatatcccaagtcctgggtgtgtggaacgtccttattactgctggggatgttgcttgtctgtgggaattgggaatttcacacctagctctgaatttctaggaagcccgaacaaaagagaaatagaaatagagaaatcacatacttcccaccagagaggagacaccatccataccagaggagactcgtatggggggtggtgaggataaggccgatccatcttccccacctcatactctgcctcctgcagtgtggcctccctgagggcgccctggcaagggagggtgtgggaccctcatcagtatggctcttacaaattcccagaagctgctgtagcagctcaaagaggggcaggctcttccaggtctgttccttgccagatgccctctcccagcctggggttaaccctaagcaggcattgatctgcactttgctcagagtcactggtgacctcccgggtagccaagagcttcccccttctccgtgagccctctgagactgcaggtcccagacggttgtaaattctgcctggtggaaattgccaaggctccaaagcaggcacctgctgccctcaggagcctctgtgcagggccattcttctccctgcaagcagcacttctcggagacctttctggttttcctcttcagctttgtttggcagtggtttggtgttggtttggagatggtggtgtgttgggaattatgcttcacatagatggacatgtttgttagcgggaggaatgatggtgcagatattcattccgggcttaccccaaactaggtaaccctttatgacattgtttagagatgatttgctgaacagtttcataatgccttctgatgtttcagtacaaaaaatagcttgctgaacaatgttacaatctgtcttctgatatttcattacaaagaagcaagagcacattctgagcaccctgcccagtgctttcaccttctctctgttggagcaggtgattggttccagctctgcgttttggcacctctgtggctgggcatccctctgaactgtgcacttctagaagggagcaacaagatagagaactaatatgcctctaggcctgagttcattttggaaaaatctttgtagatttcttgcccaatcctcttattttaaaggtgaattgtcctagagggaagaaaaagaccatggtgacctgggtgggtaaagggtggaagtagtactggaaaacgcccctaacaggagatgagaaagagactctggtgcacgtcatctttgttttaattaaaacgttatgcaatacaaacattcgccttcccactcttccccctaccacagaggagctgtaatttcccatatttggaatttggggagagctgggcctcatttgaagataaggccagattcagtctctgatttggggggaagtaagtaattgagagagccttgaggactgtggtatttatggtgaatatatcagaactatgtgtgtctccttgtcatcatttattcaacacctctgatgtcctagagctggtgctatgcccatcagtatctgactcttgttttcttctgcatattttcccttttgcaaatgtataggcattcagctttaatcaggtaggctttttactctgtgatctgcaacggggatgactgaagtcatgtggaggattttaagtaactaatctcttaagacattcagagcataatcttccctagcccgtgatcatcctgcctgcatccgagagatttgtgaggctctgcaaaggaggctggatgtggactttggcatcctttggagagactgggtgtcttccttgctggtgacaggtttttgtttgcttttggcatgggaacaggacctgctgttcatttaccatgtcaagagagttcaagatgccccatgaatgtgaccagtgtgttactaaatctccgtactggtacagagaacaatggcaggccaaacacacatgaagaccctgtctaggctcattgatgtttatgcagtttgtgtccagggctggttctcagggagaaaaatagataagatctgcaaaatagataagagaggactgctggtcagtggtgttccctgacatttttccctgaatgataccaggttaatcaaaagataaggatctaaaatatttttgtgctctgcttataatttgaatgtgacttcatatgtgtgtcatctgttggactaaattggattgcagttgctcttcaaattgtcattcctttattttctatttctacctacctcctgatgttagctcaggttcctgctaccaaggtgtcttgcaaaaaaatttggtgactattactctaagtgaagcctttgatactttctcttaatacaatggttaaacctctaacaacgtagactaatgaggaagattagtttgaattagtaaaatgtctgaattaccaaatatttttcaagaacttcactgttattacttttaagtaaatactgtaactcaaactaggctaatagaatgcctaataaagatccttaggggatcctgctttaggagagaaataagaatgatttgcaattagtgcaccaattgtttatgtaaatggaatttctgaaatactagactgagcttgaaaaccgtttgttcccttaagtattttaaatagtccctacggaacccctgtgcatgctggtagttgtttatatgctgtatagagacctgtttcatgaagacataactcaaccttatatcatcagtatcagaaattccaagttagtgatggccaggatcctcaccttccaagattagattagatctctctgccaaacgcttccatagcacatgcaattgtctgttgtaacactaatcaatacatttaacaaatatatgatgtattctgctatatgctttgccagtgtgtgaaatggaggagacataaccctcatctttgtgtagtttataggctagcaaagaagtcaggcagtaaacaaataaatgcatttataattaattacaatcctgaagttagattgtacttttgtaagtaatggtttaatcaactagattttaagttccattaagataggggttacttctgtgttgtttgtcatggtgtcccaaatccttccttagcctactgcctggcatagagtaaatattaagttgagctttattgccattttgataggtcagaagcagtcgaatgtcaataatgtcacatagttcaacctaatagttgctcagtcaatatgtattgaatgttgaatgcatgttgtaatcagtgatcctatggtaggctgcatttcacacagttttctctagccaaagaaatgctagctatggttttgaaaaggaattctaaaacttcaaacagctaaaactggtgatatagactgtgggactggagatctgtgagactggagtgccttttgtccagtatattttctatgcagttcttggtacatttcccagcctcaggtgggagcatgtgtatttgggtctggagtgcttgtcagtagcccaaagaacctgggaagagtatgctggaaagctaagatggaaggcagggataggagctgtttggcctgaagaagaaagtggcaggaaagatattggcatagccaaagaagccttccctttaagtcctagtgtagggagacttacttttccagaccagagctcatgagatcatgcactcattccacagatttgtgtgagtctgtgatgcgctcagttatggctaggcatgggcgttccttattgtgagcttcctttttgtgcctggaacttctgtctgaagggttgtgggctggactgtagaccactggtcctcagaggcaagggttgaactgaggagaaagccccagctggatcctgctgggagaagcccagcactctggcctggggcctgctccctatctgtggaactgggagtagggcccaggctagggcttagatcagagcttcccaaaccttctgtgttaagaacgtttttgcatctgtttggatttcatggctgtttttccattttccgtgcacacatgtccaattataccaccctattataatgcacactcttttctcacacccacaggataatttgtagttccacagctatttgttgagcatcctcatctgccagcacaggatgggggtggcaagtgaggggaaacacagatatgtggtattggtccctgcctgtggtagacgtgattggttacctacagtggctcttcttttctcttcctgctggcaggacccagttgggttggatgccacacctctcccacacgccactcaaggaaaggtgaccctgcctccagctctagggtatgtgctgattgagctgagcccatcctggaggcccgtagtttagacatggttttggccactgaggtatgagaagtctgctgggagatgctgggaaagatgtttttccttgtaaaaggaaatgcagaagggacagcttctttcactagattctcggacgtgaagcagccatcttgttgcaatgaggaaagcaggtttgttgaggccagcagacgggaagagatgggaaaaaccctgagggccaagcccctgaagactgaaccgtccaatctccatacattttgtcctcactgttgaagccagttgagtgggaattttctactacttatagtcgaaggcaacctatattagacactccctcaaaggagcatgaaataggatttcttcttgtaccattcagattatcatcaaaaagcacattattcagagacagagcttagctttgtggtaaggcagaaaggagaggggaaagcaagttggtaggaaagagttgagtgaggagattgtattttaaatgggtcctgagggaggattaggatttgtgtgggaggagcagaagggcgttctggggaaaggaatggtggcatgagcaaacctgtgaagacaggtatggatgtggcactgccgaaaaacagggagattatgtcctgactaattccgtggacagattctagagcacctcaaattgtgagtttatatggtgacacgtgacttatgcagcgggaaaagtactgcaggctcatgaatgggggagaaaggaatgaaagtgggccttgggaagaaggataaggattaagtagctgggtaccaggttctttggaaggggaaaaaagtaaaaggccagtgacaagctcaagctactgaaataactcacatttgagttgatagcagtgcggggagggagtgaagctgtcaaaggaagattgtaataaattaactggcaaagaagggtaagatggatatctaggagaggaagatggaagaggaagattttaggaagatgctgtttgctttttgccactatggctttgaggtaatgaggaaagatctaagtaatgaggcgttgaattcatttgaaaatagggctagactttgggaatgagaggccaagggttaagaggatgtggtagaggcaactcactaggcatgcacatactccagattttccagcctccctcacagttcagttggggccatgtgactagtgttagtcaatgaagtgggagaggaaggaaccagggaagagccatgtattcctccattgattcctcccatgccacagcagccttgggctagggccagaaagtgtggctgccaagacggggagggctgtccttccaggaccagactttgacggttgttgctcagctgggaaatgctggtagaagcgagatctgaagctgtaatgggtggcagtgctgacagctatttgtgttgggtctgggtggtatgtggtcttcagggtacagttgtccaccttctcctgacttgatttgctcaggggtctgcattcaatgggctggagcttgctggccaactcattctacctctaggactctcagtgtttctgggggcaggtttacatcttggctgtccagggaaggggatccttgttcatgagctgtgctagtgagaaggctgctctctccacaggcaccagaatgccaagtgccttgcagaggagaatgtttgggtggctgatgtccagtggtgaccaggtggagcgtctcaattatctggctaaacatggagcttcaggaagaagttccagatctccagacttgaataagaataaggtgcaaatcccatctttcaaatctttcccactctcagaagagtcaaaatgtgccttttctgcaagcagtccggagctaggcactttgcatacgctttgttacgatgttgcatcaatctcgcctggctgaatcacggtgttttcctaagggtaaagggccccgtgagtgctgggaggcctttggcatctggttttcgtcaggcagcaggtaaaagtgcagatggcgggtctgatcgtgctttaaaaaaagcagagttagaaacgtgggaaaggcatttgagaggcacctcttactctgtgtgtgatctcccgtgcatcctgtttcttctctaaccaaacacctcaactcctaatacccagaggaaaacccttcagacttgggagacagccggcattgctggcactggcctctctggagcttttctcgataagtttgaaaatttaaagacagtggtggcactgtttctctgttgaatggagagttgacattcttatttttccttcctcttctgcaaaactggggtgtcatcagatcagtgtttgctgctgctgttgcgttcttgggtagccactctttttttttttttttttttttttttcagagggagtcttgctctgtcgcccaggctggagtgcagtggcccaatctcagcttatcgcaacctctgcctcccgggttcaagcgattctcctgcctcagcctcccgagtaactaggattacaggcgtgtgccatcacacccggctaatttttgtatttgtagtagagagacggggtttcatcatgttggccaggctggtcttgaactcctgacctcaggtgatcctcccgccttggcctcccaaagtgcttggattacaggcttgagccaccgtgcccagtcagccactcttattttacacactgcttctggctgataggcctacaaggtctaagcttaatcccaggaaaagtgctacccgaatggtctgtcagtcagccttttgtttgtttgtctcgttccggtcatccttgcctctgtccacccagacaacattcaatcaacatttgttatggagccagcagtatgattttgcaagttacttttctaaactctcatttcctcatctgtaaaataataggagatactcattagggtgattctaagagttaaatggaaacatctgaggaaagcacttagcatcggtctggcacatagtaagtgctcagtaaatgatggttgtcattattgttgagcagagccaggggttgccaccccagtcagctgattggctgtagacatggtgtgaccatatggagctgggatttgggccacactcagcacatagttgtgatccataaatgcacaacctttggaccccattgtcacctcccttggaatatcttggtgttcttgtttcagtctgataaggccattgtagctgggttctaggtatctctgagcatggagcactcacgccagcctcagacatcgctgtcaagggcatcagcagcagtgaggtgattcctcagccggtcatttgggcatcgctgcctgggtctctcctgagcttcagctcatcttttttgtcacctgccatacctttgcctctaagtgtcccccagtttttattgctgccctctccatccgcaccagtgcctctctctgccagttccactgttctctcgcctgctctttaggatttcctttgttttgcctccttgcctggtgctttcagcgagcagcgctgacgtcatctcaggaaccgtgctgcgtctgagggaagaacctgcaataactttaaataactttaaacctgcaaatgcttctttgcaggtttaaaaggatgactataaactatgacgtcatgcctagattcattcttgacccaaccaacaagctcttgacattctctgagtccaggttgactgtgatgaaaggcagctagtgttcccaaatggcccagggatcaggtcttcatcgctccactcagagggaagcatcctctctctgctttttaaatagacttttgactggggctccagcagcgcggggcgcgcagacctggagttgcatggaggccagagccacgacacccgcctggggaacggagcagccccaggagctgatccccgtccacctgccccacggagccctcgccgcccgcttgccactgcctgcatggccctcctgtccccggccccccagccctcctttccccagctcccccaccctcctgtccccggcaccccagcttcccagcccccgaaaccgcccccccacctcgacccggcccatgccgcaagtcgcccgctgcgcggacccggcctccgcccgcctcctgcgtcctgggggaggcggctgccgggggtggtgggggagggggagggggaagaggccgccctccgcccgggtgcggggagggggcgcaggggtgtccggccaggccccccgcctccccgcctccccgcagcagctgccccgcgcccgggccgcctaatacttttacattttaacttttatactacagtgaaaagtgatttacacaccaccactgcaatattacagtgttatgaatgtgactatatacttacctttccctgtgaacttttttttttgggacagagtctcgctctgtcgcccaggctggagggcagtgtccatgatctcggctcactgcaagctctgcctcccgggttcaagtcattctcctgcctccgcctcccgagtagctgggactacaggcacccgccaccacgcctggctaattttttgtatttttagtagagacggggtttcaccgtgttagccagcatgatccccctcttctgaccttgtgatccacccgccttggcctcccaaagtgctgggattacaggcgtgagccactgcgcccggcctacctgtgaacttaatatcttaatgttttaatgttgctaatcagaatccttttatttcaacttgaaaaactgccttataaggcaggtgcagtggtgatgaactcccttagaatttttttggtgggagtctgggaaagaccttatcatctctttttcatttctgaaggacagctttacaagttgtggccttcctgattggcagtttttttcttccaatacattgaatatagcatcctattctctcctggcttataaggtttctgctgagaaatccactgatagccttattgaagtttccttgtatgtgatgaattcctttcttcttgctgcttttgaaagtctctgtctttgacttttgatattttaattataatacatcttggtattatggtctttgggctggccttttttggggcctctgaacttcatgtgtctggaagcccacttgcctctaagaatttggaaagtttttacccattatgtcttcaaatatactttcaggccttttctatcttttttacttctaggaagtccataatatgtttgacccacttcatggtggtgtcctataaatcccaaaggtttttactttataaacttttttttctttctggtcttctgacgggatatttcaaatgtcctgtctttaatttcacagattctttcttctgtttgatcaagtctgcaattgaaattctctattgcattttcatttcattcatttatttatttttatatatttttgagacagagtctgtgtcacccaggcttgaatgcagtggtgccatcttggctcactccaacttccacctcccggttcaagcgattctcctgcctcagcctccctagtagctaggattacaggcatatgccaccatgcctggctaatttttgtatttttaatacagatggggttttggcatgttggccaggctggtcttgaactcttgacctcaagtgatccgcctgcctcggcctcccaaagtgctgggattacaggcatccgccacggcacccagcttgcattttcattttattcattgtattcttcagttctagaatttctgtttggttcttattatttctgtatctttattgaacttttagttttgttcatctactattttcttgatattattgagttgatatatacattctagtaaatttcactgagctatcttaattattttgaattgtcaggcaatttgtagatctctatttttggggggttgattactggagatttatgagtttattttggtagtgtcatatttgctgattcttcatgatctacagactttcattaatgtctatgaagaagcaaatacctcttcttctttttttttttttttgagacagagtcttgctctgtcacccagctggagtgcagtggcgtgatctcagctcactgtaacctccacctcccaggttcaaatgattctcctgcctcagcctcccaagcagctgggatcacaggcatgtgccaccacgcctggctaatttttttgtattttttgtagagacagagtttcaccatgttgtccaggctggtctcaaactcctggcctcaagtggtttgcccgccttggcctcccaaagtgctgggattacaggtgtgagccaccatgcccaatctctttctgtctttatagattggtttcagcaggtacaaaccttttcctgctggatcccttgactggatcacagtcaagtgggcctggagccatatcacatggctgctgcctggtctgcagctgaatctctgattggcaggccgctatcaaggcataggttggtgatgcagtttctgctggatcctcaggagaactggactgcctctgataccctgattgaacaggactggagccaggtcatggggccacttctagttctacagtcaagtcttcagatatcaggcctattaccaagggcatggactggtatagctccctgtgggtcccagattgagctcctgctggcttactaggtaggtccatgggaagacaggactgcctccagaccacagtagagcagggctagagccaagtcacaggacagctttggtgaccacatttgggttcaagattggtggtcctcttattaggagaatggatggtatgtctttcaccaggtcccaggatgggctggactgtgcccagactgtggcaaagcaagactggaatggagtcacagggctactttagtgtccatagctgagactgagatcagcaggcctgttaccaagggcatgtaaaggcatcactgaattcctgggcaggcacgactgactgtggtagagtggggctgaagccaggtcagggctgctttagtttctgcagtcaggaccatggttagaaggcctgttactgggggcataaatggtcatggttcctcctaggtgcttagtggatggggctagttgcaagaccatgatctagtggagctggacccaagtccataggaggacaaagctgctttcagtctgcaactgggaacctgtcactggtgtgtggacctgccttctcaaagcagctctccttggttttgggctttgctagagttttgccacctcctgcctggatattaaaactcttgcaaaggcagttttgtccatgaatggctgccagatcattgtttgtgtggggagaggtgagtggagggcctcctgttctgccatcttgctgatgtcaccctaagatgattatttgaattctttgtcaggcaatttgtagatcttcatgtctttggagtcagccactggagtttcattttgtttctttggtggtgtcatattttctcatgcttcctgttctttgaagacttagattgctttcttcatgtttgaagaaggagtcatcttttccactctttactaacttcaggagagaaagaccatcaattagctaagctatagattctgggggtctctcagtccttttctgtgggtggtccttcccttttaagggggatgtcttaggattttgtcccttgtcttcatttcacaaatgaataaaacaaccagaccagacataagtaaggaaatacagcacttgaacaacacctgaaaaaacaactagacctaacagacatacacaggatattctacccaacaacataatacacatacttctcaagtatacatgggacattttcaggatagaccacataacacatcacaaattaattctcaataggggctgggtgcagtggctcacatctgtaatcccagagtaatttgggaggctgaggcgggtggattgcttgaagccaggagcttgacatcagcctggccaacacggtgaaaccccatctctactaaaaatacaaaaattagctgggcatggtggtgcgtgcctgtgatcccagcttcttgggaggctgaagcgtgagaattgcttaggagcccaggaggttgaagctgcagtgagcagagattgtaccactgtactccagcctgtacttcatgacaaagaaaatgtaccattgtaccactgacagaacgagaccctgtcccaaaaaaggaaaaaagctcagtagatttaaaacgatagacatcatacaaagtgtcttctctgaccacaacaggataaagttagaaatcaataacagaagattttaaaaagttcacaaattagtagaatttaaacaacacactctcaaacaaccaatggatcaaagaaatcacaaagaaattataaaattcttaaagacaaatgaaaatgaaagcacactatatccaaacttatgggctgtggccagttgtggtggctcacacctgtaatcccagcactttgggagactgagggaggtggatagctagaggtcaggagttcaagatcagccaggccaacatggtgaaaccctgtctctaccaaaaacacaaaaattagctgggagtggtggtatgtgcctgtagtcccagctacccaggaggctgaggcatgagaatttcttgaacccaggaggcagaggttgcaccactgagctaacaccactgcactccagcctgggtgacagaatgagactctgtctcaaaaaacaaagaaacaacaaaaaaacacaacttatgagttgtggtgaaaggagtgctaaggaggaaatttatagctataaacacattaaaaaaagaaacacctcaattcaacaacataagtttacacattaagaaactagaaaaagaagaataaaactaaacccaaagttagcagaaggaaggaaacaatagagatcagggcagagataaatggaaaagagaatagaaaaacaataaaaaacaaaaccaaaagttggttcttcaaaaagattaataaaactgacaagactaaggaaaagggaaacaatctaaattacttaaaacagaaatgtatttgagaatatctttatatatttctgtctgtctgtctgtctgtctatctgcctgtctatgttttagaaacaagtgtctgtctatgtcttagagacaaggtctagctccattgccctggcaacaatcagatgcaaccacaatcagtggcacaatcggctcactgcagccttgaattcctgggctcgccactatgccagctctttttttttttttttttaagagacaggatcttgccatgttatccaggctgatcttgaactcctggcctcaaggaattttcccacctcggcctcccaaattgttggattacaggcatgacccaccattcccagcctagaaaggattataaaagattactataaataattgtgtgctcataaattggataacccagatgaaatagatgaattcctagacacacaaaacctaccaagactcaattataaagaaacagaaagtcagaatagacctaacctagtaagggaattgagtcagtaataagacaatctcatgacaaagaaaagtcctggacctgatagctttactggtgagttctgccaaacgtttaaagaagaactaacactgattcttttcaagcatttccaaagagtggaagaggagtgaatacctcttaactctttctatgaggccagcattaccctgataccaaagccaaaaacactgtaagaaaataaaacaacagatcaatatgcctctgatcattgatgcaaaaactctaaaaatgctagtatactgggtggggcacggtggctcatgcctgtaatcccagcactttgggaggctgaggtgggtggatcacctgaggtcaggagttcaagaccagcctgaccaacatagagaaactctgtctctactaaaaatacaaaattagccatgtgtggtggtgcatgcctgtaacctcagctactcgggaggctgagacaagagaatcgcttgaacccgggaggtggaggttgtggtgagccgagatcatgccattgtacttcagcctaggcaacaagagcaaaactttgtctaaaaaaaaactatcatactgaattcagcatcatattaaaaggattatacaccatgaccaagtgggatttattcctggaatgcaacgatgtttcaatatataaaaattgatccatataaattcagataattaattttaactgatgtatagttttacattatatgcacataccacgattcacttttccattttcctagtaatgagctttaagattatttccaatttttagctattaccaataatgtttcaacaaacacctttggacatctcttctgcaaatgtgtgtgtattctcttggagaaggtttaccttgtggaacttctagtgtgtatgtgtatgtgtgtgggtatatatatatacacatatgtatatattttcaactttactatatatttccaaaaaactcttcaaagtggcagatttaaactccccttcaccgtatataaattcacggttcctaaagcccttggcatagttttgtgtttttatagaaaagggcataaagtcttattgctgttgaattgtaccttgctcttttcaattgtcttttcacaataattcactatttatcatctgttgtgaatattgtgtagtagttcttaatcattttttctactatattatttattttatatcattaatttgtagaaatcctctttatataatggatattatacttttcaattatatattttgtaaatattttacccaattttctggcttgcatttaacctttatttaggatgcctaggatttttcattttaatacagtctaatttatttttcttttcttttcttcttcatgcattctggcatttgattaataagccatttgttgcccaacgtcattagttctctgtatatacttttaaatatcttaaacatgtaatattcataagtaatttcacaagtagtttaagatttgagtctttaacctaaatagatacaggattttgtgatatgctgtaatatacagatttttatttctatatggataaaaatttatatgttttttctgacatcatttattgaatagtataatttttctactgacttttagtatcatatcttttattacaagtccaatgtattcagcatatctatggatctatttcttggtgcttccattttttcccattgtttaacggtgtatcactgagccaaagcaaaccattttaattattataattaaaacacatttaaatattgataggctattattgttcaaaataactttggttctttctttccattgattattttaatatgacttttccaatcaagttctaaaaaaatactggtggtatatttattgaaataactttaatgaaattaaatgaaagatcatgtatttgttttctgaattaattcttagatacattaatgttttatgttaccatgaatgtgatattataatataatatttttaattggttgctactgtttataagaatttcattttctgtttactttgccttcatatctgaaaaccttgctgatttgattagtgcatccacaaattttcttggattttctatgggtaattacaaatctccacacaatgaggttgcagtgagccaagatcacaccactgtactccagcctgggcgacagagtgagacaccatctcacaaaaacacataaacaaacaaacagaaactccacacaatgacaacgtatgtgctttctttttttcttcctctttctataatatttctttgtcctatcttaactgaactggccagaaaccccaggacaatgataaatacgagcagtgtcaacagacatctcattccctttcctagcttttataaaaataacgattatgcttcaacattacatatggtggtgtcgatggttttgttatagataagcttatcaggttaagaaatttgtctgcgtttcctagtttggtataaagattttaatataaatgaatgttgtattttatcatcttatttttttcctacatctgctaaggtaatcctgtgttttccccttttcaatctcctaatgtggtgaatgacattaaaataccttctattgttaaaatattcttgcaacgctgtatagaaccaatgcctttattctgtattgctgatggatttttgaaaaatatgtaggtggacttagttttctaaggggaatagaatttctaatatatttaaaatattttgcatgtatgttctgaaggacattggtgtgtcatttctataccatctggctactagaggagccgactgaaagtcacactgccggaggaggggagaggtgctcttccgtttctggtgtctgtagccatctccagtggtagctgcagtgataataatgctgcagtgccgacagttctggaaggagcaacaacagtgatttcagcagcagcagtattgcgggatccccacgatggagcaagggaaataattctggaagcaatgacaatatcagctgtggctatagcagctgagatgtgagttctcacggtggcagcttcaaggacagtagtgatggtccaatggcgcccagacctagaaatgcacatttcctcagcaccggctccagatgctgagcttggacagctgacgccttggatcatctgccactgatctctggtcaacatttttatcacccaacacaaaagaagcagagatttatcaagttacttaaacaacctgaccctttcatcttttgctacacatactcttgtaattgatctctccatgaattgttttctgtttaaaatatctagaatgttttctgcttcctgacttgattctaatattgtataggtactagaaatggttctagaaatagatctttatagatgagaatctggaagtggtttgctgacctgtttcagtctgaatgaattcctgaccttgttgtcgggaggagacagaaacctgatcatctgtagtgtacggtggtatcatgattacttaaatcatcaaatgtggttattgggaatgatgtgttttttaaagtggtacatgagaggtaaaattgctattgtagttgactgttgcagttataattttgtcaacatggtctgtaagagtgcaatggagtcggcccggtgtggtggctcacgcctgtaatcccaatactttgggaggccaagatgggccgatcacgaggtcaggagatcgagaccatcttggctaacacagtgagaccccatctctactaaaaatacaaaaaattagccatgtgtggcggcacacgcctgtagtcccagctactcgggaggctgaggcaggagaatggcgtgaacccgggaggcagagcttgcagtgagccgagatcgcgccactgcactccagcctgggcgacagagcaagactccatctcaaaaaaaaaaaaaaaaaaaaagagtgcaatggaaagctggtagaaaatggacattgtttaaagaccaaaacaaccacactactttgctaatccctatcagctaaagcctagagaatatatgaggcatagatttacatggtgtttgactaaggcatgcagaatataatcttgacataggctaagtttatcaacatagatacctagagattctgaagttaaagtcttagcccaagaagttagaagtggtgctcaagtttgtttgtctgacagaaactgtgaatccacactggcctgcttattttgaggttgtgttgccagagctttcctagcataataaagagaggtgcatacaaaggaataggaatagtaggaggtgggggtaaaaatatcaggtgtgatccacatgccaagccgacccgcgctgtgtcccacaggaagcccagaagatgtttctgtaagaaattaaggattcgtttgttggggagggctgctggcatgcttgaaaagtactgtgacggctgaattttgtgggcttggggagattgcagattctctgatttcaaggggaatgatgtgatcctagagttgcaaagaacaagtgacagtggaggcgcttatgctttgtgactgcactagagacaaggaagacacaactagaataatggggagcaggaatggagcggccaacagaatatctgactgttagggatctttgatgaaggctgattctcagggagtgaactacatcagtgaccaactatttgtctttatataactgggtaatgtggatggattctaataaagggactacttacagcacagcaggaaagtcacaaagaaaccagacagaagagtgtaagtagtaaggggccaagcagtcacctgactagagacagtgccagcttgccaagaaggcaccagacagaagctgtgatcttcagcaaagggacacagtctgcctgtgctgaccctgcaggggcagaggtgggggataaacacactcttctctcacctatcttctgccaccccctccattagctgaaccccaataaaagcatgagggtaagggagatctctgaagtatccaattcaggtgagcctcctaaggaacaaagcagaatgcagaaaaattaagagtgggtctagggaataaaatagagatatgcaccagagtatgatgatgtgtctgggaaagaatatacaaatacttttaaaattactagacaataaacctgagatgacactaatacaggtaaatctcatttaatggtaatatattccaagaaatgcatcattaggtgattttgtggctgtgcagacaccaaagagtgtactttatacaaacctagacagcgtagcctactacatacctaggctatatcgtacagcctattgctcctgggctacacacctgtgcagcatgtcactgtgctgaatacagtaggccaatggtccgcaacacccaagccatggaccagcaccggttcgtgtcctgttaggaactgggcacaaagcaggagatgagtggctggccagccgagcattactgcctgagctccgcctcctgtcagatcagcagcagcattagaccttcacaggagcacaaaccctattgtgaactgcccatacaagggatctaggttatgttctccttatgagaatctaactaggctgggtgctgtggctcacgcctgtaatcccaacactctgggaggtcgaggcaggtggatcacaaggtcaagacaatcctggccaacatggaaaccccgtctctactaaaaatacaaaaattagctgggtgtggtggcgcatgcctgtagtcccagctactcgggggactgagacaggagaatcacttgaacccgggaggcagaggttgcagtgagccgagattgtgccactgcactccagcctggcaacagtgggagactcagtctaaaaaagaaaaaaaaaagaaaaaaaagaatctaactaatgcctgatgatctgaggtggaagagtttcagcccaaagccatccccactccgtggaaaaattatctttcacaaaaccagtccctggtgtcaaaactttggggcccactgctgtaggcagttatatcacagtagtaatatctaaacatggaaaagatacagtaaaaacacagtacattgggagaccgaggggggcggatcacctgaggtcagaagttcgagaccagcctgaccaacatggagaaactccgtctgtactaaaaatacaaaattagctgggtgtgctggcgtggggctgtaatccctgctactcgtgaggctgaggcaggagaatcacttgaaccccggaggcagaggttgcagtgagccaagatcgtatcattgaactccagcctgggcaacaaaataaaactccttctcaaaaaaaacaaagaaaaaaatatatatatatattacaaaatttaaagagagtggtacaccagtaaaggacatttagcatgaacagaggttgcaggactggcagatgctctgatgagtcagtgagtacttggtgagtgaatgcgaaggcctaggatattactgtacataactatagactttatatgcactgtacacttaggctacactaaatgtatttaaattttttctttctttaacaagttcatcttagcttatcataactttataaacttttaatttttttaattttttgattctttgataataacacatcttaaaacaaaaacacattgaacagctgtacagaaatactttatatccttatttgataagcttcatttattttgattttttatgttttaaacatttttgttaaaaactaagatacaaacacacacactagcttagccctgtaagggtcaggataatcaatatcactgtcttccatctcgaaatcttgtccaagtgaaaggtcttcagggtcttcagtggcaataacatacatgcagctgtcattctctatgataacaaggctttcttctggaagaactcgtggaagaccttcctgaagctgttttatagttaatttttcttaatgagtagcagtactacactctaaaatatgaataaaatctatagtattatacatactgttgatccttgaacagtgcaagggttaggggaccagctcctatgcagttgaaaatccatatataattctgggctatccccaaacttaacttaatatacgatatatatcatatataatatatatgatatatatcgtatatattacatatgatatatatcgtatataatatatacgatatatatcatatataatatgtatgatatatattatacacaatatgtatgatatatattatacacaatatgtatgatatatattatacacagtatgtatgatatatattatacacaatatgtatgatatatattatacacaatatgtatgatatatattatatacaataagtatgatgtatattatatacaatatgtatgatatatattatatacaatatatgatatatattatatactatatgatatagattttatacaatatatatgatagagattatatacaatatatatgatagagattatatacaatatatatgatacagattatatacaatatatatgatacagattataaacaatatatatgatacagattatatacaatatatatgatacattagatacaatatatatgctagattatatacaatatatgatatagattatacacaatatatatgatatagattacatacaatataaatgatatagattatatactatatatgatatatacggtatatcgtatatatgatatagatgatatatcgtatatatgatatagatgatatatcgtatatatgatatagatgatatatcatacctgatatagacgataaatcatacatgatatagatgatatatatcatatatgatatagatgatatatatcatatatgatatatcatatattatataataaatgaaaaatattatctataataaaagacatatattacataataaatgatatatattatgtaaaatatatgatatgtattatatattatatctgatatatattatatattatatattatatctttaatctgatatatattatatattatatctgatatctgatatattatatattatattatatataattatattatattatattatatataaaatttatgatatatataatatattatatataatttatgatatatattatatattatatataatttatgatatatattatatattatatataatttatgatatatattatatattatatttcatatatattatggtatattatatataattatattatatattatattatatataatataccataatatatcatatattatataatatataatataatataatataatcatatataatatataatatattttattataaaatatattatattatgatatactatatattacatattacattatacaatattttatataatatataatatatattatatattatactttattatattacatatataattatacattattatatttcatatataattatatatattatattatatataatattctgtataataatatatattatacataatattatatattatgttatatataatattatgtataatatatattatacagaatattatatattatattaaatataatattatatcttatattaaataaaatattatatattatattaaataaaatattatatattatattaaatataatattgtatattatattaaataaaatattatatattatattaaatataatattgtatattatattaaatataatattatatataagggatgcaggatgtaaaaggaaattatatatatgttatatattatatatattatattatatataattatatatatatatttgggggtgccctatttcctatctcataacttattttaagaagcacagcataataatgtgtggacttgggattcagtttttgaaacgaaacactgagccttcgatgaccttcctgtacatctgaaagcacacctgtctgcatggcagcagttggacctcacagtgtggattgtgccttcaccctggaatgtttatgccctatcaccatggtgatgggattagggatctgctgcccttggtcctaagtgccactatctgtgctgagtttttcaaaggtcagagcagattgaacctttgtggtttcattttccctgattttgatttttcttatggggaacctgtgtggctgcattcaaggtatgttcatactggcctgtcaaatgcgatcttttcaaattactagttaatgctttcaaaatatgttatttaaaaaattagcctctgtattttccatatgcagttataaatatgtttcatgattatgttttattcctcaatttatatatttgattattgtaccaagcagagtatctttgaaatttttcttcatttaaaaaatatgtatcttgactcaggcctgtaatcccagcactttgggaggccaaggcaagaggatcacaaggtgaggagatgaagaccatcctggccaatacagtgaaaccctgtctctactacaaatacaaaaaattagccaggcatggtggcagctgttgtagtcccagtgtgaattgggattcagtttattcccaaattcccaaattatatatatatatatatatatatatatatatatatatatatatatataaaatatatctataatatattaaatatattatatatataatatatattatattatatataattttatgtatatatatatttgtgggttccctatttcccatctcataacttattttaagaagccagcataataatgtgtaggcttgggattcagtttttgaaacaaaacactgagcctttgatgaccttcctgtacttgtaaaagcccacctgtctgcatggcagcagttggacctcacagtgtggattgtgccttcaccctggaatgtttatgccctatcaccatggtgatgggattagggatctcctgcccttggtcctaagtgccactatctgtgctgagtttttcaaaggtcagagcagattgaaccattgtggtttcattttccctgattttgatttttcttatggggaacctgtgtggctgcattcaaggtatgttcatactggcctgtcaaatgcgatcttttcaaattactagttaatgctttcaaaatatgttatttaaaaaattagcctctgtattttccatatgcagttataaatatgtttcatgattatgttttattcctcaatttatatatttgattattgtaccaagcagagtatctttgaaatttttcttcatttaaaaaatatgtatcttgactcaggcctgtaatcccagcactttgggaggccaaggcaagaggatcacaaggtgaggagatcaagaccatcctggccaatacagtgaaaccctgtctctactacaaatacaaaaatttagccaggcatggtggcagctggtgtagtcccagtgtgaattgggattcagtttattcccaaattcccaaattatatatatatatacatataaaatacatatataatatattaaatatattatatatataatatatattatattatatataattatatatatatatatttgtgggtgccctatttcccgtctcataacttattttaagaagccagcataataatgtgtgggcttgggattcagtttttgaaacaaaacactgagcctttgatgaccttcctgtacttgtaaaagcccacctgtctgcatggcagcagttggacctcacagtgtggattgtgccttcaccctggaatgtttatgccctatcgccatggtgatgggattagggatctcctgcccttggtcctaagtgccactatctgtgctgagtttttcaaaggtcagagcagattgaaccattgtggtttcattttccctgattttgatttttcttatggggaacctgtgtggctgcattcaaggtatgttcatactggcctgtcaaatgcgatcttttcaaattactagttaatgctttcaaaatatgttatttaaaaaattagcctctgtattttccatatgcagttataaatatgtttcatgattatgttttattcctcaatttatatatttgattattgtaccaagcagagtatctttgaaatttttcttcatttaaaaaatatgtatcttgactcaggcctgtaatcccagcactttgggaggccaaggcaagaggatcacaaggtgaggagatcaagaccatcctggccaatacagtgaaaccctgtctctactacaaatacaaaaatttagccaggcatggtggcagctggtgtagtcccagtgtgaattgggattcagtttattcagtttattcccaaattcccaaattatatatatatatataatttccttttacatcctgcatccttcaacgttacatcccccaccccacagattaagttattccccaggggagaatatggcaaagtctattttaatgcagtttttaacccaattaagaacctatgaaatcattactttccaaaactttggaacaaagccacagtagtatggatccgttggaggcttttcacacaataaaatgtacctctctttgtttttaacatgtttttcccttcctctcttctttttttgtgaaatgtgtatttactttaatatatttgtagtaagtcacttccatgcacatattaattttttaaagtaataagtatgtgtattgtctacgtgtgaaagaaaacacacatttatttttatgctttggaagttatccagaatcatggaattgtcaatcacagtcaatcacccaacctactcacctttccagtgtaatcttagtcaaattttttttttgttatccaatgagatgcagtatttcaactcagaaagataaatagagtgaatttatagagactattaactaagaacatacagttttatttatactcagaagcaagtagattatgtacatatatatgaagataaaaattaaaaggataattgtgtaaatttgcatgtagagggctttgaaaacctgtttacttgttaatgctgttttgatgtattgtgtctttgttctcccgacccatcgtccagagctctctgcaggagctaagtgctcatcagttccatgacttggaaactgtctaagtttagaggcacttgtatttgttagtaaataaggcaagatgatattgtttcacaggttttagtgccgaagactgaatagataagctgctccacccagtacactggtgttcatttcatggtcatctcatctgttaaccatggatataaaacatttatcttcaatgatggggttttaccatgttggtcaggctggtctcgaactcctgacctcaaatgatccacccacctccaccttccaaactgctgggattacaggtgtgagccactatgcctgactgattattttcataaccaagaaaagaaataaatacaattaatgctggtgcatggtattaaatctagtttttaaaaaattcacacataaacaaggcagaaccctataccctccatgataaatgcagtagcagtgtatgtgggtctgtggaggttgaaagggacttggtagatgtcaagaagctagtggcagtcctgctgggcttttaaagggtctgaagaagtgacaggatgctgtggttgaatcctagcatgtattttagcatttgttcatttggagttgattatttcacgttgctttcatttgccattacctggaaagccaagggctctactctcatttccttgctgctctttctttgccttccttggtccgtgaagaagatggtccaggagaagctcattccatgcttgttaaccaggcacgcccctaagttccagtccctgagtcattcatgagtagcactgccaatgaactgacagccatgctgtgtccctccacatcccctaggtgactcgaagaagccttccaaaaagcatgtgaaaaggaagccctactctactaccaaggtaaagtagcctgtctttgcctaagatgtaaatgttgttttcttggatcctttatttttcagttgatatcagctatgggaaaattctccactacattataggtgttagataatatttccttggggatggaggaggtgtattttaccaactgacacctgattccagaggacgtgcaaaattggcagtgtcagatagtacactgggtgttaagggatgttttcttcaggaacaagctttccactttagataagaattctgcaattgctactcaaaaattacctagacagaaacattcttcaagaaaagctcctgtgctttcctaagggaactctactctagagttggggcttttgacttgaaccttatttccagtcttggttacccagagtttccaagtgaacaaaagacctgtgtgagccatccatagcatagcctgattctcagagtgttttccttctctaattacaggtgacttcagggagcacattcaatggtacgtattctggaatcactcactggttgttagaaaaggattctacaggaaatctggagcttaactgctggcttttgtctggagagcctccatgatccaagacatctggtgggaatgaggatgtagggtatagtaaaagaaactggttttcctggtgacatactctttttatctatgtatagtttctgggaacatgttcacattaggttgtgtgtgggtatgtgtgtattagggcgggggtggggtgaggtggtctgtgtgcaagtctgcatgatttgcttgtgaatgtgtgtctatgtgtgtttcccctaggaaaaaaatgttgtgtttacccagcacaactctcagtgccatttttcttaatttaacaaatcagaccacatactttacttacattagttcacacctcatcatcatcatgcccatatgttgtgagcttgtttattgagcccacatgccagatggagaaactcagccacataaataaatgtgccctggttcacttgctgcatagtgaagagtcaaaatgtttactcatacggtgctaatgttgaaggcctgaactacaacctctatttatcagccagtgaagagatcactattccccatgcaagggagttccagcaccctctatgcctggaattacccacacctgcagagatcccaaacgccatccctcacataagacagcctcatgatctcataatccaggtagctatgtagacatcttcctgcaggtgtcacatagtccttagtgtgaaaccaacatagaaagcccatgtttctgatcaaatcacaggttctgaaacactaagggaggcactaagtaggacaacgtggtgcctgcgtgtcatagctgggtctcctcaagacatggatcaagtccagtaagaattggggagatgctttagagtcttgatggagttatcaccacaagccctctgagctacacactttagggatcatgaccattaagtactcaaattaccatttggttgctatccgggtatccgtcgtccttgtggcaaccctcttgtgaagctggtgtggacagcctcagtgctggagctgtgcctgccttctgagtggaccctttctgtgttagcaggtgggtacaagcgtgggggtcagcacactcagtggatttacacacacagcgttgaagagtaaggctgggcttcattatttatacattttcaataaatgatgatcttcataacataaaatcaatgatgtagtacactagaatactgtccctagtattgaatcttgtctctcagcaaagggttgcttaaagtcacgtgacagattccattcaactgatgacacatgctgtagcagcagttaaagcagtcatttgaaaaggcttttactataaacttacgtgtgagcctgaagtgggggataaaagaggcgattagctcccctgtgccatgtttctattatgtgcgtggtggaggaaaattacacaggaaggtgatggagagaacagagcaaaggattggacaggtccattgaacccataagactatggtgaggttagtgaatgagattggtcattttaggtcaaattttacccagagctggtgcagccactgcccattcttagccagaccttattgcaggcagctctgatcaatagtcaaggaggcagtggggcttgcagacttaattcattaaatcaccaaagcaccagcccaaacggccacttttccagttaattgacagtagcttgcatattcaggtttgatcagtggaagggaagttactctttgcagacccatcttttgacaatcattttgtggtgtcggaaggtctgagcagcctcgggaggcaagcagtccctggtccctcagtgtagtcactggaggagacagtcactgagaggcagctggcagggtgaagggaaaggggaggcaggccacagagatgacagcctttaagctgtcatactgggaggtcaaggatctgaaagaggaaggagaattctttatcattaaggacctgtccttatctcaggcatttcctccagagcatcacctttgtccacccacacaccttgggctaggaggactggagaaagacagtgaggggtctcttgggtctctggcacagggcgtgatgaagaggtggcagtttttcaggaatctctctctctagggaaccaaatacatttcccatctcaggtccttcactcagcggggttgaggttctgctcgtcacttatcatctctgaatgtcagcaccctcaagtgtaaaatctcagccacagcccctcctctgcaccccctgcagggctgatgttctccataaaccataaggcgtcatgcccacggaaaagccgaacaggaaagcatgctccactgccccggagtcatgcaagttccccctccatattccgccactgctaagtgtccagcttattcctcctggcatgtagtaaacacttagagaacattactgaagtaccagtcctctctaaggttttcctgtatttagtgattttttagccctgcactgtgatactaagaagtagggcttaaatagggcctaaaaagtattgctaaaattacattatgacagtgcagagaactgagggcagagggaggacatgagcttgccaggtccacatggcttagtggaatttgaatccgggcccccactctgcaccagccctgcactcacagtcatccggctgtgttctcctctccaggaaggcactgcccacgcagtctgtctgatagaggtgttgagtgctcactgaactccgtgatcttcctgaaacccaactttgattcagtgggctctgcttggaagcctgtaaagaaaaggatcataagtttaaacttagaacagattatcactattttccctctggtcttctgtcagcaagatgtcaacagccctatctattgtcaatgcattaaccagcatcttctctgatagagaatacaagaagatatgctgtgcacaccaaccagtgtaggagacctcatggctcccgggtaaagaagaagaggtacccacaagaaggtactgtggaagttcattaattaagttgattcaagaattgcagttgcggggagtattcagtgtcccatatgtaagaggaaactatgaagagactaagccatattttttaatgtgtcaggattctaatttgcctggtcagtaaatattgctaccaccacaaaagtaaatatctacttaaaagtcaattttggttcatgtttaatgatagacaatgtttcaagctaatgtctagaacttacctggttgttaaacataagcatagatctccctgaaagagtggtgctatattattatttttcaattaatatatttctttagagagttttaaattgacataaaaactgagcatatggccgggcgtggtggctcacacttataatcccagcactttaggaggccaaggcaggcggatcatctgaggtcaggagttggagaccagcctggccaacatggtgaaaccccatctctactaaaaatccaaaaaaattagccgggtgtggtggcaggcgcctgtaatcccagctactcaggaggctgaggcaggagaatcgcttgaacccaggaggcagaggttgcagtgagccaagatcatgccattgcactccagcctgggtgacaagagtgaaactccatctcaaaataaataaataaataaataaataaaaattgagtatataatacacgaagttcccatattattctgtctcctcaccctcacttcctaatttcacctattagtaacatcttacattactgtggtacatttgctagaataatgagaaaatattgacacattattatctgaagtctacatttgcataatgttcattctttctgttatacatatatatgaattttgaaatatttaaaacattatgttcacccttatggtctcataaagaaaatgttcacttccctaaaaatcctctcttctcattaatctctgtcctctttctccagaaaccttggcaactattaatatttttactatcgcttcagctttgccttttccagaatgtcatatagttggaatcatatattatgtagttttttcagatgaatttattgcactaaattgatgtacgctttagctgctttcatgtcttttttatgccttaatggcaaaaaatggcacattaaatcaccaaataatattgcattcaatgaatttttgtctttttattcacctgttgaagaattcggtagatttcatgagagaaaccatctgggcctggtgctttctttttcggaatgctcttaatgtgaattcaacttatttaatagacataagtttattcaaattaggatcctagcatgaccttgggaagattgcctttcaaggaattgatacatttcactgaggttatcaaactgcggtcatagaactgttcatgatattccttttaatgcctaacagttcagtagagatggctcctcttttatttctgaaattggtcatttgtgttatcttctttttcttggttagcctgcatatcaattcattcattgtaatgagcatatcaaagaaccagcttttggttttattgattttctgatgatttcagtgttttaattttattgatttctgtgatgttgtttattacttttacttgctttccattgcattcctctattttctatagttccctaattgaaacatgatattactgattttaggtcttgtgatttttagtatattgcatccaatgctatagatttccctctaaggactgcttttgctacatccagaaatcttgccaagtcacattttcttttaatgtagttaaaagtatttttaattttctattgagacttcttctttaacccatgagttatttaaaagtgcattgctaatttgcaaatatttggggattttgtggctcttttacagttgttgaatttttgttgtcaggtatgtgttgcaaaagcagtcgtctacctcatcttgccaccacccaagatggcccaggatgtgggctctccctgagtgaatctttggcaatctgccaacctgatgtgttcggcctccttctttagtctgagcttgccttctgcttagaaagggccattctcagttctggcagggagttttcccaacattgagaaggtggcattcttactccccactgcagcctgcacctctgaccggtggtcagcagacaggacagaggtcctcatcagacagagttcagcagggtctctgaccaaagtgcatcttcagagtctgcacctacccactgtgaccacgggcaggctctgagtcctaaagcaggaggaactgtgcgaccatcctgattggaaatttgtgaggatcaccgtgttactcaagtaaggtctttggaaagtgtcgtattactactgtttgtgaactgcttgttggtggcctggctgagccacacactttatgaaaaccaggacccctcagctggtgtgggtgtctatgcagcctgagaccctcatgtgaacagcctcgtggcagctgtctttgccccttgccaccatcagtgcctccttgttcctgggcactgctttctctgatggtgctccattgttttcctgcacctcagtgtctacagctggatgtctcttccgcaatctaggcgagggggcatcaacggcagttctgctgtggcactgccctccttcttagcttgtcttgctctgtcttaggctccctcaaagatcccacccttcaggttcttccacaagtttcttattgaaatccgagcagaaaactatgaccaatatgaccaatcctatacccactgaagacatgaatgaagaattaaaacaattctccatggactctaccatatagatccctagaagtaatttctaaaaaaaaaaaaaaaaaaatcaaggaagatgtaatagttttccataaattagaataccctacatgtacaattaaatgaaatggctagtatagtcttgaaaccaaaaccagataaggtaaattaaattctgtgatattttaaaatactgtaaattctgactaatgtgagttaatctcaatatatgaaatagtagattaacattgaaaatgcaataaataaaattagctacctcaagagtttaatggaaaaaaatgtgattattgcaatagattcaggaaattcatgaataacattcaccctatatttgtaggacagctatctaactttaagtgacctgtgacaaccatttgaattaatgctgctttcacagcatatctcttggcttgttaaaaacccgacaagaatttccgtaacattaatttatttttaacacctatattgggtgtgaacccaccataaagtttgcccactgaaaaggtctacaatttgatgctttattaaattgatactgtgtgcacccatcaccacgatctaatttaaatatgtttccctcacccaaattctctcttgcgcactggcagttaatccccactcccatctccagccctaagcaatactgctgtgacattccatctccataaatttcccatttgcttaatagaaatggacatatatatatatttggaatctgacttccttcatttagcatactatgtttgaagttaattgacgtgttagcacgtgctggtcatgtgttttccttcatagtctgctgtgtttactcatacagatagtgtttattcatttatcagttaatggacatttaattgttttgttattttctttgatgagtaatgtagctttgagcattcatatacagtcatgtaatgcataatgacattttggtcaaaaaaatttttttttttctgagacccaggctggagtgcagtggcacaatctcggctcactggaacctccacctcccaggtttaagcaattctcatgcctcaacctcccgagtagctgggacaactggcacacgccaccatgcctggataatttttgtattttcagtagagacaggattttgctgtgttggtcaggctagtctcaaactcccagcctcaggtgatccacctatctctgcctcccaaagtgctgggattataggcatgagccaccacacccagcctaatttttttaagaaacaagggaactattttctaaattacttttgccaatttatatttctaccatgatgcatagcactaatttcaccgtacaatgtatggtaggccccaatatgtaagaaatgatgaaaataacacataaagattggtataaaacaaataagattatcattgttgctatcatctttgtcaaattctgaaaacaatctgagtatatttttatataaatatgcttggcaacatagctgaaaaacgcattatcagttacatttatcagtaacaaagacataaatttgaagggggaacaacacttgtactaacaacgcaatgtcagaattaacataaaaattctgctggtcactttggaatatttaattgcctggggcagtgtttagtagacaaatgagcatctatggagcactcaaagtaggggaatcaacagaacttgggtttgaaaagttatctgggtttagagcgtgaaactttgttagaggacacgcaccttgcatgagcgaggtgccctggtgtgtgtggacgtaccattatgcttggaggtacagcataatggtggcttcctccagaaagggacatttggggtggattcattccatctagacaacacagcctgatgtggcatggacatgaatggaggtgaaatggtcagtagttgagaggatcagtcctgacaagggccgaggtgaaaaacctgggaaccccttcaggtacaaagtcttcagttgaaaaaggaggtggtcacaggaaatactgagacaggacagcaaagcatgggagacagagttcttggccctgcagggtgagtagtgtggattctcaagttttctcctctctccattaatttctttcccaatgcagatgacttccatcatacagtcttcagcaaccttgaaagattggacaagcttcagcccactcttgaaggtaaaggaaggcagctaacaagactggcatctgggcttggctgtgcgtgttttctatcgtggggaaatatatataacacaatatttatcatttgaaccttttaaccaaagtgtgcactccatggcattcaatatattcacagggttgcataaccaacaccactatctacacccacaattttgatgatttcttacgaaaccttgtccacaataagcaatatagcaccttccccctatttccagcccatggtgattcctatcccactttctcttgtatgaatttgactattctaggcacttcatgtaattacaattatacaatatattccttttgtgtctggcttatttcactaagcataatgttctcaatgtccacccatgttgtatcatctttcaaaatgatgttcgttttttacagatggatgatgtagcattgcatgcagaccaccttgcttttattacattcatttgttcactgatggttggattatttccaccttttggctcctgtgaaaagtgatgctacaaacattagtatacaaacatctgtttgatttccgttctctattctttggggtgcctaagagtagagttcctgggtccaacaggggttctatatttaaccttctgagccactgcagactgtttttcacagtggctgcaactttatccatttctaccatcaatgtatcagggttacaatttctttacgtccttcttcacacttattttcctttaaatcatcctagtaggtgtatattggtggctgcttgtgtttttcatttgcatttccctaatgactaatgatcctgagcagcttttcctgtgctactatctgtggctgtatcttctttagggaaatatatgttgaagtcttttgcccatttttaaagagttgtctgatttttatttagttagtttgttgttgtagatttttgaatatatcttaaatatatttaaaatatattctaaattttagtctcttacaagagaaatgatttgcaaatatttccacctttgtgtagaactttagattcacaaacttcgttaatttgtatgaaatcctcagcagttgaccccaaacagataagactgaagcagtattttaggaatagttgaaagtatgatcaccacaaaacataagcgtaatcaaatcctgcaagctacatgtaaggcacaatgacaaataaggcagcaaagggccatctggtgattagttcaccacacttgttgcaactgtttgcgctgcagagttaaaacacaccagcattcaacccgtgtctcctctcttgaagtaaactgtcgtatgttggctggcctgaacaagcgtagatattctccatcctcaattaatatgcatgcatgacaaagaaaaggaggcctggatgaaaaaatattgtgtgattaataattatgctttaattaattttaaaggatataatttcagtacttctaattctcccatcagcagttataacaaaggattagtgaataaataccatagactgttttgcctagaattgaatccaatctatctattaaactttgcttgtattcaagtgcaaaatgctaaaacacataactgcagtgacagccactgtggatcctcagaggtaaaagtagtcttgggacataaatcctgcaagctaatattgtttttacaggtttagaaaaccatttagctgggtttcaaacctcacagtgtgagcagtgggactctcatcaaactatagcatgtgcttcagtaccatttgtagactgactcattcccattttcttcagttgccatcagcaaaatgccagggactctatttcttgctccttagctcctcgttcttgcctgtctttccacgagggaagattttctagcaggagctcaagctgtgcttttaatgaaacacatccacacacactgtcctgttgtccacattaagcagagctccctgaataactcatgaacaaaagcatctatgactaactgttgctctgtgtcctcctagcctctgaggagtctctagttcacaaggacagaggagatggagagaggccagtcaacgcgagggtaaggttgccttgctttctctgaaatagaaatgttcctttcttggtgtctttctttttcaactgactttacatgtgaaaaaatgacaatgtccatgacaggtattaaatgcagttttctgagggggaggaagaagtgactcttagcaactgatatgtaatccaaaatggcatttagctatgacggcttcaggttgtggactgtatccttggggtccttgtccttggaagcaatgtcttctccttggattcaggattttgcacttgccaacctacgtggacctgagagatccaccatccagaagctgatgtcttttccagtgtgtatcctacccttgttttggaggccttgaagttgactacactttctgatcaagttttcagtattcattgagagaaacagagccttgtgcaaacaatccacaacatgagatacccctgaaaaagctttgtttctgtattgcaggtggtgcaggtggcccctctgaggcttgaatctagtaagtattctggaatcacttgccaagaaaacaatctggatgccaagaaaggtgtggcatccttgcctggtttcaatgtgaagagcctccctgatcctgggattgtgataggaataagtataggggaagtgtttttttaaaacctgaattccccagggaaaaattatggccaaattttgaggaagcagctgtgctcccttttgggtggtgctgagttgggtgcttgaggattggtggtgtcttgtgtgaggctgcatcgtgtggtgtgaatgtgtgtgtttctgtacaggtgaggctgtgtgttttctcaggagagatttcccacttatacaacccaatcaccagtgtccacttctaacaataaaatccacccccgctctactctctctgtacagtgactcctccaccctcaccagagccatccccgggtctgccttattatccccactgctcaggtggagaacctgaagggccaagggagtggccccagctcccgagttcctgaatgaaacagtgaaaacacgaacccaggagtgtggaccagtgctgacgctgacatgcacttagtcatggggtgttcaccaccacacacggagtccagcattcatgtataagccctaaagcaacgagcccaaaaggccccagacactgcccatcatcataaagtggcctccgtggtcacacaacccagggcagttatagcctcatctccccacggaccgacatagtcatcagtgtgtcaaaagcacaaagatccccaggtgtttggctcagctcacagatccctttttttatttaacttttcagttcaggggtacatgtgcaggatgtgcaggtttgctacatatataaatgtgtgttatgagagttttttgtacagattattgcatcacccatatattgagcctaatatcagttatttttcctgatccaccccctcctcccacctcccaccctccagtaggccccacgctcacaaattctaagaggagtgggggaccacaaaggccagtgtggcccacttcagttgtgaagttaatttgctcagcaactggccaaagtctataaggatgggtgatgtattttagtagatttagtaatactatcttcccaagccctaaaatgctcaaatcctgccagccaaaaatggtgaggagggacagataggaactctgtgtggcacttggttattagcctggcttccatcccttagtggcaactctcttgtatatgtgggttaaagaccctcagcctcaagccaagcctcctccatgaggagccatctcactattgaccggctagtgccgggtatggccaccagcccaactgaaacaaaatgttgctttaaaacaagtgtaaatctcatacatacaacaggcaaatgcagaagcagtgtggtctcgcaagttgtaaagaggacagtcgcaattttgctggacttcaacctgggtagaagacatgagggaacctgtcactaaatcacggcagagttcaaggccacttgtagactatttcatgttacagaaggtggcctttagctactaagcaaaggcctctgtttctcatttctttcctgttcatcttcttggtcatccttcttccgcaagggaaacgagcccaagcaaaaggcagtttcaatattaatttgaccgaggttttgtgcagtttattatcatccaggtaatcaggtgcaacccagtctgcctagccgcccccctatctctgctctgtgttttcatttaataaacattttggtctacttactatgtgctagattttctcgagaccaagtaaatgagatagaatctttatgctggcagctaagttagatttcacataactgacaaaaattaaaatttctgatttcttgtaaaaatattttgtatgtgtgaatgcatactgaatgtaaagtggataaaaaactcacacttgcactcatggaaggcttttcatgaatttgtcaatttttattttttatatttccccacttcaccagataatgcatacctgaacctggaaactgattcccactgcagaaagtgttctgagccacatcccttagcttcactagtgcaggtccacctgggaggatgtcccagcatcagcttgacccatgctgtgatcagccacctccatgcatcacaccaagcaagcccctgggtgattcacagtctccaccaccagggcactgaccttaactctgtgtttttctagctccccatgaggacaccgtacacgacatcactaacgaggacgccacacacgacatcgctaacgaggatactgtacacgacatcgctaacgaggccgccgacaagggcatcgccaacgaggatgccgcccacggcatcgccaacgagtacgccgcccacggcatcgccagcgaggacgccgcccacggcatcgccagcgaggacgccgcccagggcatcgccagcgaggacgccgcccagggcatcgccaacgaggacaccatccagggcatcgccaaggagtacgccgtccacggcatcgccaacgaggacgccgcccagggcatcgccaacgaggacgccgcccagggcatcgccaacgaggacgccgcccagggcatcgccaaggaggacgccgcccagggcatcgccaacgagggcgccgcccagggcatcgccaaagaggacgccgcccagggcatcgctaacgaggccgccgacaagggcatcgccaacgaggatgccgcccacggcatcgccaacgaggacgccgcccacggcatcgccagcgaggacgccgcccacggcatcgccagcgaggacgccgcccacggcatcgccagcgaggacgccgcccagggcatcgccaacgaggacgccatccagggcatcgccaaggagtacgccgtccacggcatcgccaacgaggacgccgcccagggcatcgccaacgaggacgccgcccagggcatcgccaacgaggacgccgcccagggcatcgccaaggaggacgccgcccagggcatcgccaaggaggacgccgcccagggcatcgccaacgagggcgccgcccagggcatcgccaaagaggacgccgcccacggcatcgccaacgaggacgccgcccagggcatcgccaacgaggacgccgcccacggaatcgccagtgaggacgccgcccacggcatcgccagcgaggacgccgtccagggcatcgacaaggaggatgccgcccagggcatcgccaacgaggacgccgcccagggcatcgccaacgaggacgccgcccagggcatcgccaaagaggacgccgcccacggcatcgccaacgagctgtatacgacatcgctaacgaggacaccctacaagccgtcgctaacaagtacactgtacacaacatcgctaatgagggcactgtacaagacatcaccaatgagggcgctttatacgacattgctaatggcaccgacaaggcacgctaacgtggacgctgtacacgacattgctaatgaggacagcgtataagacatcgctagtaactatcgcaagaacaaaaaaccaaacaccgcatattctcactcatagatgggaattgaacaatgagatcacatggacacaggaaggggaatatcacactctggggactgttgtggggttggggggggagggatagcatcgggagatatacctaatgctagatgatgagttagtgggtgcagcgcaccagcacggcacatgtatacatatgtaactaacctgcacaatgtgcacatgtaccctaaaacttaaagtatatatataaaaaaaaagacatcgctagtgagcacgctgtatacgacatcgctaatgaggacaccatacaaggcatcgctaacgatgacgctgtacacaacatcactaatgatgacaccgtataagacatcgctaattatgacgctgtatacgacatcgctaatgacaccgtacaaggcacgctaacgaggatgctgtacacgacatcactaatgaggacagtgtacaagccatcactaatgaggacactgtatatggcatcgctaacgaggacactgtacaagccattgctaacgaggacgctgtacacaacatcgctaatgaggacaccatataagacatcaccaatgaggatgctgtatatgacatcgctaatggcacccacaaggcatgctaacgaggacgctgtagacgacattgcttataaggacaccgtacaagacatcgctaacgaggacgctgtatacgacatcgctaatgaggacgttgtatatgacatcgctaatgaggatgctttacaagacatagctaatgaggttgctgtatatgacatcgctaatgaggacattgtatatgacatcgctaatgaggacgctctatacgacatcactaatgaggacgctgtatacaacatcgctaatgaggacgctgtatatggcatcgctaatgaggatgctgtatacgaattcgctaataaggacgctgtatatgacattgctaatgaggacactgtacaagacatctgtaaaaaagaagatgctgccaatgtaagacacttttctttgtcttgaacagaaatgttactttcctggcttctttccaatcagatgtagacatgaacatctgccagtgtgcattatcgatgtcatctgcagtttaatcaaatgtagacatgaacatctgccaatgtggactatttatgacatctgcaattcccttggtgtggtgctattgattggcagcctctcaccaacccatgccaggcacactggggtgtggtagatggcagcatccacgatccactgcaatgcagaggtgtttccctccacagcagttttcccccatggattaagagttgtgaaactgccaatctagatacactttaaagataaattctgtgggaaaaggtcttgtcttttccacaggtgtcttccgtgccagttttgggggacttcgacctttgactcaatcactataccccttcctattttctctctcaagttgtcgagagactatcagatctgtgtgacgtgtatggcatcatttcaccctcctaatgttttcttttctataattgcaggagccattgacactggagaatgatacgtaccctgaaataactcacttcctgaggaaaaagcgccatctctagggtacagaaacctgattctgggctccttttgggaaggaggatttggggtctggtgagagcaaatgattttgcaagtataaaaccatgtccagagaggctgtagggatatctgtgagcccagaggaaacaccaggggatcctgtgcgaagcaccatggcttcagctagggtgggaggagtgggtgggcctctctctaatgacttatcctggtgtttgtgtttctaaagatttgattgtggagagcatatctgatgatggggatttgtaggtaggtaactgctttccacgtaagatccaattggagagagttcccaggggccttcggggtatccatgctgcttgggaggttaagggagggggcatgaaatcaaaacgaaacaggaaatatgtgtcatatcggatttggtcttttccgggtttattggcataatagttagaactgtctctctgggctatgagggtgctgtgttatttaaaggtggtctttcccagaacacctggccttttcttttctgcctctgccaaacatcacagcctttgggttggattagtcagcaccccttgggattgtgcagaagaggtttggggttgcattgagtgtcacctgtggtgaacagaatctgagggacacaactctctcacaggcacttcctccaacctggagacagagttctcctggtgtgtgcccaggggtggaggagaaattgacagtctgcctctgaactttcaggactttaaaaagcactcatgtttccatcctcactgttgactcctggcttaaagggatctcccggggtgagtgaggaggcgggatcggaccctggcagtctgacggcagcacctgtgttcctctgcactgggccgtggatgacattacataccttggtgagaatcaggaattgaggctaaccacatctgaaattgagatgggccttgagtcatataaatagtttggaaaagatgcattttactacgctattgaaagaaaccatttatttctcactccagcaggataaatggttttcagtatccatttaactgctcattgactcttactgtagatgaggaggtggccagcagcccctgccctcccccagttggtaggcccaaggtaaccagcaattgactggatataatggaagagtggtgcattcgggggtatctgtattaatgggacccacatgatatggatgagagctattagggtgagaaaaagcctgggagcacaatgaaatatttaaatattaaacaaaacattgttgaaatctccattgtactttagtagttgaagtcattcttgtggtcatcactgcctttcccaagcataacaagctacttaatatcacatggacccgtgccatgaggaatgatgatcagtttgtaaaatgccaataaaacaattgcctatataagccacaatgtttcatccatatatttcaatttccatgtgtaagtatagttcaaatttcagaaatttattattatctaatagaatatgcatggtatatcaatgagcaattatcatactgtttctattaacaattatttgtatgatgaaaaaagcagactcccattcttggatttttctcagtttgcacacattagcatgacagccccatttccacctgacatgtgccagcaagaggccaggaacagaggcttttcttattaactaagatttctaaatgtattacgtattcacatttagaaactctaaatatcataaaaggttagcaaggaagtttcccttccactctgaacttccaaacaccaagtcaacatttttgtttgcatatcatccctgcaatctatgtgcaaatagaagcatgcacctggaatgcaggctgatgtgtgatcatgtttacacaaagtcctctgcacctctgcatatatcactgggcaatgcaccttagttatcattccacatttcaaatgtaaatccattgtattgtttcagagctataaagtactgcaccccatgactattcccaaaattacttaagcaccccgctatgggtatccatttgttctgtttccagtcttgctcttataaccaatgctgtagtgaacagcactgtgttgagaagcggtgaacgtgggcatctttgtcttgttcccttcctcaggcggaatgctttcaactctcccccattcaggaaaatgttggctgtgggtttgtcatagatagcttttattaccttaaggtatgtccgttctacgctgattttgatgaacggttttaatcataaagaaatgctggattttgtcaaaggctttttctgcatctattcagattatcatgtgatttttgtttttagttttattgatgtgatgtatcacatttattgacttgcgtatgttaaaccatccctgcatccctagtatgaaacccacttgaatcatggtggattatctttttgatatgctgttggattcagttagcttggttgtagcatttcttattattccatctgtggaatgtattggttgaaataatgaaaacatgttctatcctcactgcttagcactttgtgtttctttaatagccttcccaacagggcaacataaaagcaggagccctgctagtctccccttaacccggaatccccccttctccacagctcgctcattggacaggatagactgggcgcccaggcttcaaggtaaggacgtgctctgtcacctagaggtgcagtgcttgggaaggccaaccttggagggttgcctgccagctttacagtgacagaggtgttgagagggactgaccaccagtgcataaggctgtgctttgttggtgacataaaggattgtttcacagattgttggggagggacaatcccaaggcctcccctggccctggtgctggctctgcacaaaggcaataagagagggatgctggtaagggctgacctgttgctgtgctggggaggaaggtgctgggctgaaattcaggaggctgaggatgcagcagtcccataggaggtacatgaccttcaggatacattttcttcattgatgatcaatggaaatgagaaatcactgactattttttctatcattggaatctactctccactgctcatgctgttcctgtcttttggggaagatggaggatcaatcagtgtgcactgcactgagtggaaggaaggagaactgtgacaaaaattaaggaaggatgagagacgggagggcccttcatccagctgcttgcagagtcctcctgaggaggaaagccccgtggctccctggagaaggagcattgagggctgcgtgactcccacagtgaagtgtgtggtatgtctgaggacacccaggctggtggtccatgaggagccagtggcagagtgagaagaagaaaggccaggagggtggctggaggccaggctctgagtcattctccatgtgatggaaacagccggagcccagtgggcttggaggtacaggatgcggtggctgatgacagaacaatgtggagagaggcgtcatttgtcaaatccttactttgttctgggcattgtgctaaaaattctgatggctcatcccatttaggggctgaaagttgcagaggtttaggaagctcacccacgatactggagcccccatctcctgccctagtgctgtccaccttctcacccagccaccacctgtttcgggggaacacacagaagtggtaacctcttatggagaggcaagtaaattctgctgtttttgttattcacagaaaaacactggctcgtgtgggttgggaaggtgaaataccagaagtatttcatctggttatttctacccatgcgactcctatagtattgaaatgcataggttagcatttttggccaatttactcagcattctgggttaaaggcttttatttattttatttatttatttatttatttatttttgagatggagtttcactcttgttgcccaagctggagtgcaatggtgcgatcctggttcattgcaacctccgcctcccaggttcaaactattctcctgtctcagcctcccaagtagctgagattataggcacatgccaccacactgggctaatttttttgtatttttagtagaaatgagatttcaccatgttggtcaggctggtttcgaactcctgacctcaggtgatctgcccccctcggcctcttaaagtgctgggattacaggcgtgagccaccacgcctgccctaaagtcttttaaaattcacttgtataagttgacttagttttctttaaccttgtagaaaaatacaaaaatggcaatctcttttatcacacaaataatgtctttttaatggagtgatttttttctaattgaggtattatgtacttttcatttactaattattgtttacatttgaagtgttttatgaattaatatttaattgcatagatgaagattactagttataggcattttactaaccaatactcattaagcatagcgtggattcctatgacatcaaggagctattttatttggtaaaacgaaaaagcacaagaatgaacgaacgcaagaactgaaacagtggagacacctagaatgacttgtctaagatctaaatcattttgttgtcttcccagcgtacttattatcctgatcattgtcatcagcattgtttgggtccttttagcacagatttctcaaaatgggtaactccataacagttggaagcttacgaattcatataatttgtaagaggtcaatttgggagtacctatctattttaaaattccaataacctgggaatttcatcccatgtctagagtcttttatgtaaaatatttccacaattaggagaaatatgtgcatggggattttctatgtagcggtgttttgatagaatagaaaattgggataaaccaaatttccatcacgaaggaaatagtaatatgctgaataataatacagcgaatattatgcaggctttaaacatcaaaaaagagttcaacttctgacttccgatgatggtgttgaagcaggtcactgctggtttacatttgattttcatgtgggaactctggaagtccgccttagtgattttacatgtggctaaattgagctaatgacaagctgtttgcagtatggcaaaatggaactttaaaacagtatcttgtcaacaaccaagaggacctgtttcacataaagcccacgcattcatctgcctgtccatcattctgtctgtccacacgggcatcattcgttagtggaactgagtgcccgctgtcgagctgacaagcccataacctccctgttcctagtcacacattaattcttcaacaagtcccttttgatagattgtgattaagcttagctactatttccaattgcttccccaaacgtacttctcactgttctcccatcacacccttcagcccatccatgcggggttcctttgcttttcccaccttacaccaaactccctatttttactcccacttttacctcctctccaagacacaacaaacaaaactagcattttaaaacttagttgtaatctttcttccttcatgaaaatttctccaacagccactcccacggtcctgtgtgttccggatattttaaaataatggctataaggttgagcacttcaggatacgctgttttgctgtgtgcagatggaggcagtggctggagtgaatgaacggcaacacttgctggcaaccggcagaagctgagagacagggaacaggctctcctccagagcctccaggagccaggcctttggacaacttgaatgtgggcttctgggagaccatgcgtttctgttataagcagcccagtctctggcagtttttacggctgccccggaacactcatctatacctgtctgacaaggtcaagctccaaggaagggactctctacatatctacattgtttgcagattttacaataatcatttattcttgcatggctgatcattgttaaccaatacaaataaaataataaagaaatgacccacattttatgttgggagtttgatctgccatttatcaagtatggaatcttgaacaaggggttaaacatctgaatgtctccatcacttcatctctaaagtgggggtgctcacacccactgggctcccccgcccaggttggtgccggactctccctgggcccccctgttctctcaccagccacatccattctccccccagaggcgctagtgactgtgcgtggctttccattcccaccacgtttgtctctaaccccagtggcagatcagtgtaagaacacagctgagtgctcctcgcctccttgccccttcaagggcccctcaccacccaccagatcaggtgcaaacttccaagccttactggatccccttccacattctgagctccgcctgccttcccatcgctatccttccccacctgcctccctggtagagaaaagcggagtgtgtgatgctgtctgaatgctgagcacggccttttgcagccagtccactgtgtacgctgcccctatcggagacctccaccttaaccctttccagcctggaggctcctcccagggccccacaacagaagtgacttcccttgcctttgaatttctatagcacaatccctactgccccccgttaaaactgcaaagtccttttgtggaaaataactttattcatgactgtgtttatcacactatcttatggagaagagatgatcaataaatatttgctgaataaatgaatagcagttacaaaacacttgattcatatggaattaatgttggttctcaaagtgaaaaattacaaacagcactgatattcagccagtatacaagtctggtcacagcagttgtataatactgaaataccccctgccactgacctttggcccccagatgcctcccactgccactgctctccccactgggaacccctgaagttcccacaggctcataactaaagggctaatgtcttgcacagcagcgagcacccaggaccgagcagccacatggccgggtctgctggtgaaagcatccattctgactgatcaggacctgaggggcctcatggttacatattttgataatatccctaattataaataaggctcagttatatagtttgaaaacagtgcttctcctcattgcaaaatctcttagaagactccgtagatccaggaacggaaatggaaaatgacagcgtgtcaatctctgaaggttttgggcatttccattagcactccatcttcatgtaaaccagaagatatgcagtttcctgcctagagagaagagaagacacatcagcacagcggcatgaaaccttcatcagaaaacaatgcttcattaatccgtgacaggacaagcgtcagcaaacttccaggcggctggattaggccttcatctatccatcaccttggagaggaacaaaataggtggcctgggaagataagcactatgtttctattagttaatatctaaagcggaggttaacaagctatggacacacaagccaaacccagccctcttggggttttttaaatctactttcaacttttattttagattcagcgggcacatgtgcaggtttgtcacatggatatgagcatactccccaacagttggcctttcacccctcccctccctccccatccagcagttcccagttgttgccatctttaagtcaatgagtccccatgtttagctcccatttataagagagaacatgcattatgttttgtttggtttttgctggtttttttttttttttttaatggagtcttgccctgtagcccaggctagagtgcagtggcacaaccttggctcactgcaacctccgcctcccaggttcaaacgattctccctcctcagcctcccgagtggctgggactacaggcgcccaccaccacgcccggctaactttttgtatttttagtagagacagggtttcaccgtgttagccaggatggtctcaatctcctgacctcatgatctgcccaccttagtctcccaaagtgcagggattacaggcgtgagccaccgtgcccagccttttgtttattttttgatgagacggttcttgctctgtcaccaggctggagtgcactggcacaataatagctcaccacagcctcgtgctcctgggctcaactgaccctcctgcctcagttttagcttcctgagtagctaggactacgggtgtgtaccaccatgcctagctataataatttttatttttttgtagagatggagtcttgctttgttgcccaggctggtcttgaactcctggcttgaagtgatcctcctgcctcggcctcccaaagtgccgggattaaaggtgggagatcgcacccagtctccaaccctctttttgcaagtaaatgtaactggaccccagccatgctcatctgcccatgtactgtctacggctgcttttgctctacagggcagagttaagtggttgcaacagacactgcacagaccacaaagtctgaagtactttctctccagccctttacagagaaagtctgccaacctctaatctcaataacagggaaatcaatgacaaccacaaagtgacaaagattgggtgtctaagatggatgttcagaataaacaagagagaaagatgagaagtagaaggaggatttcaaacgcaagcttcacctaatccgttatttttcaaatgaccaggcctatctctgtagccgaaaatcacctcaaataggatctctgatatacagtctccaaaagctcagctaagaaacttacaaagtctctctgccttaacttcatccaccttttttctctccagcttctcctcggtagttaatgattataaaaatatttattggctcatgcctgtaatcccagcactttgagaggccgaggcgggcagatcacggtcaggagatcgagaccatcctggctaacacggtgaaatcccgtctctactaaaaatacaaaaaattagccaggcgtggtggcgggcgcctgtaatcccagctactcaggaggctgaggcaggagaatggcgtgaacccacaaggcggagcttgcaatgaggtgagatcccactactgcactccagcctgggcgacagagcaagactccatctcaaaacaaacaaacaaacaaacaaaaaaacagtgtgatggccaggcgcagtgctcatgcctataatccaagcactttgggaggctgaaatggatggatggcttgagcccagtagtttgagacaagcctggcaacatagcgagacctcatctctacaaacatctttaaaatatgccaggcatggtggtgcatgcctgtagtcccagctattcaggaggctgaggtgggaggatcacctgtgcccgggagttcaaggctgcagtgagctatgatcacaccacagtgctccagcctgggcaacaaagcaagactccatctctaaaaataaaataaaatttaaaaaaaagatcttcgctgtaaaagaggtacgctcaaatgcaataaaagcatataagaaggccgggtgtggtggctcatgcctgtaatcccagcactttgggaggccgagacgggcggatcacgaggtcaggagattgagactatcctggctaacgcggtgaaaccccatctcctctaaaagtacaaaaaaattagctgggctaggtggcaggcgcctgtagtcccagctactgaggaggctgaggcaggagaatggcataaaccagggaggcagagcttgcagtgagcctagatcacaccactgcactccagcctgggtgacagagcgagactccgtctcaaaaaaaaaaaaaagaaaagaaaaagaaaagaaaagttcttctgacatttgtgtatgaaatcagccttcactacatggataggaccagcacgcttctgcggcacgactctgcaatcttactacatttttttttactttgtattttatttattccttttgagacagagtctcactctgtcacccaggctgaagtgcagccgagatctcggctcactgcaacctccacctcttgggttcaagcaattctcttgtctcagcctcccaagtagctgggactacaggcacacgtcaaaacgcccggctaatttttgtatttttagtagagatggagttttgccatattggtcaggctggtctcgaactcctgacctcaggtgatcgacctgtcttagcctcccaaagtgctaggattacaggtgtacatttatttatttatttgagatggaatcttgctctgtatttattaatttatttatttgagatggagtcttgctccatcgcccaggctagagtgcagcggtgcaatctcggctcattgcaacctctgccttccaggttcaagcgattctcctgcctcagtgtcccaagtagctgggattacaggtgcctgccaccacagctggctaatttttgtatttttagtagagacagtgtttcaccatcttggccaggctggtctcgggctcctgacctcatgaaccacctgcctcagcctcccaaagtgttgggattacaggcctaaggcaccatgctcggccatatttatttatttaattatttagagacaaagtcttgctctgtcacccaggctggagtgcagtggcgccatctcagctcactgcagcctccgcctccgaggtttaagcaattctcatgcctcagcctcctgagtaactgggactacagatacttgccaccacgcagggatttttttttctatttttttgtagagacacagtttcaccatgttggccaggctggtctcgaactcctgaccttaggtgatctgacagcctcgtcctctcaaagcactgggattacaggcatgagccccttgcccggcctctcactacatttaagtgacgccatggctcatgcctgtaatcctagcactttgggaggccaaggcaggtggatcacctgaggtcaggagttcgacacgagcctggccaacatggggaaaccccgtctctagtaaaaatacaaaaattagtcaggtgtggtggtacaagcctgtaggcccagctacttggaagactgaggcaggagaatcactttaagcgggaggcagaggttgcagtgagccaatatcatgccactgcactccagcttgggtgacagagtgagatactgtctcaaaaaaaaagaaaaaaagagagaaaaacatatgatgccggggcatctcggcctcaatacctgggtgagcacagtcatgtccaggccagggctgctggtcgaggtccggccccatctcttccagcagaaagggagtaagcttgcagggcggctgggggacaagatcccaggatctcagcctctgctcatggatcagctctgagaccccgagtgagctgggggtgctctgtgcgcattggtttccccagctgtcaagtaaagggattggatgaggaagtcttgtcaaggtggaatgatctcagatttggggcagcagtgaatgatcccgctccctgggccatgccagtggcccggcctcggctgaacacagccccaacactctggaatggggatgagggggcagtcagctcttgctcctagtaagagagatgcaacagggctctgtggctgagctgggtgccttgcctcacacctgtaatcccaacctttgagaggccgaggcaggaggattgctcgaggccgggaattttgagaatagcctggacaacatagccagaccccatgtctacaaaataataagaaaacacacagctatagtccaagctacttggcaggctgaggcaggagggtcccttgagtccaggaattggaggctgcattgagctataatcgcaccactgcactccagcttgggtgacaaagtgagaccctgtctctaaaagaaaaaaaattggcctgtgagcatgggcttgattttcaaacaggacccggagggtagggtaaacgtgtgggtaaatctaaatgaatgttattggtataaaattacagtagtatagaaaatgatatcttgtggggtttaaaataaataaaacatactgaaatatgtattggtacagttatatatctgggatttgcactgaaataatgtggggtagagggaagcaggaaagagtatacatgaaatgagcttggccataagattgttgttgaaattgaatggatactcggggcttcattacacaattctctttactcttacatagctctacactctcaacataaataagaataaaaacacaaaaaacacacagatacatctatgcacacacacatatttaaaatacacaaaaatattagcatataagtcactgggggtaaatttagttcctgttccaaggttcttgtactgactaggaagaggatagaagtactaactcataggctgggcgcggtggctcacgcctgtaatcccaacactttaggatgccgaggtaggcagatctcttaaggtccggagttcaagaccagcctggccaacatggtgaaaccctgtctctactgaaaaagaatacaaaaattggccgggcatagtggtgcacacctgtggtcccagctactcaggtgactgaggcaggagaattgcttgaacccaagaagtggaggttgcagtgaaccaagattgctccactgcactccagcctgggcagcagaggaagactctctctatctcaaccacaacaaaaagtactagctcatgttagactttgataagggaaggatgcatgttgtaagctctaaaataatccagtcatcttttaaaataactctaagactgcacagttatgaaactaatagagaaggaggaaattaaataataaaaataataaatccaaaacaagatgtgagaggagataagaagaaatagaataggcatggaaaacaaattggtggtgggtttcaacccaaataaatcattagttacatttaaaaggacaataaaaattaaaataattgaaaataaagtaaaacccaactaatgccttttatataagggtacagagaggtggaagatcatgaaaaatatgtcatgcatgtactaaccaagaaagctgtataactttttttttttttttttttttttttttggagatagagcctcactctgtctcccaggctggagtgcagtgatgtgatcttggcttacagcaatctctcccttctaggctcaagcgattctcccacctcagcatcccaagtagctgggactacaagtgtgccaacttagaattatattagccacacccagctaatttttgtattttttgtagaggcagggtctcgccatgttgcccaggttggtcttgaactcctgggcttcagtgatccacccacctcgacctccagcaaagtgccaagattacagccatgagccaccatgcccagcataactatttttaatgaagtagactttaagaagaaaagtattattagaggtaagagacacatcacagaaaagaagaatttactaggagccaggcgcaatggctcgtgcctgtaattccagcactttgtgaggccaaggcggcggatcacctgaggttgggagttcaagaccagcctgaccaacatggagaagccctgtctctactaaaaatacaaaaattagccaagcatggtggcacatgcctgtaatcccagctactcaggaggctgagggaggagaattgcttggacccaggaagtggaggttgcggtgagctgagattgtgccattgcattccagcctgggcaacaagagcaaaactctgtctcaaaaaaaaaaaaaaaaaaagaagttactagctagtttcggtaattcttaacaaccaggaaactggatgtgaaagtttttcagagaaactaaaccaatagattatacatagagagagatttatttaggaattggctcacatgattgtggggactagcaagttttaaaatctgtagggcaagccagcaggctataaattcaggtaagagttgatctcgaagtctggaacctaaaatctgtagagcagtcagcaggccagaaactcaggcagggtttgtgtgttacagtcttgaagcagaattcctgcttctctgggaaacctcagtttttgttcttaaggccttcaactgattggaggtggcccacccatattatggtgggtaatctgttttacttaaagtcaattgactgtcagtgttaatcacatctatgaaataacctcccagcaagatattgacaagtatttgaccaaacaacaggacaccatagcttagccaagttgacacataaattaaccatcaggagcaagtagaatatccaaaaaacaacatactaggggtattatatcttatatagctattataattatataaaacatataattatagaatgacgatattaagataaccattagaacaaaaatataaacttttctttctttcttttttttttttttgagaccaagtcttgctctgtcacccaggctggagtgcagtggtgcaatcttggcttactgaaacctttgcctcctgggttcaagtgattctcctgtctcagcctcccaagtatctgggattacaggcacctgctaccatgcccagctaatttttgtatttttagtagagacatggtttcaccatgttgcccaggctggtctccaactcctgacctcaagtgagccacccccctcggcctcccaaagtgctgggattacaggtgtgagccaccacacccagccaaaaatcaccttttttacaaggatcaaaacagtcattatgctggagatgacagacctcactgtcaccatgctccttttgtatgtctactaggcacggtgctgggtccacactcacagaaaccttaggaactcgcacccaggggctccggctgtagcagaatcccaagaataaaacctggtgctgaaagagtaggagatgaggccaggtgccatgactcactcctgtaatgccagcactttgggtggccaaggcgggtgaatcaagagatagagaccatcctggccaacacggtgaaaccccgtctctactaaaaatacagaaattagcggggcgtggtggctggcacctgtagtcccagctactcaggaggctgaggcaggagaatcatttgaaccgaggaagcagaggttgcagtaagctgagatcgcgccactgcactccagcctggtgacagagtgagacaccgtcacaaaaaaaaaaaaaaaaagcaggacactgaactctgggagggcctcctggtgagaggtgagcacagaggggagagatggaggcaggagcatgggcttctggtggccccagcagaccctgtggcagcgtggccagggtcctctgcagggaggaatcttggccaggatgacgctgtagcaggcctcttcctgaggcctccagccagcccggccagggtcccagcgtccagtgacccctgtttcacagcagcagctggggccagccccaggctctcttccactcccagcttcttaaaactggaagtggagagagttgtttgataaaacactggggcaaaccacatcctctcttcaccaagggagagttggaggggatgccggcagagggagctttagagtagagacccctacccaaccagtgaccgtcacgcacacagcagggcatgctatggagacccccagacagtcactcggggagacccagcaggtccagactcttcagagatctgtggcagcaggtccccactcccaaaagccacgtgcccacgggtggtctctggtgcctgagaccccagtctcatttgcatctttgcaacttcgagtttaagtgggtgtcgcatctctgtatgtcctcccgagcagaggaggggcacagcctggggtggcagctggcgtcaaaccctcaaatcccctgagagccactggggagactaagcagtccccagcccctacttgtccctgagctgccattctcagccctgtgggaggagacagaaagccctgaagagaaaccaaaggaccaggtcaggaggggctgggggggggtggcatgagcaatcagggcagggaaggatgcacagatgggggaatggagggaagaaggaatgaatgaaaaggtgaatgaatgaacaaagagagagaacggccactcctcccttgctttagtttacaaagtactgggatcctcccaacagcctgcaagacagaatttctgggaagcagaccaggtggctggcagggaggggaggcttgccctggcttttgtgggcccaatgggaggcagggggcaagaaggggcatcctgtgtgtgtcctccctgcagcggcagcagcaccttcctggaagagggtcaggaaacacccgctgtggcccctctccaccacgccctcatccaggacaccaagtatcagtcactcagctcacgagacccaggccctgactcagggagagaggatgtgaggggtggggcaccgggctcctcaggactgagagacctgagatgtggccccgggctgggtgtaggggcagactggctatggcagcattgtgtgtaccccagcaggccagtacccacgcagggagcctccaaaccccttcacccatgaccctgggagaagaccgcagccttggagaattggcctcactgaaggggcctgcgccggccagcagggtcaggcggggccagacaggttcccacctgggatatgcaaatgggcctcctgaatcctggagccaggtatggactcacacaccaccattgtccccaagtccccatctgccccacgggcacaccctgccgcctgttctgtgcaagggccctgaggctgtctccttgcgctcaagccctgcaggtgctgaagcccacacacacggctcctgcttcctgggccagtgcacgtgcacacacacacacgtgcacacacacacacacccccacaaatatacccacacacaatcacacacattcacacatacccacccccccatactcacactcacacatttacacacacccacacacccacactcacacactcacagtcacacacaccctcacacagcgaaacacaatcacacacattcacacccacccacacccccacacactcacactcacatatactcacacacacccacacacacatacacaaacacaatcacacacattcacacacacccacactcacacatacacacacccaaacacgatcacacacattcacacacacccacaccccacaaacacactcacacatatacccacacacactcacacataatctctcacacacacacatgctcacacacacacgccttctccaggaggggctggctgccaaaggccacccagcttcctcccacgtctcactcaccgtacaatatttgagaagaccttggagtcagcagcaacagcggcgtgggcaaaggccgggggtcaaatggggcctggtgtcgagagaggaccacagccagcacaatgacagccagcgccagccccagccccagccccagcaggaccaggtcacccatggctccgtagtcctgggccatggctctgcggcccagaaggagaggggaggccggtgggcagatggagggacagatgggtgggcagatgaatggacaagaagatgcatagatagactcacaggtaattggacagatggacaaacaggtgggggctgaagacagacacgaagatggatcgacagacaggccagatagctagacaaagaggacagtaagagaaagatggtcagatagacaatgggacagagatgggcttacagatgggcggacagacagacaggtctgaacagcgggctgccagatggacagatgggtgaatggacagatggctggcagctgtggcgagctgctgccctcaccaagtgcacactacggagtggccaaactcatgcctcaacttctagttttcagctcctgcttgttcctggcaggaggccaggcagcaaagcgtctgaggggagttttctttgcctagagaagtcagctgctgtgttaactccctcactgctggtaggtccaaaggccccacctactgcccgccagagcccatggtcacactgtcgcaatgtgcaggagaacttggtgcgtgctgcactgcggttgccaggtaggggcagggctccctggaacctccacaccattccccaggttctcagcagctctgggaaagcagagctggggccgcttaactctgccctggatccggcaaggctgcccacctcccagagtggagccctgctccccagctcccatctctatcccctaaccctctccgcatggcccagcctagtcagcatcaaggtggagctgaacagaggcagaaggaggaggacccaaggtggtgtcactcaggacccgggttcaagtccttatgtttctgcagcctggcctgggtcccccaacccccccagggtgaccaagggcttcccagtctgcacagaggacagggggtcttgacagcatcaaatgctggtgactatgagacacttacatgggaaatgcagacagaccatgcctctagcccttggcaccaggcaccatccatccctgggacttgctgtcctggaaatgcagcatggacctccagggaggggggctgtgccatgtgggggccccaccccacctgcagctctttcccaccctggctgcaggtctgcttctctgaatccaaatccgctactactgtgctggcagcgcagcctctctggggacactggcctggctctgttctccccaggcctcagggtgcctaaatgggaggcaaccaggggagtgaggacccactgaggggctccgttgaccaggctcagcaggggtgcaggtgatgtggggtggaatccttcccacatggcccccacagtcctccccgcttcctccccaactgaacactgcctgctccagatgtgtacacctggagtctgggcccctccatctgggcagcagagaaactgaggcacagagacagactgtgtccttacagggcacacagcctgccaggcccctatgtccggccagagcccctggtcagcctgggctgcagtgattgtttagaggtaggctgttcccacggctgcctctcacggtaggggggcctgcggacgcctcctcccgcccccacccgactcccaagcctcagtgacattgctcaaccaggaactgaagtgcattcctgggctcaggccagcccacccacccacccgctgcagtcctggaagcccagaggcctgggcagcaggaacagtggagacagcagtgtgggggacgtcccccctcctctccccaccatcctcgtcaggcagaggccagggtgcagggaccaccggagcaaaggcccagggaaatgaatgggtgtcattctggtcctgacccgaggcacagccaggaaggtccctgtggggaaaagaaagagatatcagactgttactgtgtctatgtagaaagaagtagacgtaagaggctccattttgttgtgtagtaagaaaaattcttttgccttgagatgccgttaatctgtaaccctagccccaaccctgtgctcacagaaacatgtactgtgtcgactcaaggtttaatggattcagggctgtgcaggatgtgctttgttaaacaaatgcttgaaggcagcatgcttgttaagagtcatcaccactccctaatctcaagtaagcagggacacaaaacactgcagaaggccgcagggacctctgcctaggaaagccaggtatcgtccaaggtttctccccaggtgacagtctgaaatatggcctcgtgggaagggaaagacctgaccgtcccccagcccgacacctgtaaagggtctgtgctgaggaggattagtaaaagaggaaggcctctttgcagttgagataagaggaaggcatctctctcctgatcgtccctgggcaaaggaatgtctcagtgttgattgtatattccatctgctgagataggagaaaactgccttagggctggagatgggacatgctggtggcaatactgctctttaatgcattgagatgtttatgtatatgcacatcaaagcatagcacctttttcttaaccttgtttatgacacagagacatttgttcacgtgttttcctgctgaccctctccccactattaccctattgtcctgccacatccccctctctgagatggtagagataatgatcaataaatactagggaactcagagactggtgccagcgtggggcctccgtatgctgagcgcaggtcccctgggcccacttttctttctctatactttgtctctgtgtctctttcttttctcagtctcttgtcccagctgatgggaaacacccacaggtgtggaggggcaggccaccccttcaggtccctgaatgtccttcctcaggaaatgatgggggaaggggtgatgagaatgaaggagacgatttaagtccctcaccccccgaggtagtcctgggctgagccccatgggacctagagaaccagggtgtaccccaccagcgtgtcgggtccaggaagcctcgtggccagctcccacttctcttcctgctgtgcaacccagagcaaggcctgcccctccagcttcagtcttctcccctgcaaatggggccacggcctttcctctcaggccaatataaggattgaggccgggtgcagtggctacccctgtaatcctagcactttgggagactgagatggggggactgcttgaagtcaggagttaagaccagcctggtcaacatagtgagaccccatctctattggtttaaattttttttaaaaaaattaaataaataaaataaggattgaagagtgacttgtacaccagttgagcccacctccatctcacccttgcagagccccagagacacagccctccagagctcagacccagtgggacttgactccacaggcataaaaccctgtttgtctatgggccctttggaatcaccaggttttcggggctcctgaaggatagccccgacctggcctcacctggcccctggccccagtgcccctggtgatatccaggtgctgggctgtgatcaccgcctcccaccagcccacctccaccagcccttcccagaaccctgctccaggtgttgggctgtgatcaccgcctcccaccagcccacctccaccagcccttcccagaaccctgctccaggtgttggaactgtgcacagaggagggagcaggccccgagggaggcctggaggggctgccaatggtgaaggctgctgtgtcgagctgtttccttccggacccactccctctgggctgcgtccccggctggtccaagccctgatccctgggatctggggacatcttcccgtttgctgttccctgagaaccaggcctccctctggagaggatcacaagcttgggtttcactctgggcttgctcttgggaaccccccaggggcatggctctgaccgagatgttttcctccagcctgttgcccagtccccattcctcggaccctcagcttcacctccagtgtcatcggcagggtgagctggacgcctacgggtctgagaaggcgcccgggttcccagcatcggctggccaccctctgcctaagaaagcgccagggtcgtgacaccccctggtggctgatcctaggtagtgtcactgcccagccccagtaagggagggcctggccccaaagtctgagggatcagggtgggaaggggcagggtttggtgtgaaccttcccctggcccccagccatgtgccttgctctccccatgctgaagatgctgaggctagttccagtgtccgcattgtgaagatctccgaatcccacctctctgttcctccccagccagatggctccatttcacacacaatacactgaggcccagagagtggggagacaggccagggaggccacctggagcctggcacagtggcctcatttattatgctgctctgctgctcacaggggaagcccgtcccccaaagtcctcttcctcatcctggtgagtatcttgtccctggattgcttgtcagccttgtctgcctggagcaatcagtagccagcaggttccccgcctttcctggagtccgaggcagctgcccagccaccagccgtgcggacgatggcttgcaccacagcgatgaaggtggacgcgatctgggtgtgatggtgccgggtctccagggctgcagtcactgcctgggggtgggaggagaggggaagcctgagcagggctccagatgccacctgaaccacacctgtgtggtcacaggcctcagcccaggtggtgccatttcaggccaggtcatcaggaagagcaggttggggcctgctgggtctcactggagcagggggcttggctctcatgtcacaggggctccagatggcccaggcactagagagaggacaccaaccattgtccactctgtgatgatccaggcctccagcccaggatgccctgggaccccacaccgtgactcagtttctccaacccctggcccacctggtcaatgtttctctccactgtcgtgacgttgggcagaagcttgttgtgcagccggggctcctccacggccctcttcacgtcatagccgaaccagaggttgtagatgatggcctggggcatgggagtgtgatcagggtggcttgggggctgtgcagagtgggcagggccagggagaaaaggggtgacacataccagtgcagtgtctgtggtgatctgcgtgcccccagcagctcccaccaccatccggacctggccgtcctggcccaccatgatcgtcaggcacatggacaagagcggctgcttccctgcggccgatgggagaagacagggatgcccgtcagctgcctgcccaggacacccgcccctctccaccccagtcccccaccccccggacctccaccccatacctggctggatgaaattggcaggtgaggggggtgccccaaactcattggtgaatgctgggagagctgaagtcgtccattcattattgaacaggatcccactgaccggggagcagaccttggagccaaagctaccgcccagccaggtcagacagcacccgaccttgcctggcccagcctggtccctatccacccactgaggctcaaacatactcactgagaggcccaggataagctaccaaggttgggcctcagtttcccaccaggaaaagaggtgatggagccaccttactggataagtgggcagtccctgggccacccgcccctggccctttcccacccaggcggcccagcagcccctactagaggttgatggtgctggtggcggacacagcactgccgtcctctgcgacgacagacaggtgagcagtgcccccgtcatccggcgtgtagaactcgggcttgtagtaggagatcgggtgagtggtgtggtcagagatctgggaccggagctgggcagcgaagaactcagaggtcatgttgcggaccacctgctgagaccccagagctggcctgaggaggtggggagggagggtggggagggggcacaggtctcagaaggcccttgactgtgactctgaccgcaaccctctggcacccacaaccttccgtggctccccaggacccaagggcaggcccaagaccttgcatgaccagtctgactccctgtctctgtcgcgttccagcaactctgaatgtctgtctgcctggtcctcagcctccagacccttgccgcattcaatcactcattccttcatgcaaaaaatatttctagaatttgcactgcatgcctggcactggggaatcaacagggaacagacacttaagtcctgccctcatgccaagaaaaacaaacacacccagggaaagtgctgaaaccacaggccaggtaaggggaatcaagaggcatgaggtatgggcagagtggtcagggagggcttctcagaggaggcaacgtgtgaaaagagcctggaatgtggcctaaatggtcagtgcaaaggccctgaggcaggtggtataggctggtgagcgataggcagagagtgaatggagtagggtggggagaagaggatgaagatgcaggctggggcccatcccacaggacctcctaggtcccataacaactggctttttctctgtgccatgcaggcttagggcagaggaatgaggaggctggggagtgttttcacagggtccctctggcagctatgacggggataaggataaagcccaaaggggaggctgtgggtatcaaccaggcaagagatgatggcctgggtgggagaaagagaagaatcaaggatggtgccgactagcgaggccggcagaaggggccggtttggggatggtcaggagcttgattttggatacttcatcagacccaaagagcatgggtgcacgtataaaaaaaataaataaataagcatgggttcacgggcaagggcgggctgagagatgaacatggaggtattgacattgagtggctgctggatgccatgagcctggccaaggtccccaaggcagtggcgaggaggagatgaggaggtcaaagaggagacagagaggatggacccgaaggccgaagaaaatgcctcaagagagtttcaacaccgggcgcggtggctcacgcctgtaatcccagcactttgggaggccgaggcctgtaatcccagcactttgggagggcggatcatgacgtcaggagatcgagaccatcctggctaacacagtgaaaccccgtctctactaaaaatacaaaaaattagctgggcgcggtggtgggcacctgtagtcccagctacttggggggctgaggcaggagaatggcgtgaacctgggaggcggagcttgcagtgagcggagatcctgccactgcactccagcctgggggacagcctgggggacagagcgagactccgtctcaaaaataaaataaaataaaataaaataaagtttcagcaacaccccacggattagttgaccaatcccagggaaaggtgttctgtctgaatctgccctcaaggaaacagaaaggcaaatccacgatgtgggacattttccaagactactgccctgggctttaaaaatcaacaaaacaggccaggcacggtggttcatgcctgtaatcccagcactttgggaggccgaggcaggcggatcacgaggtcaggagatcgcgatcacggtgaaaccccgtctctactaaaaatacaaaaaattagctgggcgcagtgtcgggcgcctgtagtcccagctactcgggaggctgaggcaggagaatggcgtgaacccaggaggcggagcttgcagtgagccgagatagcgccactgcactccagcctgggcaacagagcgagactccgtctcaaagaaaaaacacacctgtaatcccagcgctttgggaggctgaggtgggaagacagtttgatcccaggagtttgagaccagtctgggcaagaccctgtctctaaaaaaaatacaaaaattatccaggtttggtggcacgtgcctctggtcccagctgctcagggggctgaagtgggaggattgcttgagccctggaggttgaggctgcagtgagccaagatcacaccactgcactccaacctggatgacagagactctgtgtacaaacaaaaacacaacaaaaacaaaacagccaagggagcctactgtaggtaaagagaagggacagcaggttgtgtcaccccgacatcctgctgtgctatgttcaagtctcacttttgagacacaccctgaggtgcgacatcagtaacctactgtggaatccctcagaaaaacacgaatcccaatagatgtgggtggagacggagagagttaggaaatccggcagaaatgtccacactgcagaatccaggaaaagggaacattgatgcttgggcagttttgggttttttttacatttttgtaggtgcgaaaatttgcaaaatgaaaactcgaggagagtgtggtgagctgtgtgagatgctgctgagtggggcctgatggggaaactgaggctggacatggcgatctggtggcatggggatagagcaggggaggggataccctgaagggagagaggacatagcccagccatgtttgctctaagaggagcaaaggacagaaggaggcagcagatagaagtttctagagcaacaacagctgcctttctttcgggaataatccgtgataaagaaataaatcatcagaggcagacaggagcattgtaggaacagcaccccgagccagtgagtagatgaaggagctggccttagccaaaaaggagggcagagggacacgctgcagtggctctgtcccctcagagagacaagacaccaggtcactggctgcagcgggagtcagaggtgcagaatgctcacagggaaagagaagacaccacccgggcagctgacgcccctcctgggaggtcactggtcagtgtgggggggtctgcagatccgcccaggaatgccaaggacccaagtaggtaaggagggatgtgaggatcctcagtgggaagggatatgacagggtcttatagggacccagcatggagctggggcaactactgggtgagtgggtcaggtggtgcagggctgagggtggcatctgggaagcattagtttggagtgacagggagtgggtggccgaggtctctgttcacctggccctctccctttcacccatccatctcaccatgcccgagggctgcaatgcccccatgcattcctcatctcagcactgagcactcaagaaccacagcatgtgcaaaggacctgaggtaggagggtggccactaattccccgcactgtcagttctgtggggcagaagccaagactgggggtcacccacgagtccatccgagcacacagtaggcccgcaatcgaattctgtggcaggaatggattcataaagcatatgtgaggctgtagccaccctggggagcccacctgatgcctctacggcaggccccacacccacagtgagccagcccctgccccttacctcagtcacatccacaaacttggggtccccaagcagggtcctcttggcgtaggcaaaccggaaagcctctacgatgcggtggtacgtcaggcccttctgctcgggggtctccacgctctcccgggagaagttgtaccctggttgatcagagccaggtgcatgttgctgagccccagaggctctgaggggctcagagggttaacacctgcctgagccactttgcccacctcaaggagcgtttaataaccaatagcagcagctgcttcagaaggctgtggtgagagtgaagtaaggtgagggctcccgagcctggacctcacgtcacgcatcagctctggccattcaatgaccaagtggcagggtcacccactggaccggggtaccctctggaccggccctgcagccctgagctcctgcacctctctccctcctgatgactcctgttcctcctccaacccttgagcattgcccgcttcagccctgttgctctgcactgcctccttcaggacatggtgagctgtgacgcagggacacacctcaggagctcagtgatggaaagacgtggcatggggggcgagcagagatgcaggaggggtggggcgtggggagagagaggcagtgtcatgggtcctaccacacggctgtggtgcgaccactcacctttgaggatgttgaggatgagggccagcacgggcccgctgagccgcgcactgggcatgtacagcaccgcgtctcccaggctgatgttcagcgggtgctcgatcagctcagcacggtagttgttcaggtcctcagctgtcacaatgccccctgcaatgggacagcagctcgaatgggtgctgggatggggctgcaccactgcgtggaggatggaactgcaccagtggtgttgggggcaggcatggctgcaccatggtggtggggaaaagcctgtacctaccagggaggacagagtgcactactggaggggtgggactgtgccctgggagggggccacaggcaacctcacctccttgggaacctcaccagctccggcactcctgtctccctgacactgctcaccacccgacagctgggctggggccacctgccctctgcctgcttggcttactggcttcctgtctgccttctctcatctgtggccagagagtgttttcttttttcttttttttttttagagatacgatcttgctctgttacccaggctggagtgcagtggcttaatcacagccttgaacccctgggctcaagtgatcctccagcagaccctccccagtagctgagactaaaggcacaactacacccagcaaattttaatttttttgttgtgttttgctatatttctttctttctttttttttttttttttgtgagacggagtctcgctctatcgcccaggctggagtgcagtggcgcgatatcggctcactgcaagctccgcctcccaggttcacgccattctcctgcctcagcctcccaagtagctgggactgcaggcacccgccaccacatgtggctaatttttctgtatttttagtagagacaggtttcactgtgttagccaggatggtctcgatctcctgaccccgtgatccacacgcctcggcctctcaaagtgctgagattacaggcgtgaggcaccatgcccggccgggttttgctatatttcttttcactatgctttgaattttttgttttcttgttccccacccccacccccactatatttatgtagattctcaatattttttttgtagactcactatgttgcccaggcttgtcttggaccccctgacctcaacttctacctcagcctcccaaagtgttgggattacaggcatgagacaccaagcttggcctcagagggccttttctctctttttttttttgagatggagtctcactctgtggagtgcagtggtgcaatctcggctcactgcaacctcagccccacaggttctagcgattctcctgccacagcctcccaagtagctgggattacaggcacaacccaccatgcctgactaattttgcatttttagtagagacagggtttcaccatgttggccaggctggtcttgaactcctgacctcaggtgatccacccgcctcggcctcccaaagtgctgggattacagacgtgagccaccgcacctggctcagagggccttttctaactggagaattcctgccggtgtccctgctgcttggcctcttctcctcacgatgaatggatagagggagggagggaggctcttaattctcctggagtcagctccagacagggtattggcatgccaatttccagcctcagtggtaaaggtcgacacgctaatcaccctcctccatgaaacagtgacaaaaattacctgaagaaagccacagccaagctccaggcccctgccccacaaatccccttccccatgcctctctcaaggcgaccctcatcccttgtaaccctcttggtgaatcaaagcgccctctactgggccttagcccagctgttcctctgctaggaatcccttcctctctctgcctaacgaagttatctgcagcccagccgccacctcctccaagaagtcctcctggatcttcaggctgtattctagtgcttccctagccctggctcttgcctacacctgcatttaccccaacagggacttgctctcctggactgtgtggcctctcttggttttgatataagcaggagctgtggacccacatggccagtcactgaccctcctccaccaggaacttcctgcaggctcaggcaagacaggaggaccccatggctctgggctacagctcagggtttccactgcagagttcctcacccaggtccttgaggttacccactcaccagccgcctggatgtccttcacaatctgggccatgaggctgccgttgtagaaggcctgggcaccctcgatggccagcatctcataggtgtcagccagccgcggcagggtcagtctctccccctcccgaagcacctttctatcccggcagaacacctcaccggggcagagggggctcatgtgaggcagcaggtggggtggactcagctagaccaccccccacacctgcccacacaggagaccagcacaaagcaggggcagcacctgtcacaggtgggtggccctgtcactcagcgctcatcctcctagtgtcccttccgggagcctcctagtgtcccttgccactcaggacacgtggccagccacagtggccactgggaccccatgctcagaatgtgtccccacacgtggtgggaagggtctgtatctcctcatcccattatcagcacagggtcctgaaggcagagggccgctccactgctgctacggcctgcaaggtccttgggctgtgcctgccctgcctgtgtcagggggccgcacccacagacataccacaagacaggctgctgctcgatgacagtccgcttgttttccaggactgccgccaagcccttgcccacagggaagccctggcgggccagctggatgctgggctggaagaggcgagcccagggcagccgcccatgccgctggtgtgccagctcatagcctcggatctccccaggcaccgccaccgacagccctcctggggagagagagccacagttagtgaccctgagtgggggacatcgggatctctagcaggcagcatcccaggcacagtccctgactcattttacagatggggcaatgaggcttaggaggaaagatttttttttcttttttgagttggggtcttgccatcttgcccagcctgatctcgaactcctggattcaagcaatcctcccacctcagcctcctgagtcgctgagattacaggcgtgaacagcacacctagcagaaggggatttttaatttttaaatttattttttaattttaattttttttttttaggaggggatgtttaatttttttttttaggaggggctcagcaggtaggagtgtacatggaccagggatgtctgaggagggcacagcaggggaagcagtagcatgcggctgggttttgctgtcccaggatgaggtgtctgtctgtacaggtgcctgcatgtctaaaatcctgtgccaggccagaccccctcccatctcgctgaccacaaggccttatcctgtaagactcatgggctccaccagaatgtgccaaaacaagagcagatcccaccctgacccaggtcaagcacaggccaccttcaagacacagccagccccaagaaagggctcccttcctcttttctactgccccagagaggcaagactgagccttaacctccatcctgtcccctctcccagcctcagtttctccaaccaactataagggtttttgtttgtttgtctgttttgagacagggtctcactctgttgtcccagctggagtgcagtggtgcaatcatggctcactgcagccttggcttcccaggctcaagcgatcctcccacttcagcctctgaagtacctaagactacagacataccccactgcacgtggctttttttttttttttttttttgagatggagtttcactcttgttgcccaggctggagtgcaatggcacaatcttggctcactccaacctccacctcccgagttcaagtaattctcctgcctcagcctcccaagtacctgggattacaggcatgtaccaccacgccttgctaatttttgtatttttagtagagacggggtttcaccaggttggtcaggctggtcttgaactcctaacatcaggtgatccatcctcctcagcttctcagagttctgggattacaggcgtgagccaccactcccagcctaattttttatttttattttttgtagagacaggggtcttgctacattgccaagactggtctcaaactctggcctcaagcaatcctcccacctcagcctcccaacatgctgggattacaggtgcactcagcctataaggggttttgccttccagttctgacttttgaggaggtcattggaaacagacccctgggcctgcttcccccctgagccccactgcccatatggacactacagacactgaccctttgcccagaaaggtacaactatggcctctgcccccagggactctcctgctcttgcgagagatgatggggccatttgccttggcttggcggctgtggctctagaactgcctctcccaccctgaagcctggcacaagtttccaagagctggtggtttcaattcctagaagctgcacatatatcccggaaggtctgacacccagcatatgattccttccaccttgtagttagacagaagttcttttttgttttgttttgtttttctttgtttgtttttgagatggagtcttgctctgtctcccagactgcagtgcagtggcatgatctcagctcactataacctccgcctcccaggttcaagcgattctcctgcctcagcctcccgagtagctgggattacaggcacaggccagcacgccaggctaatttttgtatttttagtacagatggggttttgccatgttggccaggctgttttcaaactcctgacctcaggtcatccacccacctcagccttccaaggtgctgggatgacaggcgtgagccaccgtgcccagccaagacaggagaagttctaatctttgatagcagaccagggtgacgatgcttagcaacagtattttgtatatttcaaagtaacgaagagaggactatggtgctaacacccggaaatgaaaaatattcaaggtgacggagactccaaataccctgccttgatcattatacactctatgcatggaacaagcactcacatgtacccataaatatagaaaatatcatgtatcaatatcagaaaaaaatctcctcctgacctcagcccaatcaggctctcatgccaccacacttgccaagttctctggtgacccccacactgccagacccagtgccccctctcagctttactgggctcatcactctccctgagagccgcccctgcatcccagcacctggctccacccgagtctcccccgcctgccatcctagctcctactctcccctctgtctttgctctctctcctggtggtctgcttgacatctgagcttcagcctccatttatgcactgacaactctcaaattgacctgctggcctggactgctcctccgatcaccagacctgaggatctacctgcctgctcgaagaaagcatctcaaacttcaacgtgcccaaaaccgagctcctgagtgtctgctcaacctgcttcctgagaaccctgcctgtctccattagggtcaccccatccttccaggtacagacaaaagatcaggggtccccggggactccctacacaagcgtcacacccaacccatcctcaaatccacaggctccacttccaagtgtgtctgtgcagcgtcagccacttcccagcaccctctccacgaattactgcagtgacctccggacaggtccccacatgctccctgccccttacacagcaatccaaggggtccatagaccagatccatccccttccagtcacacactccacgagcccccacttccctcagacaggaagcagaggcttcaccataacctaagagatcccgcacaacctgggccattccccttggatcacttgctgcagcctccccagctccccacagggctctgtccctgccatcacacctggatagcagaccaggagataactcccctgaccccatctctgcctctgggtctttgctcagatgtccccttccctgactaggtcaccctccatagagtcccagattttgaggccctccaggtctgtttttctacagcccgtaacacacccgcacttgcctagtttctcctcccacctggagtgtcacagatttcatctgccgtctttgtttttcaccccagcttcaggaacaacagctgattctttaagacaatgctcaatacattctagtcaaataaatggttttaagcgtccacaaggtgccaagcctatggttcccgcattctcttaccctcagcaacttcatgtctacagatgctgagtttctcaatgagtattaaaaacaaatgaaagattggtcgggcacagtggctcacgcctgtaattccagcactttgggaggctgaggcagggggatcacgaggtcaggagatcgagggaccagcctgggcaacatagtgaaaacccgtctctactaaaaaatacaaaaaattagccgggcgcggtggcgggcgcctgtagtcccagctactcgggaggctgaggcaggagaatggcgcgaactcaggaggcagagcttgcagtgagccgagatcgcaccactgcactccaacctgggcgacagagtgagactctgtctcaaaaaaaaaaaaagaaaaaaaaaatcaaagattgagtatgttgcagaagactccaaagggcaccacccaggacccccacctgaagtctaagacctgctatggtgagtgtgtcctgcccctccatcctccaactttttttttttttttttttttttgagacggagcttcgttcttgttgcccaggctggagtgcagtggcatgatctcggctcactgcaatctctacctcgtgggttcaagcgattctcctgccttagcctcctgagtagctgggatattacaggcctgtgccaccacgcccgactaattattgtacttttagtagagaaagggtttcactatgttggccaggctggtcttggactcctgacctaggtgatccatctgcctcagcctcccaaagtgctgggattacaggcgtgagcctgtgaaaaaaaggcccagccttttttttttttttttttgacagggtctcactttgttgcccaagctagagtgtagtggtataatcatggctgactgcagcctcaacctcctgggctcaagtgatcctcccaccttagcctcccgagtaactgggaccataagcacacaccgccatacctgctaatttttttttccattttttgtagagatggagtcttgctatgttgtccaggcaggtctcctgggctcatgcgctcctcctgacttggcctcctaaagtgctaggattagaggcgtgagttgttgagaccctcccatcctccaacttttatctcacaatctattgtgcctcctttggggacagacagtggcttcctggatggacagtggcttcccctcaggtacctggggaatttgggggcctcctccccacttaagaccagattagaaaagagagactccacctcacattctagagcgccatccccacaaatgaacaaatgagtgaatgggatgcctgttgaaaaggcaggatatagacagcctgggttcaattttagcttcaccacctcccagctgtgtgacctcagctgatttgcatgacctgtctgagcctcagcatccccaccctgtaaaatgggaatccacacagcatcccctagcccaaaggagcagggagggttgtgagaggctcgtgggtgaaaagcacagagcagagcatgggccccagtgagccctgatccatgaggtctgctagcataataattattctttccatgtgctgcacagagtggccccggaggccttagcagaaataacagaagctcccggccctttaccgtggtgatgatggtcctgaccactcattgtgggagggtgctatggggccaggaagggatggggggtgacagaactgcccctgaaccctgacgggagcaggcttctgtgggcaaggccccttcccggtggctcagccagctctgcacccatgccccaagtctgcagcatggcttacccttctgggactgctccgagctgttgaacatgctggcaaaggccagcctgggggccacctcgcgggcattgatgacctcagcttttcctagaagaagcaggtaggcaggcccacccaccaaaaccctttatgccacgtgagcctgggggccacccagctgtgcctcggcccaacccacaccccctgcccctctccctctcctcttctgaggcactcatgagtggtgctgttgtagatggtgaggaagaggccaaccccgatgcccatgctgtgggcattcatgagccccacacacaacagggctgcaatggctgcatccactgcagagccaccgtcccgcagtgtgtccctgccatgtggcacataaaggcatgagaacctgcaggcttccaccctggccccgcatacacaccctgctgcccacctgcccaaaggaggatggaagagaagtccattcgagttttggggtttttgtttttagtttctttctcttttttttgagatggagtcttgctctattgccaggctggagtgcagtggcacgatctcagctcactgcaacctctgcctcccgggttcaagccattctcctgcctcagcctcctgagtagctgggactacaggtgcatgccaccacgcccagctaatttttgtatttttagtagagatggggtttcaccatgttggccaggatggtctctatctcttgacttcatgatccgcctgccttggcctctttttttttttttttttttttttggagacaaagtctctctttgttgctcaggctggagtgcagtggtgtgatcttggatcactgcagcctcagtctcctgggctcaattgaccctcccatctcagcctcccaagtagctgggactatgggcacatgccaccatgcccagccaattttgtttgtttgtgtattttgtagagatggggtttcatcatgttgcccaggctggtcaagaactcctgtgctcaagtaatccacccaccttggcctcccaaagtgctggtattacaggcatgagccactgtgcccagcctttgttttatgagacagggtctcactttgtcacccaggatgaagtgcagtggcacagtcttggctcaatgcagctttgacctcctgggctcaagcaatcctcccacttcagtctcctgagtagctgggactacaggtaagaaccaccacaccgggcaattttttgtcttttttgtagagatagggtctttctatgttgcccaggctggtctcaaactcatggtctaaagcaatcctatcgcctcaacctcccaaagtgctgggattacagtttcttctttttcttttcttttttctttttttttttttctgagacagagtttcactcagttgcccaggctggagtgcagtggcatgatcttagctcactgcaacctctgcctcctgggttcaagcgattctcctgcctcagcctcctgagtagctgggattacaggcgcacaccaccatgcccggctaactttttatatttttagtagggacagagtgcaccatgttggccaggctgatctcgaactcctgacctcagtggtctgcccgcctcaaccccccaaagtgctgggattacaggtgtggaccaccttgcccagacagtttcctctttattaagcaaacaaatgtacatgacttttataattgggacaaaaagggaaattgctatactttattaataacattttttttttccctgctagagatggtggcttacacctgtaatctcagcactttgggaggccaaggtggaggatcacttgaggccaggagttcaagaccagcctgggcaatagagtgagaccatctctacaaaacagtcttttttaattagtcaggtatgatgcacgcctgtagtcctagctactcagggggctgaggtgagaggatcgcttaagcccaagagttcaaggctgcagtgagctatgatcatgccactgcactccagcctgggtgacagaacaagaccctgtctcaaaatatgaaaaacataatattttttctgtttaagtctttaggagggaacttatctttatatataacatgagataagagtctaaaatagaataacacagtagaagccaggcaccatggctcacacctgtaatcccagcactttaggaagctgaggcgggaggatcacttaaacccaagagtttgaggctgcagtgggctatgatcgctcccctatactccagcctgggtgacagagtaagactccaccttaaaaaaagaataagcccttcatgtccctgtttgggcaacagcgttccttggggggaggggggaggggggagggatggcattgggagatatacctaatgctaaatgacgagttggtgggtgcagcacaccaacatggcacatgtgtacatatgtaacaaacctgcacattgtgcacatgtaccctaaaacttaaagtataataataaaataaaataaaaaaaagaaagaaagaaattgtctcctaaccaaaaaaaaaaaaaaaaaaaagaaaagaaaagaaaagaataagccgggcgtggtggctcatacctgtaatcccaacactttgggaggcccaggtgggtggattacctgaggtcaggagttcgagaccagcctgaccaacatggtgaaaccccatctctactaaaaacaccataattaggccaggcgcagtggctcacacctgtaatcccagcactttgagaggcagaggtgggaggatcacaaggtcaggagttcaagaccagcctggccaacatagcaaaaccctgtctctactaaaaatacaaaaattagctgggcatggtggcacatgcctgtagtctcagctactgtggaggctgaggcaggagaatcacttgaacctgggaggtggaggctgcagtaagccaagattgcaccactgccctccagcctgggtaacagagcgatactctgtctcagaaaacacacacacacacacacacacacacacacacacacacatatacacacacacaaatttgttgggcgtggtggcgcactcctataatcccagctacttgggaggcttaggcatgagaatcgcttgaacttgggaggcggaggttgcagttaactgagattgcaccactgcactccagcctggcaacagagcaaaactccatctctaaatagatatagatagatagatagatagatagatagatagatagatagatagatgatagatagatagatagatagataggaagaaataagtaaaaataacaaccaaacaacaaaacagtggagtttatccaaagaaacagagactcttagaactgagaaaaggggccctgtttggctctagagacccacaccctgctctcggagtcaccgtccccttcccaaaggctactgagagagtccaagcgaagcttgcatgtggggaaactgagtctcagaggggtgaaggtattgctcaggtccacttgcccagttttcagggcccatgtcccatgccctgccccgctcacctcccaatctccaagcactgcttggcatccgcggccatggcagccctggtgtacacatggttgtcaggttccttggaggccgagggcagccagagacagaggccgacaatgaccagcaccaggaccacggccagcaggcccagcaccactaacttcttcttcatggctctgctgcacccacggggtaaggagcagggtcaggcccagcctcagacatgccctggcccctccccaacagggcacagtctaaagtcgggcctcagaaacacaaggccggagtctccttcccgcttcccagaatacgtgcaggctgtccggcccccagacctttgcgcaggccatgccctctgccagaagctctgggcctcatctctgccctcccaaatcctccctgcttatcttcagagcccatcctggtaagaaccccatctccagcagcggcccttcctgggagcccccagatttccacacccctctttctgcagggcctggcctacctcctcacagtggctgagcctccactgcttagggagaagctccagcagggatgggcctggcctggtttctcctgcgtcccccaccccagcctagagcctggcactgtccaggagtcctctgaagaccctccaccccacctggagcatggggtttagcttccatagtgcccacaatcagagcgccccacagattcactgccacggggccaggacttaccgtccagcagcagacgggggccccaagccttgcctggggtgttggccacgaaagacaggaggatttggtggaaacagctgaggaaataaccggggtctccctcacactctgctgaagcctgtagccacagaatcttcttcagagactctctgatcaggcagccttctcgttctcctgaaggtcaagggaggttacctgaagcacgcacagcccagacctttctgggggactccgtgttacctccctctgcctctagctggtttctctgtctccagttgaactctggaggcaaagaggctgtcagtaacacatttgtttccatgaattctctcagcatgtctcccaggcacagggttttgcacggagcagggcaggtaggggacagggcattcctgcacaagcccaggatgtgcatgcggtaagcatggcaaagggggctcaggaggcaccgccagcctgccctgctctgacgctggacttgccactcacctgctgtggggcctcaggcaaatcactgaactgtccagcctggatgacggcagcacctcacttgccttgctgctgggagtgttgtgaatagagtaggttagactgtgggcagggcttggtgaatggtagctgtgattatcatcatggctgcactggggacacccccaggaggcctgagtggcacaggtctcttgctcactgtatgtcccctgtggactcccttccaggctgtgcagtgagtggcagcagtgacccttgggaagtctcatggctacggcagcaggtgacaggtgtgacaacagggaagagggatgtggtgacagaggttggggttcccctctcccacagtcagtttcccacaaagggcggtgtctgccagcaagcccctccaatgagccccaagcttggtttccctccactccacgctgtcccagtgcagagcatctgacctcagaggcagacacactgtcccagaggtggtctacgaatggagtccccgtgccctccccacacacagggaacatccaaatgccatcgtggaagggtggccacctccccaggcttggtgggcctggggccgatagtgtgatacatttgaccccctcccagccctggatgcagacaccaagagcagagagacctggcagtagccatgcagcagcgcaccaccccacatccccagcacaatccaaagcagcccctcatccccaccgtgaccaccacagcctgaatccaggcgccacctgtttctgacctgaactccctcacagcccctgcctgcactccctccctccaacatcacctgcccttcagtcttccagaaagcagctagagggctctgtctgtccaactgcagaacaggccctgcctcctccctgccctgttggacagctcacacccttcaccaggcctgacagcgctcttgccactccaacaccccgggtcccagccgggagtccgggtcagggttaagggttcctggtagagacaccgattcctggaggtccaaagagcctcaggagctgggccagcaatatgcagcatctattatggacacagaacattcccatcacatggccgggtgcagtggctcacgcctttaatcccagcactttgggaggcagaggcaggtggatcacctgaggtgaagagttcgagaccagtctggccaacatggtgaaacccccatctccactaaaaatacaaaaaattagccaggcatggtggcaggtgcctgtaatcccagctactcaggagctgaggcaggagaattgcttgaacccgggaggtggaggttgcagtgaggcaagattgcaccactgcactccagcctgggccacaagagtgaaactccgtcacacacacacacacacacacacacaaaaaaaaaaaaaaagaaaaaaaaggtctcctgctggaacacagactagttagagaaaggaaaaataaacaaatgatagtatgtgtattaataaaagaactagcaacacccactgcttagttgtgataataaaaactggacattaatataggcagaaaaacagaacagccttgatatggttaaccctttgacactggcaaacactgtgaccagtgctgcccacactggaagctcctgcatccctcttcctcatgtttccttcagcattaaggagcaacaagggagacagccagttcatagttccttacgcatggagccaaaggaccttcaatgtacaaggtctgagcaaggacccgcagccacatgtgcttcctgcttcagcagtgccccgtgggtctcagagctacccaaaggcctatccttccgagaggtttctcctctctcccaactgatgtcatacgtctcatcttccttgtcattcagatcatcaaccacaaacgtccttgccttatattttcatatcccttttcaccagttacagggttagttaacttacgaaattcttaacatctgcattagatctttttaaagtttcaccctcaaccacctattatttagaagtgaacacagaaatttagtttccttgtgctatctgttgacccctaaaatatgctgggagttttgggattttttttaaagtcaaatgcatggcataaagcaaaattacactactaaagaactgagtcaggccagacgctggcaacgtgaagacagcttctccttacccactaggttcatctttgcactgttaactcccaaagtattgcttctcggtgctgggtgtgtggcattcatattccccggcatcccgggcctgaagatctgtgatgtgcaatagggttgggttcccctggactctttctatgaagatcttccctccgcggacgcgctgggtgtagatggcataggggaaggaagagtccatggtgctgacgatctgcacctctcgctctggcgacgaaggcaggtaaatggaccactggaaattctgttcagaaggtccctggtagccactcacattgcaccagatagtgatgtgggagccctccgtgcggtacaagggtccttcctgaacggtgacctgccgctgtgctgacaccacacctacgagggagagaaacacacgcaacatgctcacttacttctcagaccaaaatgcaaagtaggcagcaatctccaaagggtttgttatttgtgtgacatgataataatataaacagcttactggccctttcaaaggcactctgtgatttataaatattaattaaaacactctgtggtaaagcactgtccctaatttgcatatatgggaatttgatcatgccaagatgtgcttttgttacttattcaacagctgacccttgggaatttcatttagcccctctgtttgtcatgtatacggcagttttatatctatttattaatgctgtgtataaagtttttaataaaataagcaggaaaagttgaatccttggcacaaattcagatgaaaacaaataaaagcaaccatctaggaatctggctgaaattaaatgcttcttccttggtccgagtgctggtgggagggagtcctgggagcacctttttactggtgctgcacccttcattttcccatgtagctgctccccaacaccaccccaaggagcattccttagtttctcttccctccataaatggaggcagagctgagctcctgcaggctgctatcgttttaagctgagcacacccaaatacaaatgtgaagggctgaaacagatccctgatgcccagattcccacaaactgacaaaggggggaactaacagtgcccagctaaacctgtgacaaggacagtcaggctacccttgagtttcccactcaagactcccccgctgacctcctgccttctggctcagatactgttctccaaggtcacttctgcctgccttctccatgttcttcttaaagtggcatggtgagtttaatttctcatttcgtgccaactcaacattgattgtgcctgagccactcagaaggtgggagggggcacacccctgcctcttcatttcggcagtggtcacgtactgcaggttgtgaaaagcgcaggtgagttataggcgcagctttgccaccaattagagctggttgtgtcatctcagacaacttgcttttcttctccagaccttgatcttctcatctatcacatgatttctaagaacgctttagagagcactagcatgggttccgatgctggctttgtcacttattaactgtgatcttggataagctgcttaacctctctaagcctcagttttctcatcggtaagatggggataataatgcctgtctcatagggttattgagaagatttagtaacatctgtaaagaccctagcacagagcctagcccacaatcagtcctcaataaagagctgctggctaagacatatttctgctggaacattctgtggctctggatccatagaggacaggatttggccaatgactgcttaaggacatttcaacggccccttgacaatgacaccatcactgggctgcccacctcatcccacagctgcagcccattcttgtgatagcttcccttttcccccacaaatgggaatggcggctgccctggctatgcctatctgaagtggatccagctggtgaacagccgggacagctcaaatactagtggagtgcagctctctgcccagcccagcaggtgactgtgcctcagtgtaagctaatctaatctgcaagatgacagacctcaaaacggcccatacaatgaaatgcccatggcttgcaaaactttaattcatgcagaacctttcctcacaaacaaaatcttacacagcaccccatcttggcttcagcagaaccaggaaaaataaaaaattggcaggggaaggaaataaacagaacaagtggtatctgaatttatttgatatattctggttgatggcattaattatgacatttaaagtcaccatgaggacaactcattagtaatatcagtatgttaaaatatggtgcataacatttttaatatatgtacagtcatgcactgaataacatttcagtcaatgaggaaacacatgtgcaacagtgatcctgtaagattataatggagcatatatagagatctaatatatggcacttaatgttggcatggcagatcaagtaggggaaatgactgatatttagtaacagtgctgggacatttgattttccataataaaatatataaatgaaaatatatatcccatctaggtttgttgaaatacaccctatgatgttcacacaagaatgaaattgcctaatgatgcatttcttaaaacatgtccccatcattaagtgacccatgactgtatacacacacacatatggtgacacttaaatcaaatgattgcagtattcctgaaacacagaacattttgcaaacaatttacctacattcataacattaggcatccttagaattgcagtgttctatgacagagcaactacaaccaacccccatccatctcctgcaaagaaggctggaggcaggtcagggtacaccagcatcttcaagaactgcttctcaatcctggacctacactggaatcacctggggagctttaaaaaaaataacagtgcctggaccccacctgacataactggtcttaggattaattagggttttttttgaagctccacagatgattcaaatcaggtgtagcaaagcactgttactttaaagtgtctctacctacatggtgccagccaagtgctcaaatgaaatatcttaaggctctcactggctttaagtttctctctttggtagagacccaatcactggttcaaggaagtttcattctcctccagtcttccccagtgcaaaagaaaacagctgagacccatcagatactggcttttgtgatgcaataatgagtttaaccagaatgcatccgatttacagaccttacaaaggcactaggccagcggatcatgcacgtcctccccacccaaaggtaaacagtgttaagtggcctgaatgagccaggacagcagggtcaaatcaacttgtctaggctggaagcaggttataaacaatccggacaaataaataactactggattgcactttaaccacacacattcagctgcacctgtttattaaatacctccttaatttccctctgccccacaaagggcttctgacccctgaaaataatgcttctcaacataaaaagaattgttttcttcttggcagtttaattccccttccacacatcccaccccaccatttccctataatggtaataccccgctgtgcagacctctgctgcctccagagagacacaggcgcccaaccctgaccagggcatcctctgacccacagcccctctatctcccctctcagcctacaatagaaagttcctcccaggcaaggatcattttttttaaataacttttttaactttagacattctgtactctttggattactctgcaataagcaaatatgacttctgtaacataaaaagaaagatcaaaatgttatatataactgcatgaaaagaactagaaagaaaatactaggtgacaggatggcaagtgatttttatttttttcttaatattttactccttcccccagtcctctgcaatgagtatgtaccagttttataactagaaaaaaattttagccaaaaagaaaaataatgcatgtttgctatataaaattcactactgtagtatatatatatacatacatacatatttggtctttgtccccagttcctggcactgagctcctaaaccccttggaacttcctaagcaatgggagtaccttttgttatttataagaagccccttttggccatcccagagtttatgctaacgaggtgactgaaggtgagcacggaggcagtttcaaggaaggagctggccacgcttagaattgtggagttttcagccccgcccttagacctccaaggacaagagggggaccgcagattgatccaatcagcattggtcagtgatttgatcagtcatacccacgtaatgaaatcccatatgaaaaccctaaataatggagttaggagagcttctgggtgctggaagcggcgtgcaccaggagagggcatgggcagtgagcactactcccctctcagaccttgccctatgcactaaataggactgacctatgtgaccaataggaaatgcacaaatggtggaatgtgacttccagggctaggtcataaaaagacaagcacgatgttatgaggacatcaaagcagccatatggggaggaccccatgaggcctcctgccagcagctagcactaacttggctagcatgtgactggaagtagattctccagcctcagtcaactcagtcaagccttcagataatgtcaaccccaggcatctttttgttgttgttgagacagggtctcactctgtcacccaggctggagtgcagtggtgcaatcatagctcactgcagccttgacctctgaggctcaagtgaccctcccacatcagcctcctgagtatctgggaccaccagcacacaccaccatgcctggctaacttttttatttcttatagagatgggatgatatggttggggtctgtgtacccacctaaatctcacgttcaattataatccccaatgttagaggtggggcctggtgggaggtgactggatcacaggaatggatctttcatgaatgatttagcatcacccttttggtgctgtgcttgttagagttctcccagtatctaattgtttaaaagtgtgtggcacctcccccctctctctcttgctcctgctttggccatgtaaggcgtgcctgcttccccttcaccttccaccatgattgaaagtttcctgtgcttgccccagaagctgagcagatgccagcattatgctccctgaacagcctgtggaactgcgagacaattaaacctcttttctttataaattctccagtctcatgtatttatagcaatgtgagaactgactaatacatagggtctcactgtgtttcccaggctggtctcaaactcctgggctcaagtaatcctcctggctttgcttcccagagtgtagagattacaggcatgagccactgaacctgcccctttccccccaacaacatcttgattgcaacctcctaagagactccgagtcagaagtatccagttaagatgttactgactttctgaactacagaaactgtgagataataaacatctattgttcctttaagccttaagtttggggctttttttttttacaccaatatataactaatgtagacacctgcagtccctaagattgaatgcaaaattgtgttacatacacatgagtgtgttcttctgggaaaagagtccataaacttcaaaagattctcaaaggaatccaagacccaaaaagattaagaaacattgcatcagacaataaattgtcaatgagcaaggtcctgtccttttagattgggttttgaaatcacccatcccacaaatatatgataccacttaactagtttttcaagatattccttgttcaaagatgctcccactttttctttgtgctcaagtcctagataaacttggctaggggcaggaggtatgattcaggagttagtgagccgggagggctcactgtgcctgggaaagccagcttctcatgaatttttggaatatgccttggctcagaaacctacctctctaggcacaggatccaacttatacgttcaagatgcgtgactgagcatgtgaaagtgtcagagggatcgacctcaccattttacatctacttttccagttgtggcccctacaatcatcaaggctcattcggcaccatgctcctccaaattctgcatgcgactcagccacactaatatctttcttcatctataagatgaaagtaatacaacgcaccatgtagcaaactcacaggagaccctagagatcaaataacactgtgaaagccaccaaatgaatattttaaaattttatctcatttctgccaaggtgagatatcaatctaaaaacaggataaatctttgtaagtacaagaacattaaaaagaacattaagtttgggttaaaaatgcaaaactgcatatgcaggaaaattacgttaaaaaaaaaaaaatcctacacctacaaaaacaaccaaacaaaacattgatgatactgggctgattcactgaatggtgagaatatgagtgattttctcctctcctatttttctcaataccttttctctattatctccttttttaaataaacaagtatatattgttctaaaccgaagataaatgatcatgagcagcactttcccaggcactgtcctagttgctctgcatacatcatcgcatttaatcctcacaacagtgaatggggtcgatttcattacagccacatttaccagacaaggaaatggttttcaaggttaagtaaccttctcatgacacagaatgtgactaagagttttcttattccatggctcacactaaatgtgctctgtgaatatcagtgagaagtaataaagcactgactggattttcttggtcaccgggtcctaaaagaaatgttggggaatctatgcagtcccaagttaaaaatgggaactgaactgagctgccacagcatgctgaataggtggagtccaggccaactaagtgcttcatggaacttaaaggctccagagggaaagcaatcgggaaggcacttccacaggcacatcggtgacaacttctggggattcttacctgtcagccttcagccaaggaaggacaggaagtggcatgggctaaaagatcctttgtttgacctctttccagatcaggtgacaggaaaacacaacacttgaacctttccaataaggacagccagcacttactgagccccagccaggtaactgacactgttccaagtactctgcttgtataaccagctttaaccttgcaacagccctctgaggtaaatactcctagtgacctcactttacggatgcagaacctgaggcaaggagttagggagtaaatgaagctggctaaaggcacttgcactggccaggcacagtggctcatgcctgtaatcccagcacttccagatggatcacttgaggttaggggttcgagaccagcctggccaacatggtgaatccccagctctactaaaaatacaaaaattagccgggtgtgatggcacaagcctgtaatcccagcactttgggaggccaaggcagatgggtcacttgaggttaggggttcgagaccagcctggccaacatggtgaatccccagctctactaaaaatacaaaaattagccgggtgtgatggcacacgcctgtaatcccagctactcaggaggctgaggcaggagaattgcttgaacctgggagatggaggttgcagcaagccgagatcgcaccactgcactccagcccactcggtcaatgtcactgccatcaagggacagtctaaccaaggtccagatggcacaagtggagccataaaaccaggacagcttgaggttcagcttcctaagcccacaggtgcaaggaccttatctggatccatactttcatcaaaaatgtcccttgaggccaggcacagtggctcatgcctataatcccagcactttgggagggcgaggcaggtggatcacctgaggtcaggagttcgagaccagcctggccaatatggtgaaaccctgtccctactgaaaatacaaaaatttagcccagcatggtgatgtgcgcctgtaatcccagctactccggaggctgaggcaggagaatcgcttgaacccagcaggtggaggttgcagtgagccgagatcatgtcattgcactgtgggctgggcaacagagcaacactctatgtaaaaaaaaaaaaaaaggtcccttcaggattcctcgagcctgggaggccgaggctgccatgaacaatgattgtgccactgcactccagcctgggtgacagagcgagatcttgtctcaaaaaaaaaaaaaaaaaaaaaaatggctcttgaaacagccatcaactcccatgtgataaatgcactgccacaatccagcagcaaacctaaagttcggagtgaattcctaagtcttcgccttcactgacttcccacagcatgggcagtagctgtgagaccttgggctggttacttaacctctctgcacctcagtttcctcatctgtaaagtggtataatcgtcacagtgttatggaaggatttaatgagttgctacatttaaaacttaattcctggcacacaataagtgctcaataaatgtttagccgctagttgcagtagtagcaatagtagtgatattaactctagctgtggaactaatttctcccacacaccgtggcaggttgtattctccagacacagcagtaacaatatctccttcccacacgctcttttgcaatgtgaccatgccacacactcccatcaagaggtggagtttagaataattccctcctctgtggatctgggcaggaagtcactgtgtgacttccagtcctaggtcatgacaagtgatgtagcttccatttcactcagggtgccctgaaccaccacataagaaagccaacggtcctgaggccatgctgtgagggggcccaaggcacatggagaggcccagggcaggtgctccagtccagagctggctccagccaggtccccctgccaccatgtgagtgaatgagccaatcaccacccagctccacctgccaccatgtgagtgaacaagcctcccctgtgagctgcccccagccttggaacttccagccatgcctgccgtgcctgtaaattctcaacccccagattctgtgagcataacaaaattgttgttttaagccactgaggttgggaaacatttgttacatagaaaggtaacaagaacatatgctatggcttcaatcaacatttttttcagtacctattatgatggacactaggacagaaactgtgagggagagattaataagacatagttgacaagttgtcctaagctgacaatcctaaaataaatacacataactaatcattttaatggtatacgatagcagtgaggtgcaaagtgcaaggttaagccctttcagaaagtgaaagcattcaaaaagccttcaaaaaagtagtgtcatctgaattggatcccaaagcgcaagggaaatatataccacatgaaaacaccgcagtgcattccaggattagcaagaagtttgcggaggtcgttttgtcacatgactggagggcacatcagtgccaggcggaaaagggcaccgaaaggcacattaataaagtcaaacacctcctctgggacaggggaagttgagaaagagcctaacagaggtaaggaagaagacggatcagatttacactttcgaattatcactctggtggcaggtgaaggacagagcagagggcaggactggaagcagacagaccaaattcacagtcaaatgcgacaagatgagggcctggcctggttttaaatccaaggacaaaaatatcattcattcactctttcattctttctcttatctgaatccccagtggtacctaaaatagagctggtctaaagatgatgattaatgaatgttaaattattgatactacttctaagaagatgtaactgccagctacagaaccagccaaaaggactgcaaacccagtaattcatttcatcccaacctgactgatctctctgatgtctgcactgctgtgtcactagactgcccgattgtcctaggttgagacatttacctactgagccccagggatgggtggctgcttctaagctgctgcctaattccctcattactaaatgttgacgctgcttccttagaggactgctaaaccataactcaaaaatgttttaaacatgctactatttacttagattagaatatttacttaaatgttttaaaaaatacagtattttaagtcttttatctcttctgactactaccactaaccctgcttcccctcatttttccagagattagcactactgtgatttaaggatagagctctccagacttaaaaaaaaaccaaaaaactgcttttatatccagatatatgtaaccactgaaaaatatacattatttttcagcattttttacataaacattatcatccctttcattgagttatgttcctcagttttcctcctcaaagtttttgagatcaaatatagttcccatttttcttctttatatagctgcacagtattccatcataggattacaccacattttatttattccaatattaatgaatatttaggttatttatacttttttttctataaccaacaagcccatgccttctactgcttatcctttccccacctgaatttgtacaatccccagcttctcttatccatgaccactgaaaccccagggaagaccttatcactttcaggatgtccatggctctttcaccctatgccatgcttggaaccaggaaagcccaaaagaccccacttcctgcccttctattctgctcctcctctcctatcgctcatttctttgcctctatcctccactcctcccagcaaaggtagggatagcacctgagtcctgccaccctctcacctgcattccccctcactctcatgcgaaggacagcacagaagcagcatcaaaaaagaaaggcagcgagggagccctgcagcctgccctaggccagccatgcccacagccacaggaatagacactgttttcagccccacctagattcaaggcagcatctaatagaaatgcttataagtaaatataagtgccagtatttgccttctattttctagaggggaaaaaaattaaaaggcaagatcagattacttgcctggaaatgttctccctgtaattactctgaccgctctttctttccctccggttttggagataatggaaataggctgagtgttgggcatttttttttttaaagagggcagcttcatggcaacactccctctgagaagtccagaggctcagtgaaccgcagcttagagtgagttccagtaaaaggaccatcacttgaaccagtaagtgcctcattccttctcacagcatacatttcacagcaattactgttgctattattttacgcttcatttctggacctaggatacctcagtttctccagactctcagtctggtccccaggttttcagtctgggagaaaggtgtctgctggatttcaaacagtccctctactggccgccaccaccaccctctcctaaagaggactggaataactcttccacagctcccgccacactcagcactgcctgcacctcctcctggagctggcagggccccagctgtgcacccctcaatgctctcacagcttcaggaagaggactgctaagcccagggccctgctgacaacatgccgggagcgcatctgcaggcagggtcagaatgtcagctaccaggcagcagagagatgcggggcgccaacagcaaaagcacttggggggctttttcaagtggcatcagaactagacctggatacaaaggggtggccctggcttcaggaagcccatgataagtcagtctgctgtgtccttcaacacagtgtccccaccttctgtctcccaacactaggccatggagacacaaaactagaaaatggggctgcctagctacgaatgcccaggctgtgaattggggtctccaaaggaacctcagtgccgtgtcctactcagagcagctccttcagctcttcaccctggaaagcactccggtacaaaacaggaatattcctcttctcctgactctgcccaaggcactgctgtgaccctctcagcagtggaagcactagccaatgtgccatcctcctggacgatagctggataatcgcaataagcagagccccaacaactagctctagtgtgtggggagaagtggggaggatggagaaaggatacaaaaagacactgtgggatttcagggcaacccatgagtgaggatcacagcagagctatgccttgcaaggaccagaactggaaaacctttgtgacttagaccgccctcctcaggacagctcccgccactcttcagggacaaagttcctttactcagccatagtttctgtgctccaaatactcagcttacacatgcctgttgctgctgcactcaccactgtggttctcagtgcaaattccccagaaagcagtctgactggctgggagaccttttttcttttaaccaggcccccaaagttgtagattttggggtcatttacaatatgcatttccccaacacactcagatctaggtggacttgaccagatgggcatctgtattccattacccagcatataaccactttgggcaacagggaatgtgaagggccccaaaccgttccccaccaagagtgtgggtggcaggcaccctgaaatatgtctagcacactcataaagcatgaacatctacacacaactaaaaataaatagtgagagccctgacactgcttctgggggttttcccaagcacctgttacgaatggtaacaatggatggccgctccttctccctcagctttgactttcattgctggtggctcaggctcctgtgcttggctgtcatcggtgggtagccctggattggacattttccctattcaattcaaggaccatgttcttgagcataactatgaccaggcagtaggcagtgggccctgctctttctttccagggaggcacagataagccagcatcacagatgcaaaaaacagaaccgtggaggtagagactaattcttcagcagcccagagaagagaactgggaaacagggccctcgcagatacacaagaccaagctggagagttcagggacttccaaaagaaggtacaagaatgagcactataccatagtggggtgggtcacaaaagcaggaaaaggtccccaaacaaagaatccatcagtcagttacagcactctccacatgtggtgaaacagtatgcaaccatttaaaaactgcagagaacaatatttatgaacacctaaaaatgctgaaagcacactactaagtaaaaggggagaaaggctataaaaggatttgaaagtattttcgtaaagataaacacccacacacacccacacacctctatatatgtgtggaaaaaggactgggctagtatatttaaaaaacgctaaagggaggtcgggtaataagggattgttttttccttgcactttgtgttttctaagtattctatagtctgaatgaattagattcataattaggaccaacagtcataagcaatttctcagaccacctgcctcataaaacccaaaaaaagaagtcagagaggggtgaatattttggtacagatgaattcaggttgtgtaagtggagaggagggaggtggccaaggagcctgaagtgggggaggggggctgatggtgaaatagggaatgggtggagagagaaaatgattgcaaaattggctggagccagcctggtcaggtcaactttgcaggtgtgtgaagtgtcaaatggttaatcagttgccctctgtttgagctgcttaatgcacaagggcctggttgaacaggtttgacctcatttactttttcttaaagctgtttagccactttcctaaaaactcctattttctgagttattaaactttccattccatgttgatcccttccgagccctctaacgcatctcttctcttgcttcttccaactggatgccttcatgaggcattaacaggtactgtgagccctgatgaaaatcatcctttcagggtacaaggaaggcacctgaatgacagatggttggaggaatcttgagaaagcagtttaggcattaacatgcaggctgtcgctgacttacacagagccaaggacgtgacatacagcatggggccatttctaaatccccactgaggacaagggtcctggagggaatgggatttggaacaagatttgggctttgaacattcgctacaggctctgacaaagcagtgatggttcaaaagcctctgccccctggtggcaagccctgcccagatgctgttaaggggctctccaggcacgccctcctaattaggggcaaaatcagagaagcctctttggaagaagacaaaaggcacaatgagatgcggtctcctgaagtagaggctttctctctggttatcacctgaaacaggaaataaggactgagtacctgctcaattccaggcactagccaaatctgcagcaaactagcatttccaaaggtgtcttcttactttaatctcacagccaccctgtgagggaagtgtacattccccatttcgctgatgagatgagcaaactgaggctcggagaaattgtcagtgggatacagagttggcatccaaacccacaatctctgactctaagcttctgtttcattcattccacaaatatatatggtgtctcctctttgctggacactgtactgggctgatgagctacaagacccaatctttacagtctaggaggcagagatagataagtaaacagaggcggcaaagcgtggcactgtgaaagatgcactgaggacaccgagctaggtgttccacaggcgtcaggaaaggcttcacacaagagaggttgcttgtgcccagttctaattaggatgagtaggtatttctgctagatcgtggtggggtggggaggacatcacataggacctcagcagagagcagctcgaatctatgcagagctgcacgaggagccggaggtccagagtactgcagcagtttgacattgatgggtggtagggtccatgaaagtagaggaagaccaagaggaagcagcagacaggggccaggccagggcagggatagggtgctctactaaagagcatgggctttgaactatgagcagtggagagccactgggggtgtaaataaggaaacagatattccaaatcctgccttgggaagattgttctggcaggagtgatgggaaaggggccctggcagaagattccttcatgctcctgcggtgatccaggtgagagctgctgaggaccccaaccaaatcagatcactggacctccactgggagtgaaagggggtggtctggccagagagatagtaaagagatgtagttaacaggcaagagaatgtggggatatccagggagctgtccacaattcgcaggtcttaggcaactgcttgggagaagttgatgaggtcatcactggacagagaatctattccctgggcccaaccaactctctagaccatcctgccatgtgcctctgagaagtgagcttccccagccaagcccacaggaggacatatggagcaaaggtcaacagtcactcagctgatggatggcaagcattcagatgggaggtgcctccacaggccatgataacccatggatccatttgagaaagatgccaaaaaacagttaattcaaggccactttaaaatacctggcattcaatcctcctcaatgtctccatcaactgtagaccctataactaccaaatgagctccactcgccacaaaggtcaagacacagaaacggtcagagagcagagcctattcctgaaaagcaaaagactccaaactgccacaactcaaccagtgaagggctggggaagactgacaggttcactaagaaatgagaggaaggacaaacaaggtgttcaaattagaaaatgattccattaatgagggctctgatgatatagttgtggaggttatcagtttgccagagctgcagatttaaaatacttacatggtcatcgaaaccaaaaaatgctgaccatcccccaaaacctcccaccccacctagtgctgataacaggagttatcagttgccttttgtgtacagctagatgagatatggatctgtggggggaagaaggggtgggcgtgctagcatctctcagctagactgtcatcggatggtgacattccccaggactcaagcagcatctgagaagccactttcagtatgactatggaacagctaaccacacaacacagcatactgaatgaggagcctcgcaggctgagaagaaagcaaacccggaaggcaacaaatggatacgtgcatgctgaaggactcgtgtttaattcttcccggtaatcctttgtcaggcatatatttttgtctcctcaaacttaagaaagaaatccatgctctggaggggagaaagagaggctgtactcattaactcagagctgacctcgtctggcaggattaactcgccatacctgtccagcccacagaacctggcctggagcatggagggagaaccacagccaactccagaaaaataaaaggctgcagcgagaaacaagtggggccacagagagaaaggggttttgaaaaagttctaaatccccatggctagggacagtgacatcagtgtgtttaccaagtatttgatttacttgctcaggcaaaattccagaagagacactgggacctgtgtggagagtttcttcactgcagctatcctgccaagctcattgtaaagtgacgaattttgtggacacttacagagaaaaaatagcttcaaatgctatagaccaatgctgcacgctgcagagacacagtctttgggttctgtgagctgtatttgggcattacgcagagttcagctgccatctgtccctttgaaggccagctaagaagttggtcccagcctgggcatggtaccactgtcctacattccagccatttgggatatcctgggttcaagcattccctcccattgctggatcaagcacttcccacctcctgctctgggaaatcagatctcagtaggtcatcaaccatcccagaaagtccagcagagttggttttggtttgggggtgttttttgagttgggtggaagaagagaccttacataatcttttaactttttctctaaggctgaattccctataagcaaaattttaaaattttttttaaagaagaaaaacacccagacaatccttaaaatcccctttcagctccaagactgtgtaattctgtgataccagtattgaaagcccctgcatttccctaactatatattcccctatgccagggaaaggtgcatgtaagtgagagaacaaaaaatttcacaatcgtggggacctcttctttcggctttggagcccccttccctctgtctctgtacggggcagctttttccttctgtcttctcccttccttcttgtctactaaactctctgcgccttagaaccaaaaataaaaattcaaaatcatgatcttaggggtgaaagaacactgagaaaccatagaaagcaaaaacgaaaagccaacatagaaaaagtctgacttgaattagaagcagcacttaaaattacaggttcagaaaaagcttgaacagaatccagggctgaggtcagccctgagtctgcaggctctgccctctcacaaaggtgagtagatgggtctggagagggctgttcatgctatggaagggcctctatgccatcgaggctaaaaccaaagcaggagcaaatcagccctgctagtgtgtacagtcggcatcaaagaggcaacaacggtagagaatattttctgaaagacacacatgaaaccagtaacggcgatggtctctggaagaattaggtcagaagcagacttaatttgcactgtgtacattctttggtatcctttttaattgaacgcatgtgaatgcattacctattcaaaaataaatgtgtaaaaacacatgccacgacaaagcaaaatgaggagacagtataaaaaagacaaggataattttaaatttctcctaataaaacgctgtttaaaaatctaagaggaaaaaagggtaggctccagctagtggagagaacaactgaaaaacaagagccacgtgttcccatggtcctggccaaccccacttctttcccatcctcactcgttcacatctgccttggagcacccacagcaagcctggcttcatgcccagaacatcacctggctttcctcctctctccctgcccacatctcctcagtcactcgctgcctcctctcttgcttctctcccagttctcagtttgcccatcaaatctcaggtggtactctccattctctgctatgagggagttcatttgttcatgcaatttccccaccggagacaaaatgtatttcccaaagttggcttgcaatgacatctcccatgcctgctctgcttacccatgactttgacactccttccatcgagagggcagaacctgtgtttcctctctctgaatctaggtgggctacagctctggtagaagtgacactctgtgaccttaaggctaggtcacaaaaagggaatgcagcttctgccagcaatcctgggacacacacttggagcccgagctgctgtgtaagccatctgcctgctctgagcccaccacactataaggaagcccaagctagcccacaggagagacgaggtgaagagaatgagatgccagtctccactgctccagctctctagtgtcccagccccagccactatctgactgcaaccccatgaaagactgagccagaaccacgagcccagcccttcctgatgttgacatacagacttcatgaaagagaataaactaatttttgctttaagccactatgatttgggatgatttgttatgcagcactggataactgcaacacctgcttctaaacagtagaatcccaaacgtctaggccccatctctaacttacttcatgttcctgttctcactgattttttgccactgagcttgaccaagcccttgagtcaccaattccagatatttgtttaaacaaattcactgtgactgtctacactatccattcctccaaaacaatccctgttatagttggccttccccagttctcttcctggcatagagtagtctgtgcccttctctcatttcttaatatgaccctcacccatggagtgttcctagattctgctcattcataatgcttcttcacccaccctaacctctccctcctgtagccacagatcatccacttttccaggcctctgcactggaggctgcatcagccacctcccagtacgtcatcctttccaatgccctacaacacggggcagaaaggactcttttttgctgcacatccaggctgtttaagaaaaggcttaaggcagcttaagcacaaagaatgtcatcttcaaacattgtaacggcatcttctttttggggcactgaagtattcccatgattccaagaatcaaatgaacagcatctggttatggggtctctggtctctgccaaggcaaactcataaagcatttcagagcccttcatctggaaaggccttttctccaccccacgcccagccaatgcccactcatactttaaggcctagctcatccgtcatctctgctagggaaccttcctcagtgccttatgcaggcaaccattcctgccttgtgttgtgttgtgttgtgttgtgccttaagtcaaatccttaactcatctttgtgtgtccccttgcatttcagacagtaggtgcccaataaatgtttgtgggatgaatcaactggttattctcctggaacaccctttcccagtacacctccactcgccagaacaactgtcttcctcacaggtgccagccatcaccccgaccacaccctctcaaaaggcctttgccagtcatcaaacaaagcctcttgtctcctgagagccgctccacaatcaccttcccaagaagaattccccataccgagtccaccattccttccctgatcaaagttgctttcacaggcatcttttcagctatccactcttcacggcttggttttcatgcactctgagttggccctatctcccctttttggcctcaagcacgtcaagaggaaggctggtgacagcctttcccgagctcaggacagttttcatgcaaactggttcttccaggttcttatgcctggaagaactgctgctctccaatagcatgaagtagacaatgatgttcttagcatccagtcttaaaactagaaaaagtattggcactgctggatccccagctcctagaatggtgtgtggcacctaaacagagctcaaaaaatattagttgaatggaggaaagaatgaacagtcatctggcccagacttggagaagctgtgatctgtctagcccttctacaccaggagcgaggcctgaaaagctgcatgactcacccaaggtcacaagcaagccagtgaagaggggctggaaccctgtcttttgcctcaaagcacagggccctccttctgtcccacccagctttctcaccacccaccccaccccttccacactccaaagacagcatctccgtgagaagtgttgggcagtgtccaggagtgtttttcttcctggctttaaaacaaattgtgacaaatggctccacagatctaccgggccatggagctgagcagatgggactgcaattcacgctattaactcaaattctacttgactttctttcaaatcagggcattttatctagaaattataaaaaattgttgggggagtgcctttgtaaggaagtttgccagcacattcatttacaaatcgacttgctcctggccaccctcactgatcacggacttttactcacgctcccttactctctcccatcaaagagtccagcgcatggagagagtgatggaatcttgaggcccaccggtctaaccacccacctaagcttgactcccctgtgcctgtggacatcctgcgtgcagatgcacattcccactaatggcagccaggggaaagcactattcgaaagttcttctttactttgaactcaaattgggctcaggggtcctggatacaggacaaccccaatctcttatttattcaatggacaacaggtgagcacatactaggcctggacactgatgtaggtaggcactaaagcttcagagagatgcaaatgaacaatctttaccctgaaggagctcatgttctatgggttcatttcctttccctgtgtcttacaaacaggttccagtttgtttccgtccttcagagtgtactgcctagaactgcatgctatactccacaagtggcctgaccagcttgtggacaaggatgaagcaagcagaccaccttctttcagtgcagacaagatggctgtttagaggccacatcacgtggcagacacctgccaactaaaaccctccatccttcccacagcctccccctcctacactttgcagctggattcaaaaccttgcattcacccttgttccatcaacagggccaggccatcagtctatctcatccggactgttttttatcttacttgccaacctacacacttgctgttccttcttgccttaaagtcatacagatgactttaggtgattcagatgagtgtgacctctactttcaccaaacacaatagtcaattcagaaaggtcaaggacagaaccctccagcatgctaacgcagccaaagaagtccgaaaacaatacttggccacactgttttcctgcttacggatgtggactgctcttgtcctgcctgtaaatatatcggatcgctctccttcttgctggcatccacagtaactatactcaataaacacaccaactttgatgccaaatcctaggccatcccacacatcttaaaaataaaacaaaaatatgctattccagctaccctcactctttttgtggtttcctgcagtccaactagctacaaatctcaaagccaaagattgtagctccctctcttttgttctttcatcaagccagggagtcctgctcctctctctctagtctctcctgtgtcagtgccacttgtcaactgcctaatccagccacgctgctcttcaatattaaaggtcttcagcatattttaaagttagtctcctactgccactcttttccctactcttgccagtccactcagtaaactactgccatacaggtctcccacagcagtttctcaccagataaacaatggccggagattccactttgccaatcacatcaagtccaaactccgtgtcttggtatccaaggcttctaaagtctggccccactccacctactcactctgacacccaccactccctccaaacatccccggtacgtcttactggattttgccatttcctccaagttgaccaggagtcattcacacctaaaggctatgcttacatcgttttccatctcttgtgttggtgagctaaaaacaagatggaaaagaaaaaagaagaggaagagagaaaaagagaaaaggaagaaatggggaaaacagcaataggaccagctaactcctacagcagagtcttgccaggccctcccctaattgctttatatgtgttacaatgtttaaccctcacaactacaacaggagttgggtaccattccatccccacctgcagatgagtgtggcaccccaagattaagtatctgcccagggtcacgtgaaaagtctgcatgcatgctgaaccattccagctgcaccactgcccaggaaaaaagtcacaggtaggaagacaagcatagaattaagaacaaagcaactaactgtaccaggtgctacagaagggtggtcagcctggaaaatcaggaggtgcattccttgggagattgccgcaatcagagtctgggagtatgcaggagactggcaggcagcccagggacaggtgaggcacaggcactcattcccttccatgtgagaagtcagggcacgtgcaaagccaaggccagaggacaaaggtgagctcgccaatagggccaatactgggtctggctggaaggggagggtggacagagatgggtactaagaagtgaagatggacaggcaggaccaggtcttaaagggtttgtgtcttgctaaagatggacccttaattccgtgacacatctattcaaccactcctcattatctacctaaattctactgtgcctttgcaaagcccagctcaagtcctttttcctctcaggcctgtcctccctactcctgagcaaaccacgggtgtggagacaggtcccaaccacctgcagatgacagaaggaagctgcatctaggatcggtctacacagaggcaagaagggatcctcctcctctgccttctcctttcatgctgttcttactttctctcaaaaagaaagaaaatacagtgtcattgcttcttccctaagcttgttaagtcaaagcaagtcaaagcatcagagcttcattacttggctttttctagctataagcgtctggaaaatatcaggagtcactggcctctaggaatccattaagttaaaggagctccatgatctactatcataagatgacaaagaaaatatgcactttctttgggaggtcaagttgggcgaatcacttgaggtcaggagttcaagaccaatctggccaacatggtgaaaccccgtctctactgaaaacacaaaaattagctgggcttggtggcaggcacctgtaatcccagctactcaggagactgaggcaggagaatcgattgaacccttacccaggagacagaggttgcaatgagccgagatggcaccacggcactccagcctgagcaacagcgtgactccatctcaaaaaaaaaaaaaagaaagaaagaaaggaaggaaggaagaaagaagaaaatatgcattttctcaggattaaataacaaaaaatgccaagtttcttagctccagtcaagaaaatgacatcatgtgacaacagcagccattgcaagtttatcagaagatgaacaattacagatttttcatttctgaataaggaaccatttacacagacacatgtataacaaatgtctgtgcacatccaggacttgtcaaatcttaacattttgccacacctggtttagtttttttatttttcctttcaagaaagaaagcattacaggctgtgcttcaatccctatttcaccccctttcaagccccactattccacccatcccagaaatgacaacatcccgaatttggtatttaccactcttgcacatttatttttatgcttttactacctatgtatgtagccataaacaatatacagagtttttggatgctataaaactgtttaaaatggcatcacactgtatgcacccttttgcatctgttttaattgacaaaacatttttgagggtaatccttgttgacatatgtcactccagggcattcctttcaactgctttataccatggtccactgtctggataatcattatctatagcacaatgtattcattttcctactgataaatttttaagtggtttccaacttttcattgcaataaatattcttgtaaatcttcgtccaaggttatcttcaaccacactaggcattgcccaaattgctctgcaacatcagtgcaccaatttacattgccaagatcagtgtttaagtgtttctattctttgatgtctttgtcaaccttggtactatttgactactacacttttcaccaatcagatataaggatgaaatggtgccttcttggtattctgaaaattaattttaaatgggaaaataaattactaataagtgcagcttaatcaacaagagttttcattaacatgtgggaatacaccaggtgttccttggattttcttgaaaattctacagggagggtacgggagtgacggtacagataagattggacatgagctgataattgttggaactaggtgatgagtgtatgagggttaattattctgctctctccactttggtacatatttgaaatttttcacaatagaaattaaaagaagaacggggcgtggtggctcacgcctgtaattccagcactttggaaggccatggcagaggatcacttgaggtcaggaattaaagaccagctggtcaacatggggaaaccccacctctactaaaaatacaaaaattagctgggtatggtggtgtgtaatcccagctattgaggaggctgaggcacgagaatcgcttggacccaggaggcagaggttgcagtgagccaagatcgtgccactgcactctagcctgggcaacagggcaagcctctgtctcaaaaaaaaaaaaaaaaaaaaaaagaagaagaagaagaaagaaaacaaagaagaaagaaagaaagaaaaagaaagaaagaaagaaaattaaaagaaggaaatgccataaagcatctggagcaaagaacatccaaagaagagcactgatcactgcagcagacagccattcagaatgggcagagagcagagctggcaggaagagaggacaaaaggaagaccaggaagggaagccaggaaaagagattttgcattgtgttattatttcaatcagaagacttaggaacattatttaattatcaaatttgtgtgtctgatgatcctttacaacactgcagcatcaaataaagtgttatcagatttctttcttttttttttttttgagactgggtctgattctgtagcccaggctggagtgcaggggtataataatagctcactgcagcttcaaactcctgagtttgtttgtttgtttgtctgtttgtttgtttgtttggagagacagcgtctcgaactcctgggctccagtgatcctcccacctcagcctcccaaagtgctgggattacaagcatgagccactgtgccccagcccaacatctgatttcaaaagtactattgatattataatcaccattaaaaatcactgaagtttttgtcacccaaagttttacgttgaaatatagaacatttcatttttttcccacacacctcacatctgcttttgatttttaacatgtgcatgaattacctcttattagaaaaaaaaacacaaaattttttggtaaaagaattttccttaagtgggtattttttccctaagtctgaaatgacttagtaaggataagaggtcaaaccatatgctttgtagtgaaactgcaactatgatgaataacattagaattctggatgccttccagcagctggaacagggcagacctgaggcgggagtcctcatgcttaggggaaggggctcaggcactgggagtcggtcagggctcccaggatgtaaaagatacacatgaaagaaacaaacagtgggactcgggccagtgcaaaatttggcctggaactgagctaaaaactgtcatactggtgggaagaagcagattggttcaacagggtaaccaaatgtgaaaaagaaaagcctcacaagaattaaaattgatggttggaactgggcgctccgaggctgtgggccggtgtcctgccccgaagggtttggctgccagcaggtgcagcgctgccctgggataccagctcctgggatgcgctgtagtatcatcaatcaccggtgctgctcgctgggccttggaagcacacagtagtagcagatgtcagcagggggccaccagggccacctgccagtgagcccactgcttagctgagtcatggtcaagtttctctgcagattgttgcctgaaaatatttcaccacctggaacctccctgtcccacccatcttcacttgcaatactcactcccctcacctctgcccctaaagcaattattcattaaccacagggatccaccatccaggaacaaaagaggcttgaaagctctatctgtgcctgcacttcttggtccaaaaggcgcagggggatgggggagaggcaccggggtcatggtgcaggctcggctgttgagcctcattccccaaacacaatgtgacaggtatcaatagttctggagttgatcatttcacagaaaggaaactgctgtcaacctgcccaaggccacacagctagtcctggataaattgacttaaagaacccaggtctctgattcccaaatcagtgctcttacccctcccacgccacctctctcttctaaagatccacccaatggaactgccccagggctggtatcccagctacttctccattcatgccgcaggtcaatgattcagggcggacactcctcaagtgaccttcagaggccctgactcactcctccgacagtcctttgtgtctggactcccagccgctcctcagcagctctgtcctcttttgtacatttattactgtcagcctgaggctagcaggaggtctcaatgcctggtgatctgaggccagcctgtcccaggccctcccagtcccgtgaggtcctcctggggatgcaggcacagcgactgacaaggataaggagcagaagggcaggtggctttctgggtgtgagcttggccttctgccacacccatgttcagaaaggtgtctacgggcacatcttgtgttgtcacaggtgtagaaagggctttgacacgcggcagatcctccaatccctgtgaaagagggatcattctttctattatacagtgaggacgctgaagtccagaaaggtcaggtgactgatgaaaggtcataaaattagcaggaatcagggaaagggcaggaaagcagagcttccagttgcaaggtcaggactcttcagcccagcaggcgagtttgccagccagtctgtgccctggtctctgccctccccaaacacgtgcaccaatttggaggggctgctcccagcacgcatgctgcaagataaacttcagtgctcagccctctcactgtgacaacaatcccttagaaaggggtccacgctgtccatctgggcccctacaccaaagaacacctaattatcagtggtcctcactcaggaaacatgcccacaaataaagacaaaagtaaacccaactacacattcctcaaaatcctcctctccatttcacagaaacaccacaacagagcagaactgcaacctgatagcatccctgtctggttttggctctttcaaaacatcagggacctcacaggaaagcaatgcagaaaactgcagtcatttggccgcttgttaaggagagccctgagcagcaagctccagaccggagatgcgcatataacagcagcagttccacacagccctgcacagcagcaattcagcctctggcagctgtgatgatgctgaggcagtgtccccactgccccagtggcttctgcatgcaggttcatttgggacaggacacctctaactccatctctggccaggagccagcatagtaggtgccgtgaaagccaggaagtgaactgcacagaatggactgttccagtgtccatgggctgcaagtgggtcccacgtcacccacaggtgaatcttaattatgaaccaaggtgacggcagaaaggatgggcagcaaaggagggtgtgtgtggtgatcagccatcagaggagacggccctgtgtgatgaaaggacctcctcaggaaacctccccaccagcaactggctccaaatggtcagactttccaagaaattcctgtgaaaaggacaggctcagggcatgtgaatgtgatagtcagcaattcgcacctcagcagccagtgacactatggtatagggaaaagaacttagattaggcatcaaaagtacccggtccccttcatacatggctggtggggaggtaggatggtgcagccactttggaaaacagtctggtagtttctttcaaagttaccaaatgacccagcaatcccactcctaagtatttacccaagagaaataaaacctgtgtccacacaaagacttgtacacatcctaatagctgtattcatagtagccccaaactggaaacaacccaaatgcccatcagtttgtgaagagatggacaaaatgtgctatatccataaaacggaaccctactcagcaataaaaaggtgtgaactagatacacacaagaacatggagggatctcaaaagcactgtgctgagcgagagaagccagattcaaagggctacacactgtaggatgccatgtgcatcacattctgtacagtgcaaaactgtagtggcaggattcaggtcccctgaggctggggtcctggaggcaggagaggggctggtagcaaggaggcacaagggaactttttggggacagaggagtggtccatatttgataggtggtggttgtgtggctgctcatgtttgtcaacaaagaattacatattttaaactggtgagttccgttgtatgcaagcaaattataccacaatgaagcaaatctttaaaacactaggttccttttctttatctagagctcaaagtagtggcccatgctggctatgacttggagaaatcacacaagcttactgggtctcaactgcttcatttgtacaggtggctgcataacactccccgggcaggggaactgtagggatgaaatcagcaaatgtgagtgaacacacagaggaagcaacacataggccttccccaaatacccacttctgttttctttcctcagtgtgagtaagtggctctaatgatccacaaaccttccaaccagccaagtcaaggaccagcaggaggactcaggaaagtactgaaatgctggggagaaccaggacagcggctgagcacagccagacagggagggcagcctggtggggccctgggagccatggacgcgactgcgctgggagtggggatgggagatagcaggagttggtgggtggggcacaaagtgggagccagggccaaattgctgctgatttgaccattttgcaaaaggccagcctggctgtggcctcaggcctctcatttcctctaccataatgaggggtcacggaagtgccttcccacaactgcagcatctccctccacatttgggctcaaatacagagtggggccggagacagaaaaagtctccgtgacacactgtgatttgtttctgcactgtgtgaacccttggctctgtgacacagaacacaggtttcagcagttcctgtcacttcccacaggcgaaacagacagagcattcttttgtccggcttctggtgaaacgccattatcgttatttttaggaggaagatggagaattggggtgggtccccacaaagaggatggattcagaagacttccaggaaccttaaacggcttggaaactaattgtgccagttctttttgatgtctaattttattctaaaatttcctctcagcacaatatattaatactgatcagccaagagaaggttaggttttggctcacaaatagtcaaggagagaatctccttcattcattgagaaggcagaagatggcgttaaagagtattcacaggtaactaagattgccagagggagaatcgagtgagttgtcagtggtgaaatacagaggaggtagagagagctacactgagacaacaaaggcagcttaagggaacaaagccagctaagggaacaaagccggggtccctcaggtctgtggccaccggctccagccaggacagcctggtagctgaagagcacatccttgcccgttacatgcctgtgtttcaagtgatgctaacttgctaatgcagatatctccccaaaccctgcccctggctcaccacccagtgagcaatcactcactttccccaggacaccttcagggaggtactctgccagcaccgcacacttaaacagctactgcaggttcttctctcagacgcagcacggttcctgagatgacgtcagcgctgctcgctgaaagcaccaggcaaggaggcaaaacaaaggaaatcctaaagagcaggcgagagaacagtggaactggcagagagaggcactggtgcggatggagagggcagcaataaaaactgggggacacttagaggcaaaggtatggcaggtgacaaaaaagatgagctgaagctcaggagagacccaggcagcgatgcccaaatgaccggctgaggaatcacctcactgctgctgatgcccttgacagcgatgtctgaggctggcgtgagtgctccatgctcagagatacctagaacccagctacaatggccttatcagactgaaacaagaacaccaagatattccaagggaggtgacaatggggtccaaaggttgtgcatttatggatcacaactatgtgctgagtgtggcccaaatcccagctccatatggtcacaccatgtctacagccaatcagctgaccggggtggcaacccctggctctgctcaacaataatgacaaccatcatttactgagcacttactatgtgccagaccgatgctaagtgctttcctcagatgtttccatttaactcttagaatcaccctaatgagtatctcctattattttacagatgaggaaatgagagtttagaaaagtaacttgcaaaatcatactgctggctccataacaaatgttgattgaatgttgtctgggtggacagaggcaaggatgaccggaacgagacaaacaaacaaaaggctgactgacagaccattcgggtagcacttttcctgggattaagcttagaccttgtaggcctatcagccagaagcagtgtgtaaaataagagtggctgactgggcacggtggctcaagcctgtaatccaagcactttgggaggccaaggcgggcggatcacctgaggtcaggagttcaagaccagcctggccaacatgatgaaaccccgtctctactacaaatacaaaaattagccgggtgtgatggcacacgcctgtaatcctagttactcgggaggctgaggcacgagaatcgcttgaacctgggaggcagaggttgcgataagctgagattgggccactgcactccagcctgggcgacagagcaagactccctctgaaaaaaaaaaaaaaaaagagtggctacccaagaacgcaacagcagcagcaaacactgatctgatgacaccccagttttgcagaagaggaaggaaaaataagaatgtcaactctccattcaacagagaaacagtgccaccactgtctttaaattttcaaacttatcgagaaaagctccagagaggccagtgccagcaatgccggctgtctcccaagtctgaagggttttcctctgggtattaggagttgaggtgtttggttacagaaggaaacaggatgcacgggagatcacacacagagtaagaggtgcctctcaaatgcctttcccacgtttctaactctgctttttttaaagcacgatcagacccgccatctgcacttttacctgctgcctgacgaaaaccagatgccaaaggcctcccagcactcacggggccctttacccttaggaaaacaccgtgattcagccaggcgagattgatgcaacattgtaacaaagcgtatgcaaagtgcctagctccggactgcttgcagaaaaggcacattttgactcttctgagagtgggaaagatttgaaagatgggatttgcaccttattcttattcaagtctggagatctggaacttcttcctgaagctccatgtttagccagataattgagacgctccacctggtcaccactggacaccagccacccaaacattctcctctgcaaggcacttggcattctggtgcctgtggagagagcagccttctcactagcacagctcatgaacaaggatccccttccctggacagccaagatgtaaacctgcccccagaaacactgagagtcctagaggtagaatgagtcggccagcaagctccagcccattgaatgcagacccctgagcaaatcaagtcaggagaaggtggacaactgtaccctgaagaccacataccacccagacccaacacaaatagctgtcagcactgccacccattacagcttcagatctcgcttctaccagcatttcccagctgagcaacaaccgtcaaagtctggtcctggaaggacagccctccccgtcttggcagccacactttctggccctagcccaaggctgctgtggcatgggaggaatcaatggaggaatacatggctcttccctggttccttcctctcccacttcattgactaacactagtcacatggccccaactgaactgtgagggaggctggaaaatctggagtatgtgcatgcctagtgagttgcctctaccacatcctcttaacccttggcctctcattcccaaagtctagccctattttcaaatgaattcaacgcctcattacttagatctttcctcattacctcaaagccatagtggcaaaaagcaaacagcatcttcctaaaatcttcctcttccatcttcctctcctagatatccatcttacccttctttgccagttaatttattacaatcttcctttgacagcttcactccctccccgcactgctatcaactcaaatgtgagttatttcagtagcttgagcttgtcactggccttttacttttttccccttccaaagaacctggtacccagctacttaatccttatccttcttcccaaggcccactttcattcctttctcccccattcatgagcctgcaatacttttcccgctgcataagtcacgtgtcaccatataaactcacaatttgaggtgctctagaatctgtccacggaattagtcaggacataatctccctgtttttcggcagtgccacatccatacctgtcttcacaggtttgctcatgccaccattcctttccccagaacgcccttctgctcctcccacacaaatcctaatcctccctcaggacccatttaaaatacaatctcctcactcaactctttcctaccaacttgctttcccctctcctttctgccttaccacaaagctaagctctgtctctgaataatgtgctttttgatgataatctgaatggtacaagaagaaatcctatttcatgctcctttgagggagtgtctaatataggttgccttcgactataagtagtagaaaattcccactcaactggcttcaacagtgaggacaaaatgtatggagattggacgcttcagtcttcaggggcttggccctcagggtttttcccatctcttcccgtctgctggcctcaacaaacctgctttcctcattgcaacaagatggctgcttcacgtccgagaatctagtgaaagaagctgtcccttctgcatttccttttacaaggaaaaacatctttcccagcatctcccagcagacttctcatacctcagtggccaaaaccatgtctaaactacgggcctccaggatgggctcagctcaatcagcacataccctagagctggaggcagggtcacctttccttgagtggcgtgtgggagaggtgtggcatccaacccaactgggtcctgccagcaggaagagaaaagaagagccactgtaggtaaccaatcacgtctaccacaggcagggaccaataccacatatctgtgtttcccctcacttgccacccccatcctgtgctggcagatgaggatgctcaacaaatagctgtggaactacaaattatcctgtgggtgtgagaaaagagtgtgcattataatagggtggtacaattggacatgtgtgcacggaaaatggaaaaacagccatgaaatccaaacagatgcaaaaacgttcttaacacagaaggtttgggaagctctgatctaagccctagcctgggccctactcccagttccacagatagggagcaggccccaggccagagtgctgggcttctcccagcaggatccagctggggctttctcctcagttcaacccttgcctctgaggaccagtggtctacagtccagcccaccacccttcagacagaagttccaggcacaaaaaggaagctcacaataaggaacgcccatgcctagccataactgagcgcatcacagactcacacaaatctgtggaatgagtgcatgatctcatgagctctggtctggaaaagtaagtctccctacactaggacttaaagggaaggcttctttggctatgccaatatctttcctgccactttcttcttcaggccaaacagctcctatccctgccttccatcttagctttccagcatactcttcccaggttctttgggctactgacaagcactccagacccaaatacacatgctcccacctgaggctgggaaatgtaccaagaactgcatagaaaatatactggacaaaaggcactccagtctcacagatctccagtcccacagtctatatcaccagttttagctgtttgaagttttagaattccttttcaaaaccatagctagcatttctttggctagagaaaactgtgtgaaatgcagcctaccataggatcactgattacaacatgcattcaacattcaatacatattgactgagcaactattaggttgaactatgtgacattattgacattcgactgcttctgacctatcaaaatggcaataaagctcaacttaatatttactctatgccaggcagtaggctaaggaaggatttgggacaccatgacaaacaacacagaagtaacccctatcttaatggaacttaaaatctagttgattaaaccattacttacaaaagtacaatctaacttcaggattgtaattaattataaatgcatttatttgtttactgcctgacttctttgctagcctataaactacacaaagatgagggttatgtctcctccatttcacacactggcaaagcatatagcagaatacatcatatatttgttaaatgtattgattagtgttacaacagacaattgcatgtgctatggaagcgtttggcagagagatctaatctaatcttggaaggtgaggatcctggccatcactaacttggaatttctgatactgatgatataaggttgagttatgtcttcgtgaaacaggtctctatacagcatataaacaactaccagcatgcacaggggttccgtagggactatttaaaatacttaagggaacaaacggttttcaagctcagtctagtatttcagaaattccatttacataaacaattggtgcactaattgcaaatcattcttatttctctcctaaagcaggatcccctaaggatctttattaggcattctattagcctagtttgagttacagtatttacttaaaagtaataacagtgaagttcttgaaaaatatttggtaattcagacattttactaattcaaactaatcttcctcattagtctacgttgttagaggtttaaccattgtattaagagaaagtatcaaaggcttcacttagagtaatagtcaccaaatttttttgcaagacaccttggtagcaggaacctgagctaacatcaggaggtaggtagaaatagaaaataaaggaatgacaatttgaagagcaactgcaatccaatttagtccaacagatgacacacatatgaagtcacattcaaattataagcagagcacaaaaatattttagatccttatcttttgattaacctggtatcattcagggaaaaatgtcagggaacaccactgaccagcagtcctctcttatctattttgcagatcttatctatttttctccctgagaaccagccctggacacaaactgcataaacatcaatgagcctagacagggtcttcatgtgtgtttggcctgccattgttctctgtaccagtacggagatttagtaacacactggtcacattcatggggcatcttgaactctcttgacatggtaaatgaacagcaggtcctgttcccatgccaaaagcaaacaaaaacctgtcaccagcaaggaagacacccagtctctccaaaggatgccaaagtccacatccagcctcctttgcagagcctcacaaatctctcggatgcaggcaggatgatcacgggctagggaagattatgctctgaatgtcttaagagattagttacttaaaatcctccacatgacttcagtcatccccgttgcagatcacagagtaaaaagcctacctgattaaagctgaatgcctatacatttgcaaaagggaaaatatgcagaagaaaacgagagtcagatactgatgggcatagcaccagctctaggacatcagaggtgttgaataaatgatgacaaggaggcacacatagttctgatatattcaccataaataccacagtcctcaaggctctctcaattacttacttccccccaaatcagagactgaatctggccttatcttcaaatgaggcccagctctccccaaattccaaatatgggaaattacagctcctctgtggtagggggaagagtgggaaggcgaatgtttgtattgcataacgttttaattaaaacaaagatgacgtgcaccagagtctctttctcatctcctgttaggggcgttttccagtactacttccaccctttacccacccaggtcaccatggtctttttcttccctctaggacaattcacctttaaaataagaggattgggcaagaaatctacaaagatttttccaaaatgaactcaggcctagaggcatattagttctctatcttgttgctcccttctagaagtgcacagttcagagggatgcccagccacagaggtgccaaaacgcagagctggaaccaatcacctgctccaacagagacaaggtgaaagcactgggcagggtgctcagaatgtgctcttgcttctttgtaatgaaatatcagaagacagattgtaacattgttcagcaagctattttttgtactgaaacatcagaaggcattatgaaactgttcagcaaatcatctctaaacaatgtcataaagggttacctagtttggggtaagcccggaatgaatatctgcaccatcattcctcccgctaacaaacatgtccatctatgtgaagcataattcccaacacaccaccatctccaaaccaacaccaaaccactgccaaacaaagctgaagaggaaaaccagaaaggtctccgagaagtgctgcttgcagggagaagaatggccctgcacagaggctcctgagggcagcaggtgcctgctttggagccttggcaatttccaccaggcagaatttacaaccgtctgggacctgcagtctcagagggctcacggagaagggggaagctcttggctacccgggaggtcaccagtgactctgagcaaagtgcagatcaatgcctgcttagggttacccccaggctgggagagggcatctggcaaggaacagacctggaagagcctgcccctctttgagctgctacagcagcttctgggaatttgtaagagccatactgatgagggtcccacaccctcccttgccagggcgccctcagggaggccacactgcaggaggcagagtatgaggtggggaagatggatcggccttatcctcaccaccccccatacgagtctcctctggtatggatggtgtctcctctctggtgggaagtatgtgatttctctatttctatttctcttttgttcgggcttcctagaaattcagagctaggtgtgaaattcccaattcccacagacaagcaacatccccagcagtaataaggacgttccacacacccaggacttgggatatttgtgtattttcaagaataaaagtttgccctttagcctcctcagagccccctcccttctcctcgctctccccttaccactgctattcatcatcttactcctacagataccccctcttcgtggtggcaccgggcactagtaactcatggctgtaaagaagagctgagaacaaaacaggaagaaaagaggttaagtaatggcaagaaaaaagatgtaccttaggaataaaaaagagttcccgaatgtcacagtgtatttaattaatgcttctatttattaaagattaaaaatacatatcaggtgacgacttaaaatgttagtcatgattttaactgtgaattctgtggcaccggagataacagaacaatgagtgcttgtagaaggcactcggttatttgttgaatgaacttcttgggaaagccttcttaggaaagtattagaagtagattctgctaaaacaggggctaccctcagaggtctcaggacaagggatagaaagtcaaacactgatgtttaagaagggatgcctatgacacatgaatcccacagccatctctccagaagagcaactattttgactgcgcatgcgggaagatggcgggccgggcgacttgagatccgcgggtctccctgctccttttccgtctgcgtcgggagctcccgggcacgtgaggccgtgccgcgtttactggcgggagggacggcctagccgggcgacgcctcggaggaggccgcggaccccttaggtgctgggcccttggaaatcggcgcgtggggggcggtgctcgagctgagcgcgagagggcgggagagctcgtggggtgcgaggggagcaggacgcccggccgggcagcatgagtcagcagcggccggcgaggagattacccagtctcctcctgcacccgacggaggagaccccatcaacgtggagggcctgctgccatcaaaaataaggattaatttagaagataatgtacaatatgtgtccatgagaaatctgctcccgggggtattcttgacttaaacaaggttgcaacgaaactgggagtccgaaagcggagagtgtatgacatcaccgatgtcttagatggaatcgacctcgttgaaaagaaatccaagaaccatattagatggataggatctgatcttagcaattttggagcagttccccaacaaaagaagctacaggaggaactttctgacttaccagcaatggaagatgctttggatgagttaattaaggattgtgctcagcagctgtttgagttaacagatgacaaagaaaatgaaagactagcatatgtgacctatcaagacattcatagcattcaggccttccatgaacagatcgtcattgcagttaaagctccagcagaaaccagattggatgttccagctcccagagaagactctatcacagtgcacataaggagcaccaacggacctatcgatgtctatttgtgagaagtggagcagggtcagaccagtaacaaaaggtctgaaggtgtcaggacctcttcatctgagagcactcatccagaaggccctgaggaagaagaaaatcctcagcaaagtgaagaattgcttgaagtaagcaactgatggcatttgagaatttatgtatcactgagttttttgggaatatcttcctggagaattacgcatcaaatttgattctcagagcaataaattatccatgaagtgctctcgttctcagtagcggcatcatggccagtagtgtctttgaggagttcaccacttagattactgagtaattgtggtttccacatttgaaaacaactccttttataattattcactgctttttgtcagtgaaatagacatcttgcctcctgaagtagcttcatcacagagtgtcatgaagacagacagtcaggctgaaaaggacagttctttgtggactctacccttcccttcaaggagtatgtcatatgtcacaaaagaaattgccttacactggttcatgtttgcagttactgttgtacattgcatagatgtacacacgaatttaaatgtgatgtctttgtatatatctgtataatgttgagattacttacgaaatatgtctgagtgacacttttcactctcgtacagccaaaataatgtatatatggaaagtgacagacaaattctctaatctctttggtatctataacttattagaatcctctggatgagggttagaagagactttttccaaacttctacatgtagaagtatcataaatgtgctacacatttatgtttgtggatttaattaaagtattttaatatggttttcagtgctaaaattggagtcagatacttcttggttttaagctgtctacctaattgctgtctcccagcagatcggtggcatgcccagtggctttgggggcaaggatagaaatgtcatcaggaaatagctgaattcattgtgaaacatgaattcagtcatggtgataattggaaactcctttcaggtttttgcaagtagattttgtaatgtttgtgtatgcagccttgctgttgagtcagtccaaggggttttacttaggacaagttgtaccttgccctctctccagctctgctcccacattttcacatacctagctatttctacctcattgggtaagtcatttaccactctgtgcctcagtttactctgtagtttaccattagactgtgagctccctgagggactttgtcataatcactgttacatcccagtgcctcacaccatgcctggcccttaagaagtgctcaataaatgtctgaacaaaaaaaaaaaaaaaaaaaaaaaaaatcaggtctaaagatgagccatccaagaaactgctcttgctcccagaggttttaaagaaagtcattcccatgaacgtgagaagtaacccaacactttgaaatgataatctttttacagcaataactgttgctgcagggcttgagaaaaaaagttctcttcctttgggttaaagtcttaaatgctgagcccgtagccagcaaccttaaagactactcgggtccagttcattctatctggaggagtcacttgggaattgaaaacacaggaaaactttttttctggtccatgaacaaacaagaacgcttaactgaattagacacaaaactaagtatttatggttgtcatcttaacaggtttcaaacaggcttcattttaatttaacataatttcaaaattatagcaaaatagtcaataaaatacgaacgtgcttaatttgatgaatttatgtgttttttgaagaaaatatgcagaataaacaagtcaattattctcactaaatacattaaaatttaagggtaatatttttattatgacttgctctcctgatatagcaaaatttattgttatatagttatggaaggaggctcactactccccaatgatttcacaaattacagcttcagccagctataaaataaccaaatcagttctgatatagccataaaattaagcctgaaaaaatagtgaagtaaatcatccctttaaaatcaagttgttgaacaatatgttctgcatgattccatttatgtcagaaaaaatatatttgtgtaagtatatacacagaaaagggtctgggagaatatataccaaactataaagaatctatatcaaagtcaataaggggcatagacaaggaggggaactttcacattttactttccacattcttttttttttttttttgacggagtctcactctgttgcccaggctggagtgcagtggcgcaatcttggctcactgcaagctccgcctcccgggttcacaccattctcctgcctcagcctcccgagtagctgggactacaggcacccgccaccacgcccagctaatttttttatatttggggtttcactgcgttagccaggatggtctcaatctcctgaccttgtgatctgcccacctcacccacctcagcctcccaaagtgctgggattacaggcgtgactttctacattcttgtaacagaattatagtcaccgttacctccatcaaaaaattaaaattcaaaaattaggccaggcacggtggctcacgcctgtaatcccagcactttgggagtctggagcagcagatcacctgaggtcaggagttggagagcagcctgactggccaacatggtgaaaccccatctctactaaaaatacaaaaattagccgggcgtggtggagggcacctgtaatcccagctacttgggaggctaaggcaggagaatcacttaaacccgggaggcggaggttgcagtgagccaagattgtgccactgcactccggcccgggtaacagagcgagactccatctcaaaaatgaatgaattaattaattaattaaagcaaacaaatataagctacctcctgaagtagaaaccagtatctcttcaccttacctttacataatactttaccctaatgcattttatctgctgttctaaatcatgacttacttcaaatcaaatcttaagtgaaaatcaagatttccttttgggggcattatacaaaaaagactgtaaaatttcattctctgaaagtctttttaaaaagggatagattgtatctggctgggatagggtaggtgtgatcggacccggaggaaatgacggctgctcaactgtgcatctcctttcctcaccctgctgaaaagtgccacctagcatggtcaatcaaggtcaccaatgcaaagcagtagtgggcaaacaccacccaggttatccaaagcagcacatggggttgggaaactgatgaccttggagatttcaaaatcacctaacaataaccccaccttccctaaccacagggctaagcaacctaatggatggaacatatgtgtgctttggtcatccgcaacccagaccactagactaattttgctttagaactggactatatcaagtgtgaacgatcatacttgttatcatgtgggaaaaaaggtttaattactccctaattgtctgggaaacaaaagatttcaaaatatggagctcctgggggaaggagagttaataaaatgggtccttgagaagtgaagtgggaagcctgcctcatgccatggcaccagcgatgccacaggtgtacccagtgccctgccgagagcagagacggtgttctcagagttgctatcaaaaaggaggcagcagactgcattctgaagcatcagacaatgggtcacatgcggaaacagaattaaatacacaaaaatagcaccaacttaaggcaagcctgggcaaactgcactacatcaaagaaagaacacacaactggtatcagatttttttttctgttttaataaagagaaggcctggacacctgaaagttgacgggaagcaggcatcactaatttctccgagttcacagttttgttagaatgtctttgctctgattatggttttatttatttatttttttgagatggagttttttttgttttgttttatttgcttttgttgccctggctggagtgcagtggtgcaatctcggctcaccgcaaactccgcctcccaggttcaagagattctcctgcctcagcctcccaagtagctaggattacaggcacccactaccacgtctggcttctttgtgtttttagtagagatggggtttcaccatgttggtcaggctggtcttgaactcttgacctcaagcgatccacccgcctcagccccccaaagtgctggaattacaggcatgagccaccacgcctggcctgattatgttttgatggatatacagaagctcttgctttggtacagaaacaggccccgctttgcttcgacctctgggccccccaccttcagaaatgtctggtgccattcctggctcctcctctcagtggtcttccaggatatccactcacagctttctgatgtcacccacctgtctctagcccagatacccagtcctcatggcaagtgactgcagcaatttttacaaatctacgcccttagggttcccatcccaggacgttcaggtttctccacccctttagaagtgcccagaatatcccctaccccacgattccaacaggacgtcactctcctcttacttaagaaaaatgcctaaaattccagcccttccaaaaggcctttctagattgaccactcaggagttactctggcctccccttcactcctgctagactgaaaacaaggacagacttgcctggcctctctcccccagtagacacctacccccagtgaacacatcctgtcagtgtcctcccgtccatttgcaaattgattgactgtttcattgctggccttggatgacctctcctagagggcagggacggtggtgttcggcaaagccttggtcgtctggataatgggaaatggggtcttctggtgaatttaattacagggttaggtggaaactttgcttcaactctcattattagaaagtctattgtaaagctttttaaaatacaactgaccactttccagcgagggtagagttaatatgccttaatctttgatttaggatcttgcagtgccccaggctcaccattctcttctgctactataattatagatgcggaagacatacagactgggctgacaactgcttggaagctaatttctagaataaacccttgctaccacatcttgtgatttttgcccttctgaaggtggagttccaaaataaaaacaaaatcccgcttaactgagggttccagttgagggaggtctgctgccatggtctttgttaagtgcctgccaccatggcccacaattagtcagttaataaagggttcttgatgagagaatttggcaacatgtgattttccacaaatataagcttgattttgatgcaaccactcatttctttgaaaatcagggggcattcacacacaggtgttctagatttccttacagtaaaaccaaccctttacaaggaatagctgtgttcactttgaagcagtaaagaagcaggtgtccactcatggcaaatgaggaactcccttttttttttttttttttttttttttttttttgagacggggtctcgctctttttttgtgtgtgtgagatgggggccacccaggctagagtgcagtagtgcaattacagctcactgtagcctcaaccttctgggctcaaccagttcttcccacctcaacttctgaagcagctgagactacaggtgtgtaccaccatgcccaggtaatgcttttgatttttagtaagatgaggtctcgttatattgcccaggctggtctcaaactcctgagctcaagtgatcctcctgcctcagcctcccaaagtgctaggattatcggcatgagccactatgcccagccagaagctaaaaatattaatcaaggagtcacaactaaggatgcactgcacacccgaagccagggaccacaagaggtcagcaactgggactgcttcctccagttcccaggctggggctcagcagcagtggcctgggctctggggacttactttaagccgaaatcccaaactcattatcattcaaaccaattttctgtgtccagcatcatcccacctaaactggtccttaaaaccactgacagtcatttctccaatctgtaaaaggcctgctgaggcctttgcattatcaggacttaactgggagtagaatgccctccccatccaaatcctgaccatttctgaacactcagcccatgtcctcttcctgagtgtcttccccaacaacaaccacctacactgaactttactttgatctctgcaggaaactgtagatagagatggggtctcactatgttgcctagctggtcttgaactgctgagctcaagtgatctccctgcttctgcctcccaaagtgctaggattacagcagtgagccaccacacctggcctatgtatgcttttttttttcttttcttttttttttttttttgagacagagtcttgctctgtggcccagtccgcagtgcagtggtgcaatctcggctcatggcaacctccaggttcaaggcattttcctgcctcagccttccaaggagctgggattacaggcacgcaccatcacgcccagctaattggccaggctggtctcaaactcctgacctcaggtgatccacccaccttggcctcccaaagtgctgggattacaggtgtaagccaccacaccgggccacgtatgcattttaaaacgttatgctcagacggggtctataggtttcaccagactgccaaaaggatccatgacacaaaaaaagtactctcagttgcatccttcggaacctttcaacacatacacatatacctcactcatccttttgtgaagagtgtctattaatcactagattaagaggatttggataaaatttataaatgtacaaactttgctaccaaggactgacacatttacttttctagctcatcagtttatgtcctagaaaaattccagagccacattaaccagctgtttcctatttttcattttacgatggtgtttccactttcacctgcaaagtgactaatagtaatacctattacagtaatttaagtaacaccatttagagtaatttcatctttagtactgtatttatactactaagaaagccgccaacgattcaagctgcactcactggtgaaaccctatgctatatatgtaattaatttatttcctaaattcttacctccctccaccccctccattggaaaataaactctaagaatgcaaaagtttttgtgtgtttttcttcaacgcttagagcagtgcctggcacctaacagtcaatatctgctaactttgatgaatgaatggtatatttatattatgcaatattactatgcagccatgaaacacaatgagttagagtggtaccagctaatttaatggaatttccagaagtatgaaattaagaaaacaagaagaaaagtgtcaaaaatatcatcccactttttttttttcttccctgaaacggagtcgtgctctgacacccaggctacagtatagtgctgccatcatggctcactgcaacctcaaccttctgggctcagggaatccttccacctcagcctcccatgtagctgggactacaggtgtgtgccacaacgcccagctaatttattttaaattattttttgtagagacagggtctccctatgttgcccaggctggtctcaaactactaggctcaagtgatcctcccacctcagcttcccaaagtgttgggattacaggtgtgagccactgtgcccagcccaatcccactttttaaaaagtatacccccaaatccatacactggtgaggaagtggagaacgtggaatcctcacacacagaatgtaaaatggtacagctctggagaacattttagcagtttctcaaaatgtttaacgtagctactacacgacccagcaattcaactcccagatatacacctgagagaactgaaaggatatgtccacacaaaaatttgcagaggaacttgtacacacttgttcacagtagcattattcataatagcccaaagtggcaaaaacgcaaatgttcatcaactgatggacaaataaagcatgaacaactgatggacaaataaagtatatcattcagcatataagaaatgaagtgctaatacatgctacaacaggaatagaccttaataacattttgctaaatgaaaaaagccaaacaaaaggtcacatgttgtatgattctatttacataaaaatacctagactaggcaaatccatagagacacaaagatcagtgactgcccagagccagagggagtggtgaatgtgaaatggctgctaatgagtacagacttctttttgaggtattgaacatgttatggaatcagatggtggtgatcaatgcataactttgtgaatataccaaaaaccacatgaaaggtacactttaaaagcctgaattttaaggtatgtgaattgtatctccataaacctgtgattttgttaatatacgcttatttgcaaatgaatacatggataatgaggaataatatgaaaggttaatgacaaccttggtgatagggtacaggagactgggagaggaagataagtgttgaggtagaagaagacaaaaaataaaaggctaaaacaataatccagggccagaggccatgagttgggagatggagcaagacgaagtgtacaaagaaatgagcataaatcataaaaatgagggaactagggttgaaaactccagcaagtagtttgtaatgggggagatgaagcaaacctaagtaactgcaatgattcaacggaatttgcagaaaatgcagaagggcgagaaaagcaatgaaaaaatggatcagaagatttaaaattggctctaccccaccaaagttttaaaaagcaagcaagaagaaaattcagttgctcctgggcaagaattcttgggcccagtggggtagaaccaaaccatgataaggagacaccagtgttttgtaagcaagagaatatattaaggagagaaaaggggcatttattgggagaaaaggtctcactgtgattgttctggaataaagtagccccatcggactgcctcaggaactcatggtggaagaggtgccactggaaaatggctaagtcgggatcttccccaagaacactagaagagacagaggaagaatagaagagctttaaattttagcagatatttctttttcttgtttaattaaaataaatcttattgacctaatatttttgagactgggctcttgcaatgctccccagactgaactcaaactcctaggctcaagagattcttccacttcagcctcctgaaaagctggcactacaggtgcacaccactgggcccagcataatggctatttcttgacaaatcttgacaatgccaccagtatgtttttctttagagacagagtctcgctttgtagcccaggctggagaacagtggtgtgatcctggctcactgcagcctcaaacacctggactcaggagatccccctgcctcagcctctcaggtagctgagactacaggtgcgcaccaccacacttggcgaattttattttatttttttttattatactttaagttctagggtacatacacctggctaattataaaatgtttatctgtacagacaggttctcgttatgttgcccaggctggtctcgaactctcggcctcaagcaatcctctcctcctcaccttccaaagccccgaaatatgcccacatccagcctgccaccagtttctttgcatacttctttcctaggcttgaccaagacctttactttcttctgtgtacagctcagcattgaaaaaaaacaaaaaagtttaggctgggcacaatgggtcacgcctgtaatcccaacacttagggtggccaaggtgggaggtttgcttgaacccaggagttccacaccagcctaggcaagatggcaagaccacatctctccaaaacaatttttgtaaaattagccaggtgtgctggtgcgggcctgcagtctcagctagtgagaagactaaggcaagaggaacccttgaacccaggagttcaaggctacggtgagctgtgatcacctctccagcctgggtgatagggtgagacccagtctctgaaaacaattaaaaataaaaaaagttgaataatgagtcttctttttagaggcaatgtatttttcctctttttgttttccttaggctatatgcacaatagacaaagttgaaatttaatcttaatctcgtaaacccttactgtccaaacacatcaaactcaaaaaaaaaaaaagacaaaaacaaaaaaggtgaaaggcgtacaagagaaaaaagggaagtaatctgtgccaaatgtacattccttccacaatttgggacaaaaatgatgcctacctggtctctgggtgccaaaataagacattagagacactcccctccttcaagaaataaaattggaatcagacactaagatacaattaaacagactttgaaagttggtatgcactactgggaggtgtctcacagctggcagggtcaactgcaactagaagaaaagctcctaagggcagaaactaagtggctcacttcctctgtaacactgccgtgcccagcactgtaccagcaccccagcagagtcaacaactttccgtcaagccacacacttacggtctcatcgtccagtggaggccgcagatgagacatagtgtgccaaatcccaaatgcacagggtgccagacaagtctgcgggaggcaggaggactagggaagccttccaggcaaggtgatgcctgagctgagttgtttttcttttgagtttggaacattaatttaatcggaggaaaacaagggacatgaaaagggcaaggaaataagaaaatgagctgagttttgaaggcaatgatcagatgaagtgagagaagaatattccagcagagggagacaaggagactgcagagatttcaaggggccaagagctgttcggtgcagctcagtgaagcacctaaacagaggtgggggaaggagaacaggggtcaaagcccagtattgaagtgttctggataccaagctaaggagaccttattacgaaggtactggggctgctgaagggtttaaatgggagagtgattgtgaacagattaatagtttggaaagatacaggcagaagtaaacctctggatttaaccaaaaaataaaggacagaaccacaatgaagatgttggaaaagatcaggaaaaacactgttaaaagatattcactctcggggccgggcgctgtggctcacgccttaaatcccggcactttggtaggccgaggcgggctgatcacgaggtcaggagatcgagaccatcctggctaacacggtcaaaccccgtctctactaaaaatacaaaaaattagccgggtgtggtggcgggcgcctgtagtcccaactactccagaggctgaggcaggagaatggcgtgaacccggtaggcggagcttgcggtgagccgagatcaggccactggaatccagcctgggcgacagagggagactccatctcaaaaaaaaaaaaaaaaaaaaagagagagagagtctgactctgttgccaagactggagtgcagtggcgcgatctaggcacatcacaatcccttccccgcccccgggttcaagtgattctcctgtctcagccgccggagtagctgggactacaggcgcgtgccaccatgtctgattaaatctgtatttttactagagacggggtttcactctgttggccaggctggtctccaactcctgatctcgtgatccgcccgccccgacctcccaaagtgctgggatgcgtgagcctccacgcctggccactaatttttctttctttctttcgtgtgtgtgtgtgtgtgtgtgtgtgtgtgtgtgtgtgtgtgtgtgtgtgacgaagtttcgctcttgttgcccaggttggagtgcaatggtgtgatctcagctcactgcaatccccgcctcaacaggagagcaggaatcttcagtgatccactggcggatctgcagccattgtgcgcgccaggtcttcccaagtcttttgtgcgcgcgcctctccttccagtacctatgccgccagcgtcccctagcctcccgccattgccagcaggtgctgagatcgcgccattgcactccagcctgggggacaagagcgaaactccatgtcaaaaaaaaaaaaaggatgaaaattttgggaaaatatggaagaaaccaaatggatttctagctcaactaaatcgtaattattcagtgtctagttttggcaagaaaccacatatttcatgtccacaatcagggacacagtcccagctctcaagtgtgggtctttcctaagcaaattgaagaacacaggcataaaagtacattaaatcaataaacctttttctctctgtctctctctctctttttttttttttttttgagacggaggttggcactgtcacccaggctggagtgctgtggtgagatctcgggtcactgcaagctccgcctcccgagttcacgccatcctcctgcctcagcctccagagtagctgggactacaagcgcccgccacgacgcccggctaattttttgtagttttagtagagacggggtttcgctatgttggccaggctggtctccaactcgtgacatcgtgatccgcccgcctccgactcccaaagtgccacagcccaggccttttttttttaagacagagtctcggcccggcgcggtggctcacgcctttaatcccagcactttgggaggccgaggcgggctgatcacgaggtcaggaggtcgagaccatcctggctaacacggtcaaaccccgtctctactaaaaatacaaaaaattagccgggtgtggtggcgggcgcctgtagtccgagctactcccgaggctgaggcaggagaatggcgtgaacccggtaggcggagcttgcggtgagccgagatcaggccactggaatccagcctgggcgacagagggagactccgtctcaaaaaaaaaaaaaaagagtctggctctgttgcccaggctggagtgcagtggcgcgatctcggcgcatcgcaatcccttccccgcccccgggttcaagtgattctccagtctcagccgccggagtagctgggactacaggcgcgtgccaccatgtctgactaaatttgtatttttactagagacggggtttcactatgttggccaggctggtctccaactcctgatctcgtgatccgtctgccccgacctcccaaagtgctaggattataggcataagccaccacgcccggcctcttttttttctttttcttttctttatctggagactgagttttgctcttgttgcccaggctggagtgcaatggtgcgatctcagctcactgcaatctccacctcagcaggagagcaggaatcttcagtgatccacgggcagatctgccgccattgtgggcacctgtttctcccgcaacctttgtgcccgcctctctccttcccgtacctattgcatgaccccccacgtccgcctcccgccattgccagcaagtgcctcgcgcgggtacctggctgcgcttattaatccgttaagctcgctctgtcacgggcgccgtgatgtgctcacgcgcccgctccctcaggtttaaaaggcgcgttgcccggcaacagaagaaactgctggcttagccgttggccgagttggcggctggacgaggacgctcagagcccagctctcgagagttcaagcaaccgacggttccccactgctcccaggagcggttacctgggcactctgtgcccctccttcctgttcgggcccaggccgaggacctgccagtagggctcagttgcctggagcccgttcagcccatcccccagttcactttgcttgtgggatctccccgttgctcctgcccgtggactgagtggcaggccatcctacaagcacccggacacttgacatcagtggtgtcaagacaactctaagaaggttttccgtgatcctgcaagccctgccttccttcctgggatcctgccttcaatttgattgcacaggtaccacagcaagccagtgctgcgtgctccgagttccagggcgtcctccagctcagccactgcactgagaacatggactctctgtggggcccaggagccgggagtcacccctttggggtccacaacagccggctgtccccagacttgtgtccagggaagatagtgttgagggccctcaaggagagcggggcagggatgcctgagcaggacaaggaccctagagtccaagagaatcctggtgatcagagaagggtccccgaggtcaccggggatgcaccgtctgcatttcggcccctgcgggacaatagaggcctctctccctttgtgcccgggcccgggcctctgcagacagacctccatgcccagaggtcagaaatcagatataaccagacatcccagacctcctggacgagctcctgcaccaaccgaaatgccatctccagctcctacagctccacgggaggcttgccggggctaaagcggaggagggggccagcctcatcccactgccagctgaccctcagttcctcaaagacagtgagtgaggacaggcctcaggctgtctcttcaggtcacacccagtgtgaaaaggcagcagatatagcaccagggtagacactcgccctcaggaatgactcctccacatccgaggcctctaggcccagtacacacaagtttcccctgctgccacgcaggcgaggggagcctttgatgctgccacctcccttagagctggggtaccgggtcactgttgaagacctggaccgggagaaggaggcggcattccagcgcatcaacagtgcactgcaggttgaggacaaggccatctcggactgcagaccctcacggccttcccacactttgtcctcacttgcaacaggggcttctggtctgcctgccgtttctaaagcacccagtatggatgcacagcaggagacacacaagtcccaagactgcctgggcctactggcccccttagcatctgctgcaggggtcccctctacagctcccatgtctgggaagaagcacagaccaccaggccccctgttctcctcctcagatccccttcctgccacctcttcccattcccaggactcagcccaggtcacctcgctgattcctgcccccttcccagctgcaagcatggatgcgggcatgagaagaacaaggtgtggcacttctgctcctgcagctgccgcagcagcccctcccccctccacattgaaccccacgttggggtcactactggagtggatggaggcccttcacatttctgggcctcagccacagctgcagcaggtgcccagaggtcagaaccagagatcccagacctcccggaccagctcgtgccccaaacgaaatgccatctcgagcccctaccgctctacgggaggcctcccggaacgaaagcggagaagggggccagcctcatcccactgccagctgaccctcagttcctgaaacacagtgagtgaggacggacctcaggctgtctcttcgggtcacacccagtgtgaaaagatggcagatacagcaccagggcagacactcgcccccaggggtggctcccccagatcccaggcctctaggccctgtagatgcaagtttcccctgctgccacgcaggcgaggggagcctttgatgctgccacctcccttagagctggggtaccgggtcactgctgaagacctggaccaggagaaggaggcggctttccagcgcatcaggagtgcactgcaggttgaggacaaggccatttagtactgcagaccctcacggccttcccacactttgtcctcacttgcaacaggggcttctggtctgcctgccatttctaaagcacccagtatggatgcacagcaggagagacacaagtcccaagactgcctgggcctagtggccccccagcatctgctgcacaggcctgtagtcccagctactcaggaggctgaggcaggagaagggcataaacccgggaggcagagcttgcagtgagctgagatcgcgccactgcactccagcctgggtgacagagcgagactccgtctcaaaaaaaaagaaaaagaaaaaaagttattgtgacatttctgtatgaaatcagccttcactacatggataggaccagcaggcttccgcggcacgactctgcaatcatactacatttttttttgtattttttttattccttttgagacagagtctcactctgtcacccaggctgaagtacagccgagatctcggctcactgcaaactccacctcctgggttcaagcaattctcctgtctcagcctcccaagtagctgggactacaggcacacgtcaaaaggcctggctaatttttgtatttttagtagagatggagttttgccatattggtcaggctggtctcgaactcctgacctcaggtgatctacctgtcttagcctcccgaagtgctaggattacaggtgtatgtttatttatttatttaagatggaatcttgctctgtatttattaatttatttagttgagatggagtcttgctccatcacccaggctagggtgcagtggtgcaatctcggctcactgcaacctctgacttccagtttcaagcgattctcctgcctcagtgtcccaagtagctgggattacaggtgcctgccaccacagctggctaatttttgtatttttagtagagacagtgtttcaccgtcttggccaggctggtctcgggctcctgacctcatgaaccacctgcctcagcctcccaaagtgttgggattacaggcctaaggcaccattctcggccatatttatttaattatttagagacaaagtcttgctctgtcacccaggctggagtgcagtggcgccatctcagcttactgcagcctccgtctctgaggtttaagcgattctcatgcctcagcctcctgagtaactgggactacaggtactcaccaccatgcagggatatttttttctattgttttatagagacacggtttcaccatattggccaggctggtctcgaactcctgaccttaggtgatctgacagcctcgtcctctcaaagcactgggattacaggcatgagccgccaagcccggcctctcactacatttaagtgacgccatggctcatgcctgtaatcctagcactttgggaggccaaggcaggtggatcacctgatgtcaggagttcgaaacgagcctggccaacatggggaaaccccgtctctagtaaaaatacaaaaattagtcaggtgtggtggtacaagcctgtaggcccagctacttggaagactgaggcaggagaatcactttaagcgggaggcagaggttgcagtgagccaatctcaaaaaagaaagaaaaaaaaaaagaaaaacatatgatgctggagcatctcggcctcaatacctgcatgagcacagtcatgtccaggccagggctgctggtcgaggtccggccccatctcttccagcagaaagggagtaagcttgcagggaggctgggggacaagatcccaggatctcagcctccgctcatggatcagctctgagaccccgagtgagctgggggtgctctgtgtgcactggtttccccagctgtcaagtaaagggattggatgaggaagtcttgtcaaggtggaatgatctcagatttggggcagcagtgaatgatcccgctccctgggccatgccagtggcctggcctcggctgaacacagccccaacactctggaatggggatgagggggcagtcagctcttgctcctagtaagagagatgcaacagggctctgtggctgagctgggtgccttgcctcacacctgtaatcccaacctttgagaggccaaggcaggaggattgctcgaggccgggaattttgagaatagcctggacaacatagccagactccatgtctacaaaataataagaaaacacacagctatagtccaagctacttggcaggctgaggcaggaaggtcccttgtgtccgggaattggaggctgcattgagctataatcgcaccactgcactccagcttgggtgacaaagtgagaccctgtctctaaaagaaaaaaaaatcggcctgtgagcatgggcttgattttcaaacaggacccggagggtagggacagacagtgctgtcacccttaggtgctgaacactcagaaacgggccagcggcagcccttccctcacctgcagacaccagattgggcagaacagcacgtggcacttgcagctcttgtagtgagggcagaacccagtgtcaacccttctgcctgtggaaggggctgctgaggcctgcggagaggccagggtggaggctcgtccccttgtccagcccttggcgtggtctccaccaggtccccagcccaccagtgcagggtgcccctgagcctgctgctgccacgggccctgtctctacccaggacgtccccccaccctcgcagtgtcagggaaatgatcatggtggcggtgacactccgcaggcagggctgctgagagaagctgagaagggtcacactgcaggcaggggcccgtgtgacaagcccctctcaccccgagagagctgaccaggcagctcacgagcagagccacatcccgggagtccgagaaaggtcctggctgggctcagccacctcattggccacgggcagcctttgtcgtgtgagccttgctctcctggggaggctcaggctgacggctgatgtgggcattgccgaaggtaacctgtggcccagtgtatatggccgggtctcctcaagctgcattcattcaagtaggacccagggtgcgtgcccatctccagcccagggcagctcccctgtaagctgggtgagctactgaagccaaggcgggaggcagctgacaacacccacagcccatgcggaggtggtggaaaggctggactcagcagcaacaccaaatcctggaccaggcagaaaccacccaagactgaggggctcatgccagagcggtggccacaggtaagaacccgggcccaggctgtgtggcaggaatcctccatgtcccagggcttagcatagcaaaggaagaccagccgggtcaccctggtggccatctgtccctgtcccacctgcagagtcagaacagcctctccccagtggggatcatctctctctgccaaaataacagcggtccctgccccaaccagactaccccactcagtggagttacggatgctgctccagcatcctaacactgcccagctggtgcctgcctgtgctcacccacaccccccaggccggccttccctgcagcctgggcttggccaccttggcctgattgagcactgaggcctcctgggcacccagccccatcactgcacctgctgcttccagccccaccccaccggctcaggggttcttcccagcggcgctgatcatgaagtcaacatgcacgcaagtcgtctcaggaaacttcttaatgaaagtgtcggccacggtggtgtgtaggtggctgagctcagattgcagctgctaagacaccagccacttaccaagagaaagccaggctgcttcaaacccagggcccacggcaaaaaagcatcacttccggccggggagtctggaagccacgccttgtgggaggtcacactggcatctaggccttcgcctgcattgcagaaggagagccgggtccccctcctggagaacgctgcgttccccagccccacaccggctttgccaccacacaggctgttgaggcaggaggcgggtaagacgtagctgtagacccaaagcaaccaccagccctgggaccctgcgggagaggagcacttttagaacatggaaaagtgtggtcatcccatcattagacagcacacatcctacataaataaaaagtcgtatggggaaggaggttggggagggaataaaaaattggcacagacattgatagactggtttccagtttcaaggtaacagatgcacatcatgagaccagaggaggcagagacaaggctggatttggcttttctaagcaacatgtgttcctgcgcagggctgaatggtcgctgagacagagatggaagccaggacaagggagcccaccgggcccagataggtacagagagcagaggctcctgttctgtcctcgccacccacgagggtgacactgcttgtaaatggtggctgtgctctcccagcaagaaaaaagcacaactaaatccacactgcacacagacgcagacagaaagccttcaagtggctctgttttctgctccctgccttgccaggtccacaagcagagaggagtgtcaggcacatggccccgctgtcaggctccccagtgagctgcgggctcagcaggagctgcccactgacacacaggggacacccactcctgccaccttgggagcggttgccagacagagccgcactgggtgctggtgtcatccagggactccacacacttccttaaatgtgatcctgcttccctctgcgcagctgcatcctctcctcctgcaggactgtctggaaacttggctctcagtttgctctcccttctctcctctgcctgccccaagcccctctttctaaaaaagtgatgccatgttcatggggttatttcttgaaaatacttggcggcctccatgcttctgttttctttgagccaggtggtcaggagggcttacaaagaatgcctgggctcccccgcaggtgccggcagatggggtagcgaatggtcctgtgcctccacctgctccgggagggagtctcccgtctctaggcctggccccttcctaaccctccacgtatcctgttctccagagacttcagaacccactcctgagaacagcggagccaggcgcttagaggaagaccaaatgctgccaggacacggattgtccagggattacattccagcatcttattaggtatctggatctgttggggaaaaaattagaaactatgtataaaacttacaaatattcaagtatcaaaaggttatttaggatgaaagttttaaaacaagtcatcagcaagctgctgccaccaagtggagacttatacaaaagttgagcgagtccactgagctgagaggacagaaatgaagtcacctgtgctggggcaggggcagggacactgggggcagggagtgtgtgggcagagaagccagagaagtccaggcctgtggaagccaaacaggagagcgtgggccggaagggcggtcaggatcgggggacgaggtcgctctccctggagaacgaaccctaaagtgcgtatcctgggattccctccctgggggtcctgtcccccgacatttcacgggccttctgagctgccttccaaggaggactaacacggcaacaaaagacccatttctgcacaaaaatccttctgggaagaaaaagaagaaagccaagaatggagtcaaaacgctacccagtgctgaccaagcctctcaaaccctgttctaagtggactgtggtttctaagtcagggaaatggaagaggccccacccacacagggacagggccacggcccccacaggatgaagcagcagcgtttattcaagatacaacagtgagggaatccggtcacgttcccttctccccagagagggcgcttcttgacaagtgatccagtagaaatcttttagactctataagttaagttcataaaaaccactgctttcaccctgtctcccagggccaggcctggactccgagatgaactggtttggggcgccctcgggtggccacataaaaaacccacagtctgaggccagcctggggctttcagacctgggcgggatctgcccaggccacctgtccttctgctttgggccgctgtctcttggcagatggcctgacacctgggggtggcccaaggatgcctcagaaaatcttgattcccactctacagatggcctgattagccagaggtttccaggccgtctgtccgcctccaggagatggactgggacctttagacatcggtggagaacaggatgctctgtcccttgctgtccagggcagggatggcctccagccgcaagaagtacagcagcacctcgacctgccctcgcggagtggggaagaggagagtggctcggaagggggcgcacagctgctggtgggaggtctttggggcccaagatcccaagtccacctcaggtgctagaaacccctgctggtgtcatgaaccccttacagtgagacgggggtggggtggggtcctgacaaggcatgacttgttgggtggggggtggttatttattttagagatgcacagggccttgctctgtcccccaggctggagtacagtggctccatcatggatcactgcagcctctaactcctgggctcaagcaatcctcctgtgtcagcctcccagatacctaggattacagatatgtgccccaatgcctgcctaatttttctttgtattttttctggagatggggtttgctacattgcccagactggtctcaaacacctgggttcagttgtcctgcctcggcctcccaaagtgctgggattacaggcatgagccaccacactcgaacacttggggtggttttaagcccccagcaaggtgcaccagcaggaccaggaggtggcctaggcaccccctatcactcccatccatgcaaacctaggcaagtccctgtctctgaatctcagccaccaccacatacaatgcaagtcggaagatgggcaggactgggggtggggcaggcagaggccacctctgtcaggctggggttgcatgggctggaggctgtcttcccatacctgggacatgacctccaaggaccagctgtcagtcatggtgatgggctggctggggttggcagggagcttgctctccttctcggagggccggagcagcgtggggccaaacaccgtgccaaggttgtgcagggacatcttattgactgcctccttctctgccatcctgtagaggaccgaagcagagggtgctgtttcaacgccaccaccaggagagaggcagaggggctgtgccgtgctagagtcctcagggagggagtgacctcgaccctggctgtgctgcaagctgactccagccttggtacttctgggtctcagtggcccaggacaaggggccagctctgggctgatggggaggtcttcctgatgtgcttgggagggaagggggggcggtccaaatgcactgctggccacggccaaagctctgagctctttgttaaggccacagtgcagagggaggagggtggcaaagaggagaggcaggggcgggggtggcagtggtgctagtccttagaagcagtgagttactgcagacaggggtcgggggaaaaggtccttggtgctgggggtctggtgggagcagaggggcaccccacggcctggagacctggagtcctgggcagccacaagagagctgggctacctttccaggtggtctagaaggaaaaggaaggtgagcaggttggcctccggcagggacgacagcaggttgagcatgcagctcttctttgcaactgggtctgaaagagctgcaggaggcagtgggtcactcccctgggttacgacaagccggagacctctcccgaggtggtcacatggagcgccagggacacgagtccttgcgcagtttaggcttgtcatcatcgtcacacccacagcgctggccgccagtgaggaccctgtgaggggcacctgtgtggggtgtgaaccacctgaacgccttttctctacctcgcaggggtcagcagcacccggcgaacagcagcaggaggagccgctagagcagctgctcatgggcagagctgccctcgggcaactcctgccaccaccccctccccagggagcccaaggcaggggaggctcagcatggaatgaaacaggggagtgagggacacaaggaggtgggaagtgggagggtcccagccccaccaagtacgcagagaccccctcgacatcctggacaccacaggggcacctgcaggctgggagaccaggtcctctgtgcatgggcccgggaggcagacctgccctaagggtgatgcacaggctacaggtgctgcacgctccagcgcccactctagacatcagcctccaggttgactaagggtcaggtcatgtttgaaaccatgcttggctggaccaggacccatggcaagagcacctgggcaccagtgtttagccctggtctgcaggaaggaggacagcagactttaggaccccacagcacggcagtgctgaccatttcacccacttggcctccttgagaaatatggatggggagccctctggggatgggcaaggccttccaggataggctcagttttggtcccctgctttttgaggttgggttaaaattccgaccatggcagaggaagcacagctcgggttcccacacctcacttttcacagcctctgagggcagcagtgcacgtggaggagacgtctcccatgaggccaaggcctccagtgctcaccgatgccctctgcgaagttggggtagaactcgtcagtgaagaggggctcgggcagctcacggaagtacagcttcagcatgcctgcgatggcgttcacgtccatctcgctcatcatcactgacacgtccttgttatctggaaagagcacggaaatgcagcggcctccttgaagatcctgagtgagtcacccaccatccctgccttggctaaagcaccgtccctgccatgctgaccactgtgtgggtccctcctgggctttgagcagctcatctgactcctcccaagagctgtgcatggttctgtgtctgcagagttgataggggtgcgtgggcattcccattcctctcccctgcttggcctgatgtgatggccaggaggaggccagcatggcaggacacagcgcctgcgtggggattgggtggctctgccctgtacatagcaaccacccctgcaccagtgtcttctgatagcaggaaggccgtgggagaatctgattggtttcagtgtttgaaccggtgtcttcctttggacccaattggccattggtgcttacatcctcaccacaggccaggttcattctgggccctcagagggagctgaaactaccacagggccctcccagggatgctgggcattctaagggtcctggtcagggtgggtggtgtgtgctgcaaagaagggtctgcaggcacaaaatcctgttgctttgaagatgctgggaaggaccctctggggtctcagtgccctcccctggcatttgaggcaggtccgggtccttcaaagcctgtgagggttggtgagatggaggcggagaggctgcagccccggcctgcgctgaatttcatcagtgccctctgcccaccacatcctcatacagggcagtggacagaccgcactgagtcctgggcttccacctcctgtccaaccccaaggcaggaaggccaaggccccgcagaagcccctggtccactgcaccaagtggcacgagtgggtacgatggtgtaaaaactggcttctatagaagctgtttgtacaactcttgttttctcttttttaaaaataataaaacagtaaatgaagaaaagacacagagaaggatgtgacatgcctgggccatggagcactctgagatctcatcggggacaccactgcccacacctccatcccgtcctgcgcaggccgacactcactgacgttgaagcctgccttcagtgcctggatgtctgcggccaccccagacatgcggtagatgcccacctcctccatgcctcggcgctcgatctcctccatgcactggcgcacgatgtagggcaccttggacctctctctcctgcgggaggagggaatgttctcagtgtcctaacagccctgcttgggccataacacaggagacctgctccctatctgcgcacccggaggtggggtgaggacggtgacgaaggtacccaggtctggggctgcacacagagccttctgcatgcctgtcctccctctgcaagctctgtcctcattgcatgtactttctcaggaacctttcaagcggccagaacccctgcgaatcacacatgacctttgcgggaaggtcaggaggcctgtctaagtcaagtcagcacgggaagggcatctgacagattccaggcctggggttagcagcctgtgcccccggctgggaggtcagacccggtgttggtcctgccacccacgtgctgtgtgagaggagaaaccctgacccctgccctgggccttaacacacatccgacgaatgaatgaagggttgcctcagcaccggtgctccaagtcctgcgatgctaagtgcttttctcctctgagtcttagcaatggacaattccaatacctccacacaggacactagagtaagaatccttcacagttagaacgcagtgctgtgcggaggccttaacttgagttctgttttgcacctggatttaccagcacatcaaagctgcttcgcaagccccctcatcagcagggcttatgtgggggagctgctgatggagtcctcgctgctcatgcccacagccctcccagagtgctatgcgagtggctgccgtgcagttgggggtggggcgtgtgtttagacacagataggagtccagggtatgactgatggaggccccggcccacgtgaccagcaaggtcagaggcccagccagattccatcctggggaagcaaatgaattctcagaggaagtggtctgtgtctgcatgaactgctctcaaaccaacaaataggcttctcttggcaactgactcgtgacaaagggttcaagattgtttgaaaaaaaaaaaaggggggggggaacagggaggcagtaggtcctggaaaagtaaattctttattttacaataagaaagtgattacatattttattttttttacaatggtggaaaattagaagtgattgtgaaaatgatgtctacccgccttgctgatgagtaggatgtgatttggctctttaggaaactgaatttgcagaacttaagaatattgatttataaagggcatggccattgacccagtccatcttatgcaaatctggatgccataaataatatttaaaaatgaaagtattggggtggaggttgcagtgagcggagatcgccccactacactccagcctggtcaacagagtgagactctgtctcaaaacaaaaaaaaaaaaaaaaagaagaagaagtcattcccaacattgctcatcaaattatgaccataaatttccaggatcagactaacggctaaagagactgatgcatcaacaccaggcagagaataaagcagattttttttgttttgttttggagagcctctaggaacttgaaaaatacatatggcacactcttaagacccggtggttcttaatcagggatgttcattaaaatgctggaaaactgtaaagacttccaggtcccatccaaggagattttgcttctgattgactggctagtggcctggccattggtattttgaaaaatccctccaagtgattcttttacatcccagctagaaaaccctaaattaaaggtgaaaaaccagacaccaagtggcatttaaataaatgtcaactttaactccacaaagcatctggttgcacgtggacagaaagagaaggaaagagggccctatatctggataacttggaaatgtgctccccctagcaagatatctaccaaaattaaaaccatatttgaggatgctggcactgcgagcaatatataaatgatgcatgtaacatcatttaatatgatcttatttttaaaaatgagtagagtggtgttttctagctgttagtgtttccaaatatcaatgtagaaattagccttctgcagctgcagaggcaattcagtttgcagcttgcttgcatgtggcctagagccacccagcctgatatgtactaattttttgtttaacttgccagagtagaaactcagtttctgggccaggcatagtggctcatgcctgtaatcccagaactttgggaggccaaggcaagcagatcacaaggtcgggagttcaagaccagcctggctgacatagtgaaaccctatctttgctaaaaatacaaaaattagcccggcatgctggcaggcacctgtagtcccagctacttgggaggctgaggcaggagaatcacttgaacctgggaggcagaggttgtggtgaactgagatcatgcccctgcactccagcctgggcaacagagtgagactccatctcaaaaaaaaaaaaaaaaagaaactcagtttctggttacatctgatctttattttttatatatcatctaagctataaagttatattccctatttgtgatcttaaaagaaggactccaggaaagtgttcaaatattcatatatctaaactggaacatatgtttatatttttaaaagtagcctgagaggttggcaactaaagtcatatgttgaatgatcatttctcaagagtttcattttatggtctttctcttgttctgtaaaatgtgggcatggatagatataaagtgcctggtgtccatgcttttgtgaaatcccttcctcttccatgtgaatgggacctgtgactttcttctaacccagagaacacagcaaaaatgatgtgatttatctgagtccattgatgacattgattacgacttcccttcaccacattatttaggactgcgtcgtaggagactgggacacatatccactttgctggcttgatgaagtaaactgctaagttgaggaagcccacatggcaaggaactgtgggcagccttcagccaacaggcagcaaaaagctgagctcctcggagctacagcctcaaggaagttacttctgctaacaacctgaaaaagcttggaagctagtttctctctagtggaatttttagggaagagcatggcccaggcaagataaataatgtaagtggaaaaacctgtcaacaataaaggttttaaaggaaaaaacaaaaaacatgtaatttagaaagtaactgccaggaaaaaaaaaaaagagactgggccagtggcttactacacctgtaatcccagcacttggggaggctgaggcgggtgaatcacaaggtcaggagatcgagaccatcctggctaacacggtgaaaccccgtctctactaaaaatacaaaaaaaaaaaaaaattagccgggcgtggtggtgggcgcctgtggtcccagctactggggaggttgagacaggagaatggcgtgaaccccgggacgtggagcttgcagtgagccgagatcatgccactgcactccagcctgggcaacagagcgagactccatctcaaaataaataaataaataaaatataaggtctcaggaacgtaaagattgacatttactcccaaactattaatatatgtccacccacctttcttgtagcaaaatcttaacttgacgtttgtttcaatagttattaaatttaattataatgtcctagcccaaaatacagtagaggtaaacatccaaggtactggcttgaggccactggccctgtatctataaaggagagggagaccatcaggggagggagggtaagaaagggaggaagagggcaaacaagttatcaaaaaacaacagtaggcagggcactatggctcatgcttgtaatcctagcattttgggaagccaaggtgggcaaattgcttgcactcaggagttcaagaccagcctggacaacatggcaaaaccccatctctacaaaaaatcggccaggcctggtggtgtacgcttgtaattccagctacttgggaggctgaggtaggaggatcacttgagcctggaaggcagaggttgcagtgagccgacatcatgccactgcacttcagcctgagtgacagagtaagaccctgtctcaaaaacaaacacatcagttattcatatttcagagtaaggacaaaacatttttaagtagctggcaaaggacatcactatatttcagagtaaaacaaataggaaatgcttatcatttgacatatttttaaacattgtatctgaaaagtgaacaaagaagtgaatgtgcttatgattaaattgactttgttactttgtaaacttgtagctttagacctgtctcttagcatcaccaagccttgatcttttcatctataaaatgggcatggtaatgccagccttgctatgtttataggtcacttaggaatgaggtatgtatggtgttgaccatggtttctggcaagtggcatatattcattataccatagctcttttcagaaagctaagtcaccacgtacatgttaatgcaacctgctgaaaataggcatggaaaaactagaaaatctagaaaaattagaaaatcactgaagaggattttctttaaaaaaatacatactttaaactcgggaggctgaggagggagaatcgtttgaacctgggaggcggaggttgcagtgagccaagattgtgccactgcactctagcctgggctacagggcaagactccattaaaaaaaaaaaaaaaaccagcaaaaaccaaacaaaacataatgcatgttctctcttataaatgggagctaaacatggggactcattgacttaaagatggcaacaactgggaactgctggatggggagggaggggaggggtgaaaggccaactgttggggagtatgctcatatccacgtgacaaacctgcacatgtgcccactgaatctaaaataaaagttgaaagtagatttaaaaaaccccaagagggctgggtttggcttgtgtgtccatagcttgttaacctccgctttagatattaactaatagaaacatagtgcttatcttcccaggccacctattttgttcctctccaaggtgatggatagatgaaggcctaatccagccgcctggaagtttgctgacgcttgtcctgtcacggattaatgaagcattgttttctgatgaaggtttcatgccgctgtgctgatgtgtcttctcttctctctaggcaggaaactgcatatcttctggtttacatgaagatggagtgctaatggaaatgcccaaaaccttcagagattgacacgctgtcattttccatttccgttcctggatctacggagtcttctaagagattttgcaatgaggagaagcactgttttcaaactatataactgagccttatttataattagggatattatcaaaatatgtaaccatgaggcccctcaggtcctgatcagtcagaatggatgctttcaccagcagacccggccatgtggctgctcggtcctgggtgctcgctgctgtgcgagacattagccctttagttatgagcctgtgggaacttcaggggttcccagtggggagagcagtggcagtgggaggcatctgggggccaaaggtcagtggcagggggtatttcagtattatacaactgctgtgaccagacttgtatactggctgaatatcagtgctttttgtaatttttcactttgagaaccaacattaattccatatgaatcaagtgttttgtaactgctattcatttattcagcaaatatttattgatcatctcttctccataagatagtgtgataaacacagtcatgaataaagttattttccacaaaaggactttgcagttttaacggggggcagtagggcttgtgctatagaaattcaaaggcaagggaagtcacttctgttgtggggccctgggaggagcctccaggctggaaaggcttaaggtggaggtctccgataggggcagcgtacacagtggactggctgcaaaaggccatgctcagcattcagacagcatcacacactccgcttttctctaccagggaggcaggtggggaaggatagcgatgggaaggcaggcggagctcagaatgtggaaggggatccagtaaggcttggaagtttgcacctgatctggtgggtggtgaggagcccttgaaggggcaaggaggcgaggagcactcagctgtgttcttacactgatctgccactggggttagagacaaacgtggtgggaatggaaagccacgcacagtcactagcgcctctggggggagaatggatgtggctggtgagagaacaggggggcccagggagagtccggcaccaacctgggcgggggagcccagtgggtgtgagcacccccactttagagatgaagtgatggagacattcagatgtttaaccccttgttcaagattccatacttgataaatggcagatcaaactcccaacataaaatgtgggtcatttctttattattttatttgtattggttaacaatgatcagccatgcaagaataaatgattattgtaaaatctgcaaacaatgtagatatgtagagagtcccttccttggagcttgaccttgtcagacaggtatagatgagtgttccggggcagccgtaaaaactgccagagactgggctgcttataacagaaacgcatggtctcccagaagcccacattcaaggtggccaaaggcctggctcctggaggctctggaggagagcctgttccctgtctctcagcttctgccggttgccagcaagtgttgccgttcattcactccagccactgcctccatctgcacacagcaaaacagcgtatcctgaagtgctcaaccttatagccattattttaaaatatccggaacacacaggaccgtgggagtggctgttggagaaattttcatgaaggaagaaagattacaactaagttttaaaatgctagttttgtttgttttgtctgggagaggaggtaaaagtgggagtaaaaatagggagtttggtgtaaggtgggaaaagcaaaggaaccccgcatggatgggctgaagggtgtgatgggagaacagtgagaagtacgtttggggaagcaattggaaatagtagctaagcttaatcacaatctatcaaaagggacttgttgaagaattaatgtgtgactaggaacagggaggttatgggcttgtcagctcgacagcgggcactcagttccactaacgaatgatgcccgtgtggacagacagaatgatggacaggcagatgaatgcgtgggctttatgtgaaacaggtcctcttggttgttgacaagatactgttttaaagttccattttgccatactgcgaacagcttgtcattagctcaatttagccacatgtaaaatcactaaggcggacttccagagttcccacatgaaaatcaaatgtaaaccagcagtgacctgcttcaacaccatcatcggaagtcagaagttgaactcttttttgatgtttaaagcctgcataatattcgctgtattattattcagcatattactatttccttcgtgatggaaatttggtttatcccaattttctattccatcaaaacaccgctacatagaaaatccccatgcacatatttctcctaattgtggaaatattttacataaaagactctagacatgggatgaaattcccaggttattggaattttaaaatagataggtactcccaaattgacctcttacaaattatatgaattcgtaagcttccaactgttatggagttacccattttgagaaatctgtgctaaaaggacccaaacaatgctgatgacaatgatcaggataataagtacgctgggaagacaacaaaatgatttagatcttagacaagtcattctaggtgtctccactgtttcagttcttgcgttcgttcattcttgtgctttttcgttttaccaaataaaatagctccttgatgtcataggaatccacgctatgcttaatgagtattggttagtaaaatgcctataactagtaatcttcatctatgcaattaaatattaattcataaaacacttcaaatgtaaacaataattagtaaatgaaaagtacataatacctcaattagaaaaaaatcactccattaaaaagacattatttgtgtgataaaagagattgccatttttgtatttttctacaaggttaaagaaaactaagtcaacttatacaagtgaattttaaaagactttagggcaggcgtggtggctcacgcctgtaatcccagcactttaagaggccgaggagggcagatcacctgaggtcaggagttcgaaaccagcctgaccaacatggtgaaatctcatttctactaaaaatacaaaaaaattagcccagtgtggtggcatgtgcctataatctcagctacttgggaggctgagacaggagaatagtttgaacctgggaggcggaggttgcaatgaaccaggatcgcaccattgcactccagcttgggcaacaagagtgaaactccatctcaaaaataaataaataaataaataaataaaataagtaaaagcctttaacccagaatgctgagtaaattggccaaaaatgctaacctatgcatttcaatactataggagtcgcatgggtagaaataaccagatgaaatacttctggtatttcaccttcccaacccacacgagccagtgtttttctgtgaataacaaaaacagcagaatttacttgcctctccataagaggttaccacttctgtgtgttcccccgaaacaggtggtggctgggtgagaaggtggacagcactagggcaggagatgggggctccagtatcgtgggtgagcttcctaaacctctgcaactttcagcccctaaatgggatgagccatcagaatttttagcacaatgcccagaacaaagtaaggatttgacaaatgacgcctctctccacattgttctgtcatcagccaccgcatcctgtacctccaagcccactgggctccggctgtttccatcacatggagaatgactcagagcctggcctccagccaccctcctggcctttctgcttctcactctgccactggctcctcatggaccaccagcctgggtgtcctcagacataccacacacttcactgtgggagtcacgcagccctcaatgctccttctccagggagccacggggctttcctcctcaggaggactctgcaagcagctggatgaagggccctcccgtctctcatccttccttaatttttgtcacagttctccttccttccactcagtgcagtgcacactgattgatcctccatcttccccaaaagacaggaacagcatgagcagtggagagtagattccaatgatagaaaaaatagtcagtgatttctcatttccattgatcatcaatgaagaaaatgtatcctgaaggtcatgtacctcctatgggactgctgcatcctcagcctcctgaatttcagcccagcaccttcctccccagcacagcaacaggtcagcccttaccagcatccctctcttattgcctttgtgcagagccagcaccagggccaggggaggccttgggattgtccctccccaacaatctgtgaaacaatcctttatgtcaccaacaaagcacagccttatgcactggtggtcagtccctctcaacacctctgtcactgtaaagctggcaggcaaccctccaaggttggccttcccaagcactgcacctctaggtgacagagcacgtccttaccttgaagcctgggcgcccagtctatcctgtccaatgagcgagctgtggagaaggggggattccgggttaaggggagactagcagggctcctgcttttatgttgccctgttgggaaggctattaaagaaacacaaagtgctaagcagtgaggatagaacatgttttcattatttcaaccaatacattccacagatggaataataagaaatgctacaaccaagctaactgaatccaacagcatatcaaaaagataatccaccatgattcaagtgggtttcatactagggatgcagggatggtttaacatacgcaagtcaataaatgtgatacatcacatcaataaaactaaaaacaaaaatcacatgataatctgaatagatgcagaaaaagcctttgacaaaatccagcatttctttatgattaaaaccgttcatcaaaatcagcgtagaacggacataccttaaggtaataaaagctatctatgacaaacccacagccaacattttcctgaatgggggagagttgaaagcattccccctgaggaagggaacaagacaaagatgcccacgttcaccgcttctcaacacagtgctgttcactacagcattggttataagagcaagactggaaacagaacaaatggatacccatagcggggtgcttaagtaattttgggaatagtcatggggtgcagtactttatagctctgaaacaatacaatggatttacatttgaaatgtggaatgataactaaggtgcattgcccagtgatatatgcagaggtgcagaggactttgtgtaaacacgatcacacatcagcctgcattccaggtgcatgcttctatttgcacatagattgcagggatgatatgcaaacaaaaatgttgacttggtgtttggaagttcagagtggaagggaaacttccttgctaaccttttatgatatttagagtttctaaatgtgaatacgtaatacatttagaaatcttagttaataagaaaagcctctgttcctggcctcttgctggcacatgtcaggtggaaatggggctgtcatgctaatgtgtgcaaactgagaaaaatccaagaatgggagtctgcttttttcatcatacaaataattgttaatagaaacagtatgataattgctcattgatataccatgcatattctattagataataataaatttctgaaatttgaactatacttacacatggaaattgaaatatatggatgaaacattgtggcttatataggcaattgttttattggcattttacaaactgatcatcattcctcatggcacgggtccatgtgatattaagtagcttgttatgcttgggaaaggcagtgatgaccacaagaatgacttcaactactaaagtacaatggagatttcaacaatgttttgtttaatatttaaatatttcattgtgctcccaggctttttctcaccctaatagctctcatccatatcatgtgggtcccattaatacagatacctccgaatgcaccactcttccattatatccagtcaattgctggttaccttgggcctaccaactgggggagggcaggggctgctggccacctcctcatctacagtaagagtcaatgagcagttaaatggatactgaaaaccatttatcctgctggagtgagaaataaatggtttctttcaatagcgtagtaaaatgcatcttttccaaactatttatatgactcaaggcccatctcaatttcagatgtggttagcctcaattcctgattctcaccaaggtgtgtaatgtcatccacggcccagtgcagaggaacacaggtgctgccgtcagactgccagggtccgatcccgcctcctcactcaccccgggagatccctttaagccaggagtcaacagtgaggatggaaacatgagtgctttttaaagtcctgaaagttcagaggcagactgtcaatttctcctccacccctgggcacacaccaggagaactctgtctccaggttggaggaagtgcctgtgagagagttgtgtccctcagattctgttcaccacaggtgacactcgatgcaaccccaaacctcttctgcacaatcccaaggggtgctgactaatccaacccaaaggctgtgatgtttggcagaggcagaaaagaaaaggccaggtgttctgggaaagaccacctttaaataacacagcaccctcatagcccagagagacagttccaactattatgccaataaacccggaaaagaccaaatccaatatgacacatatttcctgtttcgttttgatttcatgccccctcccttaacctcccaagcagcatggataccccgaaggcccctgggaactctctccaattggatcttacgtggaaagcagttacctacctacaaatccccatcatcagatatgctctccacaatcaaatctttagaaacacaaacaccaggataagtcattagagagaggcccacccactcctcccaccctagctgaagccatggtgcttcgcacaggatcccctggtgtttcctctgggctcacagatatccctacagcctctctggacatggttttatacttgcaaaatcatttgctctcaccagaccccaaatcctccttcccaaaaggagcccagaatcaggtttctgtaccctagagatggcgctttttcctcaggaagtgagttatttcagggtacgtatcattctccagtgtcaatggctcctgcaattatagaaaagaaaacattaggagggtgaaatgatgccatacacgtcacacagatctgatagtctctcgacaacttgagagagaaaataggaaggggtatagtgattgagtcaaaggtcgaagtcccccaaaactggcacggaagacacctgtggaaaagacaagaccttttcccacagaatttatctttaaagtgtatctagattggcagtttcacaactcttaatccatgggggaaaactgctgtggagggaaacacctctgcattgcagtggatcgtggatgctgccatctaccacaccccagtgtgcctggcatgggttggtgagaggctgccaatcaatagcaccacaccaagggaattgcagatgtcataaatagtccacattggcagatgttcatgtctacatttgattaaactgcagatgacatcgataatgcacactggcagatgttcatgcctacatctgattggaaagaagccaggaaagtaacatttctgttcaagacaaagaaaagtgtcttacattggcagcatcttcttttttacagatgtcttgtacagtgtcctcattagcaatgtcatatacagcgtccttattagcgaattcgtatacagcatcctcattagcgatgccatatacagcgtcctcattagcgatgttgtatacagcgtcctcattagtgatgtcgtatagagcgtcctcattagcgatgtcatatacaatgtcctcattagcgatgtcatatacagcaacctcattcgctatgtcttgtaaagcatcctcattagcgatgtcatatacaacgtcctcattagcgatgtcgtatacagcgtcctcgttagcgatgtcttgtacggtgtccttataagcaatgtcgtctacagcgtcctcgttagcatgccttgtgggtgccattagcgatgtcatatacagcatcctcattggtgatgtcttatatggtgtcctcattagcgatgttgtgtacagcgtcctcgttagcaatgccttgtacagtgtcctcgttagcgatgccatatacagtgtcctcattagtgatggcttgtacactgtcctcattagtgatgtcgtgtacagcatcctcgttagcgtgccttgtacggtgtcattagcgatgtcgtatacagcgtcataattagcgatgtcttatacggtgtcatcattagtgatgttgtgtacagcgtcatcgttagcgatgccttgtatggtgtcctcattagcgatgtcgtatacagcgtgctcactagcgatgtctttttttatatatatatactttaagttttagggtacatgtgcacattgtgcaggttagttacatatgtatacatgtgccgtgctggtgcgctgcacccactaactcatcatctagcattaggtatatctcccgatgctatccctccccccccaaccccacaacagtccccagagtgtgatattccccttcctgtgtccatgtgatctcattgttcaattcccatctatgagtgagaatatgcggtgtttggttttttgttcttgcgatagttactagcgatgtcttatacgctgtcctcattagcaatgtcgtgtacagcgtccacgttagcgtgccttgtcggtgccattagcaatgtcgtataaagcgccctcattggtgatgtcttgtacagtgccctcattagcgatgttgtgtacagtgtacttgttagcgacggcttgtagggtgtcctcgttagcgatgtcgtatacagctcgttggcgatgccgtgggcggcgtcctctttggcgatgccctgggcggcgtcctcgttggcgatgccctgggcggcgtcctcgttggcgatgccctgggcggcatcctccttggcgatgccctggacggcgtcctcgctggcgatgccgtgggcggcgtcctcgctggcgattccgtgggcggcgtcctcgttggcgatgccctgggcggcgtcctcgttggcgatgccatgggcggcgtcctctttggcgatgccctgggcggcgccctcgttggcgatgccctgggcggcgtcctccttggcgatgccctgggcggcgtcctctttggcgatgccctgggcggcgtcctcgttggcgatgccctgggcggcgtcctccttggcgatgccctgggcggcgtcctcgttggcgatgccctgggcggcgtcctcgttggcgatgccgtggacggcgtcctccttggcgatgccctgggcggcgtcctcgttggcgatgccctgggcggcgtcctcgctggcgatgccgtgggcggcgtcctcgctggcgattccgtgggcggcgtcctcgctggcgatgccgtgggcggcgtcctcgttggcgatgccgtgggcggcgtcctcgttggcgatgcccttgtcggcggcctcgttagcgatgtcgtgtacagtatcctcgttagcgatgtcgtgtgtggcgtcctcgttagtgatgtcgtgtacggtgtcctcatggggagctagaaaaacacagagttaaggtcagtgccctggtggtggagactgtgaatcacccaggggcttgcttggtgtgatgtatggaggtggctgatcacagcatgggtcaagctgatgctgggacatcctcccaggtggacctgcactagtgaagctaagggatgtggctcagaacactttctgcagtgggaatcagtttccaggttcaggtatgcattatctggtgaagtggggaaatataaaaaataaaaattgacaaattcatgaaaagccttccatgagtgcaagtgtgagttttttatccactttacattcagtatgcattcacacatacaaaatatttttacaagaaatcagaaattttaatttttgtcagttatgtgaaatctaacttagctgccagcataaagattctatctcatttacttggtctcgagaaaatctagcacatagtaagtagaccaaaatgtttattaaatgaaaacacagagcagagataggggggctgctaggcagactgggttgcacctgattacccggatgataataaactgcacaaaacctcggtcaaattaatattgaaactgccttttgcttgggctcgtttcccttgcggaagaaggatgaccaagaagatgaacaggaaagaaatgagaaacagaggcctttgcttagtagctaaaggccaccttctgtaacatgaaatagtctacaagtggccttgaactctgccgtgatttagtgacagagttccctcatgtcttctacccaggttgaagtccagcaaaattgcgactgtcctctttacaacttgcgagaccacactgcttctgcatttgcctgttgtatgtatgagatttacacgtgttttaaagcaacattttgtttcagttgggctggtggccatacccggcactagccggtcaatagtgagatggctcctcatggaggaggcttggcttgaggctgagggtctttaacccacatatacaagagagttgccactaagggatggaagccaggctaataaccaagtgccacacagagttcctatctgtccctcctcaccatttttggctggcaggatttgagcattttagggcttgggaagatagtattactaaatctactaaaatacatcacccatccttatagactttggccagttgctgagcaaattaacttcacaactgaagtgggccacactggcctttgtggtcccccactcctcttagaatttgtgagcgtggggcctactggagggtgggaggtgggaggagggggtggatcaggaaaaataactgatattaggctcaatatatgggtgatgcaataatctgtacaacaaactctcataacacacatttatatatgtagcaaacctgcacatcctgcacatgtacccctgaactgaaaagttaaataaaaaaagggatctgtgagctgagccaaacacctggggatctttgtgcttttgacacactgatgactatgccggtccgtggggagatgagcctataactgccctgggttgtgtgaccacggaggccactttatgatgatgggcagtgtctggggcctcttgggctcgttgctttagggcttatacatgaatgctggactccgtgtgtggtggtgaacaccccatgactaagtgcatgtcagcgtcagcactggtccacactcctgggttcgtgttttcactgtttcattcaggaactcgggagctggggccactcccttggcccttcacgttctccacctgagcagtggggataataaggcagacccggggatggctctggtgagggtggaggagtcactgtacagagagagtagagcgggggtggattttattgttagaagtggacactggtgattgggttgtataagtgggaaatctctcctgagaaaacacacagcctcacctgtacagaaacacacacattcacaccacacgatgcagcctcacacaagacaccaccaatcctcaagcacccaactcagcaccacccaaaagggagcacagctgcttcctcaaaatttggccataatttttccctggggaattcaggttttaaaaaaacacttcccctatacttattcctatcacaatcccaggatcagggaggctcttcacattgaaaccaggcaaggatgccacacctttcttggcatccagattgttttcttggcaagtgattccagaatacttactagattcaagcctcagaggggccacctgcaccacctgcaatacagaaacaaagctttttcaggggtatgtcatgttgtggattgtttgcacaaggctctgtttctctcaatgaatactgaaaacttgatcagaaagtgtagtcaacttcaaggcctccaaaacaagggtaggatacacactggaaaagacatcagcttctggatggtggatctctcaggtccacgtaggttggcaagtgcaaaatcctgaatccaaggagaagacattgcttccaaggacaaggaccccaaggatacagtctacaacctgaagccgtcatagctaaatgccattttggattacatatcagttgctaagagtcacttcttcctccccctcagaaaactgcatttaatacctgtcatggacattgtcattttttcacatgtaaagtcagttgaaaaagaaagacaccaagaaaggaacatttctatttcagagaaagcaaggcaaccttaccctcgcgttgactggcctctctccatctcctctgtccttgtgaactagagactcctcagaggctaggaggacacagagcaacagttagtcatagatgcttttgttcatgagttattcagggagctctgcttaatgtggacaacaggacagtgtgtgtggatgtgtttcattaaaagcacagcttgagctcctgctagaaaatcttccctcgtggaaagacaggcaagaacgaggagctaaggagcaagaaatagagtccctggcattttgctgatggcaacttaagaaaatgggaatgagtcagtctacaaatggtactgaagcacatgctatagtttgatgagagtcccactgctcacactgtgaggtttgaaacccagctaaatggttttctaaacctgtaaaaacaatattagcttgcaggatttatgtcccaagactacttttacctctgaggatccacagtggctgtcactgcagttatgtgttttagcattttgcacttgaataaaagcaaagtttaatagatagattggattcaattctaggcaaaacagtctatggtatttattcactaatcctttgttataactgctgatgggagaattagaagtactgaaattatatcctttaaaattaattaaagcataattattaatcacacaatattttttcatccaggcctccttttctttgtcatgcatgcatattaattgaggatggagaatatctacgcttgttcaggccagccaacatacgacagtttacttcaagagaggagacacgggttgaatgctggtgtgttttaactctgcagcgcaaacagttgcaacaagtgtggtgaactaatcaccagatggccctttgctgccttatttgtcattgtgccttacatgtagcttgcaggatttgattacgcttatgttttgtggtgatcatactttcaactattcctaaaatactgcttcagtcttatctgtttggggtcaactgctgaggatttcatacaaattaacgaagtttgtgaatctaaagttctacacaaaggtggaaatatttgcaaatcatttctcttgtaagagactaaaatttagaatatattttaaatatatttaagatatattcaaaaatctacaacaacaaactaactaaataaaaatcagacaactctttaaaaatgggcaaaagacttcaacatatatttccctaaagaagatacagccacagatagtagcacaggaaaagctgctcaggatcattagtcattagggaaatgcaaatgaaaaacacaagcagccaccaatatacacctactaggatgatttaaaggaaaataagtgtgaagaaggacgtaaagaaattgtaaccctgatacattgatggtagaaatggataaagttgcagccactgtgaaaaacagtctgcagtggctcagaaggttaaatatagaacccctgttggacccaggaactctactcttaggcaccccaaagaatagagaacagaaatcaaacagatgtttgtatactaatgtttgtagcatcacttttcacaggagccaaaaggtggaaataatccaaccatcagtgaacaaatgaatgtaataaaagcaaggtggtctgcatgcaatgctacatcatccatctgtaaaaaacgaacatcattttgatagatgatacaacatgggtggacattgagaacattatgcttagtgaaataagccagacacaaaaggaatatattgtataattgtaattacatgaagtgcctagaatagtcaaattcatacaagagaaagtgggataggaatcaccatgggctggaaatagggggaaggtgctatactgcttattgtggacaaggtttcgtaagaaatcatcaaaattgtgggtgtagatagtggtgttggttatgcaaccctgtgaatatattgaatgccatggagtgcacactttggttaaaaggttcaaatgataaatattgtgttatatatatttccccacgatagaaaacacgcacagccaagcccacatgccagtcttgttagctgccttcctttaccttcaagagtgggctgaagcttgtccaatctttcaaggttgctgaagactgtatgatggaagtcatctgcattgggaaagaaattaatggagagaggagaaaacttgagaatccacactactcaccctgcagggccaagaactctgtctcccatgctttgctgtcctgtctcagtatttcctgtgaccacctcctttttcaactgaagactttgtacctgaaggggttcccaggtttttcacctcggcccttgtcaggactgatcctctcaactactgaccatttcacctccattcatgtccatgccacatcaggctgtgttgtctagatggaatgaatccatcccaaatgtccctttctggaggaagccaccattatgctgtacctccaagcataatggtacgtccacacacaccagggcacctcgctcatgcaaggtgcgtgtcctctaacaaagtttcacgctctaaacccagataacttttcaaacccaagttctgttgattcccctactttgagtgctccatagatgctcatttgtctactaaacactgccccaggcaattaaatattccaaagtgaccagcagaatttttatgttaattctgacattgcgttgttagtacaagtgttgttcccccttcaaatttatgtctttgttactgataaatgtaactgataatgcgtttttcagctatgttgccaagcatatttatataaaaatatactcagattgttttcagaatttgacaaagatgatagcaacaatgataatcttatttgttttataccaatctttatgtgttattttcatcatttcttacatattggggcctaccatacattgtacggtgaaattagtgctatgcatcatggtagaaatataaattggcaaaagtaatttagaaaatagttcccttgtttcttaaaaaaattaggctgggtgtggtggctcatgcctataatcccagcactttgggaggcagagatgggtggatcacctgaggctgggagtttgagactagcctgaccaacacagcaaaatcctgtctctactgaaaatacaaaaattatccaggcatggtggcgtgtgccagttgtcccagctactcgggaggttgaggcacgagaattgcttaaacctgggaggtggaggttccagtgagccgagtttgtgccactgcactccagcctgggtctcagaaaaaaaaaattttttttgaccgaaatgtcattatgcattacatgactgtatatgaatgctcaaagctacattactcatcaaagaaaataacaaaacaattaaatgtccattaactgataaatgaataaacactatctgtatgagtaaacacagcagactatgaaggaaaacacatgaccagcacgtgctaacacgtcaattaacttcaaacatagtatgctaaatgaaggaagtcagattccaaatatatatatatgtccatttctattaagcaaatgggaaatttatggagatggaatgtcacagcagtattgcttagggctggagatgggagtggggattaactgccagtgcgcaagagagaacttgggtgagggaaacatatttaaattagatcgtggtgatgggtgcacacagtatcaatttaataaagcatcaaattgtagaccttttcagtgggcaaactttatggtgggttcacacccaatataggtgttaaaaataaattaatgttacggaaattcttgtcgggtttttaacaagccaagagatatgctgtgaaagcagcattaattcaaatggttgtcacaggtcacttaaagttagatagttgtcctacaaatatagggtgaatgttattcatgaatttcctgaatctattgcaataatcacatttttttccattaaactcttgaggtagctaattttatttattgcattttcaatgttaatctactatttcatatattgagattaactcacattagtcagaatttacagtattttaaaatatcacagaatttaatttaccttatctggttttggtttcaagactatactagccatttcatttaattgtacatgtagggtattctaatttatggaaaactattacatcttccttgatttttttttttttttagaaattacttctagggatctatatggtagagtccatggagaattgttttaattcttcattcatgtcttcagtgggtataggattggtcatattggtcatagttttctgctcggatttcaataagaaacttgtggaagaacctgaagggtgggatctttgagggagcctaagacagagcaagacaagctaagaaggagggcagtgccacagcagaactgccgttgatgccccctcgcctagattgcggaagagacatccagctgtagacactgaggtgcaggaaaacaatggagcaccatcagagaaagcagtgcccaggaacaaggaggcactgatggtggcaaggggcaaagacagctgccacgaggctgttcacatgagggtctcaggctgcatagacacccacaccagctgaggggtcctggttttcataaagtgtgtggctcagccaggccaccaacaagcagttcacaaacagtagtaatacgacactttccaaagaccttacttgagtaacacggtgatcctcacaaatttccaatcaggatggtcgcacagttcctcctgctttaggactcagagcctgcccgtggtcacagtgggtaggtgcagactctgaagatgcactttggtcagagaccctgctgaactctgtctgatgaggacctctgtcctgtctgctgaccaccagtcagaggtgcaggctgcagtggggagtaagaatgccaccttctcaatgttgggaaaactccctgccagaactgagaatggccctttctaagcagaaggcaagctcagactaaagaaggaggccgaacacatcaggttggcagattgccaaagattcactcagggagagcccacatcctgggccatcttgggtggtggcaagatgaggtagacgactgcttttgcaacacatacctgacaacaaaaaatcaacaactgtaaaagagccacaaaatccccaaatatttgcaaattagcaatgcacttttaaataactcatgggttaaagaagaagtctcaatagaaaattaaaagtacttttaactacattaaaagaaaatgtgacttggcaagatttctggatgtagcaaaagcagtccttagagggaaatctatagcattggatgcaatatactaaaaatcacaagacctaaaatcagtaatatcatgtttcaattagggaactatagaaaatagaggaatgcaatggaaagcaagtaaaagtaataaacaacatcacagaaatcaataaaattaaaacactgaaatcatcagaaaatcaataaaaccaaaagctggttctttgatatgctcattacaatgaatgaattgatatgcaggctaaccaagaaaaagaagataacacaaatgaccaatttcagaaataaaagaggagccatctctactgaactgttaggcattaaaaggaatatcatgaacagttctatgaccgcagtttgataacctcagtgaaatgtatcaattccttgaaaggcaatcttcccaaggtcatgctaggatcctaatttgaataaacttatgtctattaaataagttgaattcacattaagagcattccgaaaaagaaagcaccaggcccagatggtttctctcatgaaatctaccgaattcttcaacaggtgaataaaaagacaaaaattcattgaatgcaatattatttggtgatttaatgtgccattttttgccattaaggcataaaaaagacatgaaagcagctaaagcgtacatcaatttagtgcaataaattcatctgaaaaaactacataatatatgattccaactatatgacattctggaaaaggcaaagctgaagcgatagtaaaaatattaatagttgccaaggtttctggagaaagaggacagagattaatgagaagagaggatttttagggaagtgaacattttctttatgagaccataagggtgaacataatgttttaaatatttcaaaattcatatatatgtataacagaaagaatgaacattatgcaaatgtagacttcagataataatgtgtcaatattttctcattattctagcaaatgtaccacagtaatgtaagatgttactaataggtgaaattaggaagtgagggtgaggagacagaataatatgggaacttcgtgtattatatactcaatttttatttatgtatttatttatttatttatttattttgagatgaagtttcactcttgtcacccaggctggagtgcaatggcatgatcttggctcactgcaacctctgcctcctgggttcaagcgattctcctgcctcagcctcctgagtagctgggattacaggcgcctgccaccacacccggctaatttttttggatttttagtagagatggggtttcaccatgttggccaggctggtctccaactcctgacctcagatgatccgcctgccttggcctcctaaagtgctgggattataagtgtgagccaccacgcccggccatatgctcagtttttatgtcaatttaaaactctctaaagaaatatattaattgaaaaataataatatagcaccactctttcagggagatctatgcttatgtttaacaaccaggtaagttctagacattagcttgaaacattgtctatcattaaacatgaaccaaaattgacttttaagtagatatttacttttgtggtggtagcaatatttactgaccaggcaaattagaatcctgacacattaaaaaatatggcttagtctcttcatagtttcctcttacatatgggacactgaatactccccgcaactgcaattcttgaatcaacttaattaatgaacttccacagtaccttcttgtgggtacctcttcttctttacccgggagccatgaggtctcctacactggttggtgtgcacagcatatcttcttgtattctctatcagagaagatgctggttaatgcattgacaatagatagggctgttgacatcttgctgacagaagaccagagggaaaatagtgataatctgttctaagtttaaacttatgatccttttctttacaggcttccaagcagagcccactgaatcaaagttgggtttcaggaagatcacggagttcagtgagcactcaacacctctatcagacagactgcgtgggcagtgccttcctggagaggagaacacagcaggatgactgtgagtgcagggctggtgcagagtgggggcccggattcaaattccactaagccatgtggacctggcaagctcatgtcctccctctgccctcagttctctgcactgtcataatgtaattttagcaatactttttaggccctatttaagccctacttcttagtatcacagtacagggctaaaaaatcactaaatacaggaaaaccttagagaggactggtacttcagtaatgttctctaagtgtttactacatgccaggaggaataagctggacacttagcagtggcggaatatggagggggaacttgcatgactccggggcagtggagcatgctttcctgttcggcttttccgtgggcatgacgccttatggtttatggagaacatcagccctgcagggggtgcagaggaggggctgtggctgagattttacacttgagggtgctgacattcagagatgataagtgacgagcagaacctcaaccccgctgagtgaaggacctgagatgggaaatgtatttggttccctagagagagagattcctgaaaaactgccacctcttcatcacgccctgtgccagagacccaagagacccctcactgtctttctccagtcctcctagcccaaggtgtgtgggtggacaaaggtgatgctctggaggaaatgcctgagataaggacaggtccttaatgataaagaattctccttcctctttcagatccttgacctcccagtatgacagcttaaaggctgtcatctctgtggcctgcctcccctttcccttcaccctgccagctgcctctcagtgactgtctcctccagtgactacactgagggaccagggactgcttgcctcccgaggctgctcagaccttccgacaccacaaaatgattgtcaaaagatgggtctgcaaagagtaacttcccttccactgatcaaacctgaatatgcaagctactgtcaattaactggaaaagtggccgtgtgggctggtgctttggtgatttaatgaattaagtctgcaagccccactgcctccttgactattgatcagagctgcctgcaataaggtctggctaagaatgggcagtggctgcaccagctctgggtaaaatttgacctaaaatgaccaatctcattcactaaccacaccatagtcttatgggttcaatggacctgtccaatcctttgctctgttctctccatcaccttcctgtgtaattttcctccaccacgcacataatagaaacatggcacaggggagctaatcgcctcttttatcccccacttcaggctcacacgtaagtttatagtaaaagccttttcaaatgactgctttaactgctgctacagcatgtgccatcagttgaatggaatctgtcacgtgactttaagcaaccctttgctgagagacaagattcaatactagggacagtattctagtgtactacatcattgattttatgttatgaagatcatcatttattgaaaatgtataaataacgaagcccagccttactcttcaacgctgtgtgtgtaaatccactgagtgtgctgacccccacgcttgtacccacctgctaacacagaaagggtccactcagaaggcaggcacagctccagcactgaggctgtccacaccagcttcacaagagggttgccacaaggacgacggatacccggataacaaccaaatggtaatttgagtacttaatggtcatgatccctaaagtgtgtagctcagagggcttgtggtgataactccatcaagactctaaagcatctccccaattcttactggacttgatccatgtcttgaggagacccagctatgacacgcaggcaccacattgtcctacttagtgcctcccttagtgtttcagaacctgtgatttgatcagaaacatgggctttctatgttggtttcacactaaggactatgtgacacctgcaggaagatgtctacatagctacctggattatgagatcatgaggctgtcttatgtgagggatggcatttgggatctctgcaggtgtgggtaattccaggcatagagggtgctggaactcccttgcatggtgaatagtgatctcttcactggctgataaatagaggttgtagttcaggccttcaacattagcactgtatgaggaaacattttgactcttcactatgcagcaagtgaaccagggcacatttatttatgtggcttagtttctccatctggcatgtgggctcaataaacaagctcacaacatatgggcatgatgatgatgaggtgtgaactaatgtaagtaaagtatgtggtctgatttgttaaattaagaaaaatggcactgagagttgtgctgggtaaacacaacatttttttcctaggggaaacacacatagacacacattcacaagcaaatcatgcagacttgcacacagaccacctcaccccacccccgccctaatacacacatacccacacacaacctaatgtgaacatgttcccagaaactatacatagataaaaagagtatgtcaccaggaaaaccagtttcttttactataccctacatcctcattcccaccagatgtcttggatcatggaggctctccagacaaaagccagcagttaagctccagatttcctgtagaatccttttctaacaaccagtgagtgattccagaatacgtaccattgaatgtgctccctgaagtcacctgtaattagagaaggaaaacactctgagaatcaggctatgctatggatggctcacacaggtcttttgttcacttggaaactctgggtaaccaagactggaaataaggttcaagtcaaaagccccaactgtagagtagagttcccttaggaaagcacaggagcttttcttgaagaatgtttctgtctaggtaatttttgagtagcaattgcagaattcttatctaaagtggaaagcttgttcctgaagaaaacatcccttaacacccagtgtactatctgacactgccaattttgcacgtcctctggaatcaggtgtcagttggtaaaatacacctcctccatccccaaggaaatattatctaacacctataatgtagtggagaattttcccatagctgatatcaactgaaaaataaaggatccaagaaaacaacatttacatcttaggcaaagacaggctactttaccttggtagtagagtagggcttccttttcacatgctttttggaaggcttcttcgagtcacctaggggatgtggagggacacagcatggctgtcagttcattggcagtgctactcatgaatgactcagggactggaacttaggggcgtgcctggttaacaggcatggaatgagcttctcctggaccatcttcttcacggaccaaggaaggcaaagaaagagcagcaaggaaatgagagtagagcccttggctttccaggtaatggcaaatgaaagcaacgtgaaataatcaactccaaatgaacaaatgctaaaatacatgctaggattcaaccacagcatcctgtcacttcttcagaccctttaaaagcccagcaggactgccactagcttcttgacatctaccaagtccctttcaacctccacagacccacatacactgctactgcatttatcatggagggtatagggttctgccttgtttatgtgtgaattttttaaaaactagatttaataccatgcaccagcattaattgtatttatttcttttcttggttatgaaaataatcagtcaggcatagtggctcacacctgtaatcccagcagtttggaaggtggaggtgggtggatcatttgaggtcaggagttcgagaccagcctgaccaacatggtaaaaccccatcattgaagataaatgttttatatccatggttaacagatgagatgactatgaaatgaacaccagtgtactgggtggagcagcttatctattcagtcttcggcactaaaacctgtgaaacaatatcatcttgccttatttactaacaaatacaagtgcctctaaacttagacagtttccaagtcatggaactgatgagcacttagctcctgcagagagctctggacgatgggtcgggagaacaaagacacaatacatcaaaacagcattcacaagtaaacaggttttcaaagccctctacatgcaaatttacacaattatccttttaatttttatcttcatatatatgtacataatctacttgcttctgagtataaataaaactgtatgttcttagttaatagtctctataaattcactctatttatctttctgagttgaaatactgcatctcattggataacaaaaaaaaaatttgactaagattacactggaaaggtgagtaggttgggtgattgactgtgattgacaattccatgattctggataacttccaaagcataaaaataaatgtgtgttttctttcacacgtagacaatacacatacttattactttaaaaaattaatatgtgcatggaagtgacttactacaaatatattaaagtaaatacacatttcacaaaaaaagaagagaggaagggaaaaacatgttaaaaacaaagagaggtacattttattgtgtgaaaagcctccaacggatccatactactgtggctttgttccaaagttttggaaagtaatgatttcataggttcttaattgggttaaaaactgcattaaaatagactttgccatattctcccctggggaataacttaatctgtggggtgggggatggaacgttgaaggatgcaggatgtaaaaggaaattatatatatatatataatttgggaatttgggaataaactgaataaactgaatcccaattcacactgggactacaccagctgccaccatgcctggctaaatttttgtatttgtagtagagacagggtttcactgtattggccaggatggtcttgatctcctcaccttgtgatcctcttgccttggcctcccaaagtgctgggattacaggcctgagtcaagatacatattttttaaatgaagaaaaatttcaaagatactctgcttggtacaataatcaaatatataaattgaggaataaaacataatcatgaaacatatttataactgcatatggaaaatacagaggctaattttttaaataacatattttgaaagcattaactagtaatttgaaaagatcgcatttgacaggccagtatgaacataccttgaatgcagccacacaggttccccataagaaaaatcaaaatcagggaaaatgaaaccacaatggttcaatctgctctgacctttgaaaaactcagcacagatagtggcacttaggaccaagggcagaagatccctaatcccatcaccatggcgatagggcataaacattccagggtgaaggcacaatccacactgtgaggtccaactgctgccatgcagacaggtgggcttttacaagtacaggaaggtcatcaaaggctcagtgttttgtttcaaaaactgaatcccaagcccacacattattatgctggcttcttaaaataagttatgagacaggaaatagggcacccacaaatatatatatatataattatatataatataatatatattatatatataatatatttaatatattatatatgtattttatatgtatatatatataatttgggaatttgggaataaactgaatcccaattcacactgggactacaccagctgccaccatgcctggctaattttttgtatttgtagtagagacagggtttcactgtattggccaggatggtcttgatctcctcaccttgtgatcctcttgccttggcctcccaaagtgctgggattacaggcctgagtcaagatacatattttttaaatgaagaaaaatttcaaagatactctgcttggtacaataatcaaatatataaattgaggaataaaacataatcatgaaaaatatttataactgcatatggaaaatacagaggctaattttttaaataacatattttgaaagcattaactagtaatttgaaaagatcgcatttgacaggccagtatgaacataccttgaatgcagccacacaggttccccataagaaaaatcaaaatcagggaaaatgaaaccacaatggttcaatctgctctgacctttgaaaaactcagcacagatagtggcacttaggaccaagggcaggagatccctaatcccatcaccatggtgatagggcataaacattccagggtgaaggcacaatccacactgtgaggtccaactgctgccatgcagacaggtgggcttttacaagtacaggaaggtcatcaaaggctcagtgttttgtttcaaaaactgaatcccaagcctacacattattatgctggcttcttaaaataagttatgagatgggaaatagggaacccacaaatatatatatacataaaattatatataatataatatatattatatatataatatatttaatatattatatatatattttatatatatataatttgggaatttgggaataaactgaatcccaattcacactgggactacaccagctgccaccatgcctggctaattttttgtatttgtagtagagacagggtttcactgtattggccaggatggtcttgatctcctcaccttgtgatcctcttgccttggcctcccaaagtgctgggattacaggcctgagtcaagatacatattttttaaatgaagaaaaatttcaaagatactctgcttggtacaataatcaaatatataaattgaggaataaaacataatcttgaaacatatttataactgcatatggaaaatacagaggctaattttttaaataacatattttgaaagcattaactactaatttgaaaagatcgcatttgacaggccagtatgaacataccttgaatgcagccacacaggttccccataagaaaaatcaaaatcagggaaaatgaaaccacaaaggttcaatctgctctgacctttgaaaaactcagcacagatagtggcacttaggaccaagggcagcagatccctaatcccatcaccatggcgatagggcataaacattccagggtgaaggcacaatccacactgtgaggtccaactgctgccatgcagacaggtgtgctttcacaggtacaggaaggtcatcgaaggctcagtgtttcgtttcaaaaactgaatcccaagtccacaaattattatgctgtgcttcttaaaataagttatgagataggaaatagggcacccccaaatatatatatataattacatataattatatatatataatatataacatatatataatttccttttacatcctgcatccttatatataatattatatttaatataattatataatattatattaaatataatatataatattatatataatattatatataattatataattatatatgaaatgtaataatgtataattatatatgtaatataataaagtataatatataatatatattatatattatataaaatattgtataatgtaatatgtaatatatagtatatcatagtataatatattttataatataatatattatatattatatatgattatattatattatattatatattatataatacatgatatattatggtatattatatataatatatttaatgtaattatatataatataccataatatatatgatatatgatatataatatataatatatatcataaattatatataatacataatatatatcataaattatatataatatataatataatataattatatataatataatatataatatataatatatcagatataatatataatatatatcagataaaatatataatatacaatatataatatatatcagatataatatataatatatatcatatattttacataatatatatcatttattatgtaatatatatcttttattatatataatatatatcatttattatataatatatgatatatcatatatgatatatatcatctatatcatatatgatatatatcatctataccatatatgatttatcatctatatcatatatgatttatcatctatatcagctatgatatatcatctatatcatatatacgatatatcatctatatcatatatacgatataccgtatatgtcatatatacgatataccgtatatatcatatatatgatataccgtgtatatcatatatgatatatcgtgtatatcatatatactatataatctatatcatttatattgtatataatctatatcatatatattttatataatctatatcatatattgtatataatctatatcatatatattgtatctaatgtatcatatatattgtatataatctgtatcatatatattgtttataatctgtatcatatgtattgtatataatctgtatcatatatattgtatataatctctatcatatatattttatataatctctatcatatatattgtatagaatctatatcatatagtatataatatatatcatatattgtatataatatatatcatacatattgtatataatatacatcatacttattgtatataatatatatcatacttattgtgtataatatatatcatacatattgtgtataatatatatcatacatattgtgtataatatatatcatacatattgtgtataatatatatcatacatattgtgtataatatatatcatacatattgtgtataatatatatcatacatattgtgtataatatatatcatacatattgtgtataatatatatcgtatatattatatacgatatatgtcttaagtaatatatacgagatatatcatatatattatatatgatatatatcatatattaagtttggggatagcccagaattatatatggattttcaactgcacaggagctggtcccctaacccttgcactgttcaaggatcaacagtatgtataatactatagatttttttcatattttagagtgtagtacttctactcattaaaaaaaattaactataaaacagcttcaggaaggtcttccacgagttcttccagaagaaagccttgttatcatagagaatgacagctgcatgtatgttattgccactgaagaccctgaagtcctttcacttggacaagatttcgagatggaagacagtgatattgattatcctgacccttacagggctaagctagtgtgtgtgtttgtatcttagtttttaacaaaaatgtttaaaacataaaaaatcaaaataaatgaagcttatcaaataaggatataaagtatttctgtacagctgttcaatgtgtttttgttttaagatgtgttattatcaaagaatcaaaaaattaaaaaaattaaaagtttataaagttatgataagctaagatgaacttgttaaagaaaaaatttaaatacatttagtgtagcctaagtgtacagtgcatataaagtctatagttatgtacagtaatatcctaggccttcgcattcactcaccaagtactcactgactcatcagagcaactgccagtcctgcaacctctgttcatgctaaatgtcctttactggtgtaccactctctttaaattttgtaatatatatatatttttttctttgttttttttgagaaggagttttattttgttgcccaggctggagttcgatgatacgatcttggctcactgcaacctctgcctccggggttcaagtgattctcctgcctcagcctcacgagtagcagggattacagccccacgccagcacgcccagctaattttgtatttttagtacagacggagtttctccatgttggtcaggctggtctcgaacttctgacctcaggtgatccgcccccctcggtctcccaatgtactgtgtttttactgtatcttttccatgtttagatattactactgtgatataactgcctacagcagtgggccccaaagttttgacaccagggactggttttgtgaaagataatttttccacggagtggggatggctttgggctgaaactcttccacctcagatcatcaggcattagttagattcttttttttctttttttttcttttttagactgagtctcccactgttgccaggctggagtgcagtggcacaatctcggctcactgcaacctctgcctcccgggttcaagtgattctcctgtctcagtcccccgagtagctgggactacaggcatgcgccaccacacccagctaatttttgtatttttagtagagacggggtttccatgttggccaggattgtcttgaccttgtgatccacctgcctcgacctcccagagtgttgggattacaggcatgagccacagcacccagcctagttagattctcataaggagaacataacctagatcccttgtatgggcagttcacaatagggtttgtgctcctgtgaaggtctaatgctgctgctgatctgacaggaggcggagctcaggcagtaatgctcggctggccagccactcatctcctgctttgtgcccagttcctaacaggacacgaaccggtgctggtccatggcttgggtgttggggaccattggcctactgtattcagcacagtgacatgctgcacaggtgtgtagcccaggagcaataggctgtacgatatagcctaggtatgtagtaggctacgctgtctaggtttgtataaagtacactctttggtgtctgcacagccacaaaatcacctaatgatgcatttcttggaatatattaccattaaatgagatttacctgtattagtgtcatctcaggtttattgtctagtaattttaaaagtatttgtatattctttcccagacacatcatcatactctggtgcatatctctattttattccctagacccactcttaatttttctgcattctgctttgttccttaggaggctcacctgaattggatacttcagagatctcccttaccctcatgcttttattggggttcagctaatggagggggtggcagaagataggtgagagaagagtgtgtttatcccccacctctgcccctgcagggtcagcacaggcagactgtgtccctttgctgaagatcacagcttctgtctggtgccttctttggcaagctggcactgtctctagtcagatgactgcttggccccttactacttacactcttctgtctggtttctttgtgactttcctgctgtgctgtaagtagtccctttattagaatccatccacattacccagttatataaagacaaatagttggtcactgatgtagttcactccctgagaatcagccttcatcaaagattcctaacagtcagatattctgttggccgctccattcctgctccccattattctagttgtgtcttccttgtctctagtgcagtcacaaagcataagcgcctccactgtcacttgttctttgcaactctaggatcacatcattccccttgaaatcagagaatctgcaatctccccaagcccacaaaattcagccgtcacagtacttttcaagcatgccagcagccctccccaacaaacgaatccttaatttcttacagaaacatcttctgggcttcctgtgggacacagtgcgggtcggcttggcatgtggatcacacctgatatttttacccccacctcctactattcctattcctttgtatgcacctctctttattatgctaggaaagctctggcaacacaacctcaaaataagcaggccagtgtggattcacagtttctgtcagacaaacaaacttgagcaccacttctaacttcttgggctaagactttaacttcagaatctctatgtatctatgttgataaactcagcctatgtcaagattatattctgcatgccttagtcaaacaccatgtaaatctatgcctcatatattctctaggctttagctgatagggattagcaaagtagtgtggttgttttggtctttaaacaatgtccattttctaccagctttccattgcactcttttttttttttttttttttctgagatggagtcttgctctgtcgcccaggctggagtgcagtggcgcgatctcggctcactgcaagctctgcctcccgggttcacgccattctcctgcctcagcctcccgagtagctgggactacaggcgtgtgccgccacacatggctaattttttgtatttttagtagagatggggtctcactgtgttagccaagatggtctcgatctcctgacctcgtgatcggcccaccttggcctcccaaagtattgggattacaggcgtgagccaccacaccgggccgaatccattgcactcttacagaccatgttgacaaaattataactgcaacagtcaactacaatagcaattttacctctcatgtaccactttaaaaaacacatcattcccaataaccacatttgatgatttaagtaatcatgataccaccgtacactacagatgatcaggtttctgtctcctcccgacaagaaggtcaggaattcattcagactgaaacaggtcagcaaaccacttccagattctcatctataaagatctatttctagaaccatttctagtacctatacaatattagaatcaagtcaggaagcagaaaacattctagatattttaaacagaaaacaattcatggagagatcaattacaagagtatgtgtagcaaaagatgaaagggtcaggttgtttaagtaacttgataaatctctgcttcttttgtgttgggtgataaaaatgttgaccagagatcagtggcagatgatccaaggcgtcagctgtccaagctcagcatctggagccggtgctgaggaaatgtgcatttctaggtctgggcgccattggaccatcactactgtccttgaagctgccaccgtgagaactcacatctcagctgctatagccacagctgatattgtcattgcttccagaattatttcccttgctccatcgtggggatcccgcaatactgctgctgctgaaatcactgttgttgctccttccagaactgtcggcaccgcagcattattatcactgcagctaccactggagatggctacagacaccagaaacggaagagcacctctcccctcctccggcagtgtgactttcagtcggctcctctcgtagccagatggtatagaaatgacacaccaatgtccttcagaacatacatgcaaaatattttaaatatattagaaattctattccccttagaaaactaagtccacctacatatttttcaaaaatccatcagcaatacagaataaaggcattggttctatacagcgttgcaagaatattttaacaatagaaggtattttaatgtcattcaccacattaggagattgaaaaagggaaaacacaggattaccttagcagatgtaggaaaaaaataagatggtaaaatacaacattcatttatattaaaatctttataccaaactaggaaaagcagacaaatttcttaacctgataagcttatctataacaaaaccatcgacaccaccatatgtaatgttgaagcataatcgttattttttataaaagctaggaaagggaatgagatgtctgttgacactgctcgtatttatcattgtcctggggtttctggccagttcagttaagataggacaaagaaatattatagaaagaggaagaaaaaaagaaagcacatacgttgtcattgtgtggagtttctgtttgtttgtttatgtgtttttgtgagatggtgtctcactctgtcgcccaggctggagtacagtggtgtgatcttggctcactgcaacctcattgtgtggagatttgtaattacccatagaaaatccaagaaaatttgtggatgcactaatcaaatcagcaaggttttcagatatgaaggcaaagtaaagagaaaatgaaattcttataaacagtagcaaccaattaaaaatattatattataatatcacattcatggtaacataaaacattaatgtatctaagaattaattcagaaaacaaatacatgatctttcatttaattttattaaagttatttcaataaatataccaccagtatttttttagaacttgattggaaaagtcatattaaaataatcaatggaaaggaagaaccaaagttattctgaacaataatagcctatcaatatttaaatgtgttttaattataataattaaaatggtttgctttggctcagtgatacaccgttaaacaatgggaaaaaatggaagcaccaagaaatagatccatagatatgctgaatacattggacttgtaataaaagatatgatactaaaagtcagtagaaaaattatactattcaataaatgatgtcagaaaaaacatataaatttttatccatatagaaataaaaatctgtatattacagcatatcacaaaatcctgtatctatttaggttaaagactcaaatcttaaactacttgtgaaattacttatgaatattacatgtttaagatatttaaaagtatatacagagaactaatgacgttgggcaacaaatggcttattaatcaaatgccagaatgcatgaagaagaaaagaaaagaaaaataaattagactgtattaaaatgaaaaatcctaggcatcctaaataaaggttaaatgcaagccagaaaattgggtaaaatatttacaaaatatataattgaaaagtataatatccattatataaagaggatttctacaaattaatgatataaaataaataatatagtagaaaaaatgattaagaactactacacaatattcacaacagatgataaatagtgaattattgtgaaaagacaactgaaaagagcaaggtacaattcaacagcaataagactttatgcccttttctataaaaacacaaaactatgccaagggctttaggaaccgtgaatttatatacggcgaaggggagtttaaatctgccactttgaagagttttttggaaatatatagtaaagttgaaaatatatacatatgtgtatatatatatacccacacacatacacatacacactagaaattccacaaggtaaaccttctccaggagaatacacacacatttgcagaagagatgtccaaaggtgtttgttgaaacattattggtaatagctaaaaattggaaataatcttaaagctcattactaggaaaatggaaaagtgaatcgtggtatgtgcatataatgtaaaactatacatcagttaaaattaattgtctgaatttatatggatcaatttttatatattgaaacatcgttgcattccaggaataaatcccacttggtcatggtgtataatccttttaatatgatgctgaattcagtatgatagtttttttttagacaaagttttgctcttgttgcctaggctgaagtacaatggcatgatctcggctcaccacaacctccacctcccgggttcaagcgattctcttgtctcagcctcccgagtagctgaggttacaggcatgcaccaccacacatggctaattttgtatttttagtagagacagagtttctctatgttggtcaggctggtcttgaactcctgacctcaggtgatccacccacctcagcctcccaaagtgctgggattacaggcatgagccaccgtgccccacccagtatactagcatttttagagtttttgcatcaatgatcagaggcatattgatctgttgttttattttcttacagtgtttttggctttggtatcagggtaatgctggcctcatagaaagagttaagaggtattcactcctcttccactctttggaaatgcttgaaaagaatcagtgttagttcttctttaaacgtttggcagaactcaccagtaaagctatcaggtccaggacttttctttgtcatgagattgtcttattactgactcaattcccttactagattaggtctattctgactttctgtttctttataattgagtcttggtaggttttgtgtgtctaggaattcatctatttcatctgggttatccaatttatgagcacacaattatttatagtaatcttttataatcctttctaggctgggaatggtgggtcatgcctgtaatccaacaatttgggaggccgaggtgggaaaattccttgaggccaggagttcaagatcagcctggataacatggcaagatcctgtctcttaaaaaaaaaaaaaaaaaaagagctggcatagtggcgagcccaggaattcaaggctgcagtgagccgattgtgccactgattgtggttgcatctgattgttgccagggcaatagagctagaccttgtctctaaaacatagacaggcagatagacagacagacagacagaaatatataaagatattctcaaatacatttctgttttaagtaatttagattgtttcccttttccttagtcttgtcagttttattaatctttttgaagaaccaacttttggttttgttttttattgtttttctattctcttttccatttatctctgccctgatctctattgtttccttccttctgctaactttgggtttagttttattcttctttttctagtttcttaatgtgtaaacttatgttgttgaattgaggtgtttctttttttaatgtgtttatagctataaatttcctccttagcactcctttcaccacaactcataagttgtgtttttttgttgtttctttgttttttgagacagagtctcattctgtcacccaggctggagtgcagtggtgttagctcagtggtgcaacctctgcctcctaggttcaagaaattctcatgcctcagcctcctgggtagctgggactacaggcacgtaccaccactcccagctaatttttgtgtttttagtagagacagggtttcaccatgttggcctggctgatcttgaactcctgacctctagctatccacctccctcagtctcccaaagtgctgggattacaggtgtgagccaccacaactggccacagcccataagtttggatatagtgtgctttcattttcatttgtctttaagaattttataatttctttgtgatttctttgatccattggttgtttgagagtgtgttgtttaaattctactaatttgtgaactttttaaaatcttctgttattgatttctaactttatcctgttgtggtcagagaagacactttgtatgatgtctatcgttttaaatctactgagcttttttccttttttgggacagggtctcgttctgtcagtggtacaatggtacattttctttgtcatgaagtacaggctggagtacagtggtacaatctctgctcattgcagcttcaacctcctgggctcctaagcaattctcacgcttcagcctcccaagaagctgggatcacaggcacacaccaccacgcccagctaatttttgtatttttagtagagatggggtttcaccatgttggccaggctgatgtcaagctcctggcttcaagcaatccacccgcctcagcctcccaaattactctgggattacagatgtgagccactgcacccagcccctattgagaattaatttgtgatgtgttatatggtctatcctgaaaatgtcccatgtatacttgagaagtatgtgtattatgttgttgggtagaatatcctgtgtatgtctgttaggtctagttgttttttcaggtgttgttcaagtgctgtatttccttacttatgtctggtctggttgttttattcatttgtgaaatgaagacaagggacaaaatcctaagacatcccccttaaaacggaaggaccacccacagaaaaggactgagagacccccagaatctatagcttagctaattgatggtctttctctcctgaagttagtaaagagtggaaaagatgactccttcttcaaacatgaagaaagcaatctaagtcttcaaagaacaggaagcatgagaaaatatgacaccaccaaagaaacaaaatgaaactccagtggctgactccaaagacatgaagatctacaaattgcctgacaaagaattcaaataatcatcttagggtgacatcagcaagatggcagaacaggaggccctccactcacctctccccacacaaacaatgatctggcggccattcatggacaaaactgcctttgcaagagttttaatatccaggcaggaggtggcaaaactctagcaaagcccaaaaccaaggagagctgctttgagaaggcaggtccacacaccagtgacaggttcccagttgcagactgaaagcagctttgtcctcctatggacttgggtccagctccactagatcatggtcttgcaactagccccatccactaagcacctaggaggaaccatgaccatttatgcccccagtaacaggccttctaaccatggtcctgactgcagaaactaaagcagccctgacctggcttcagccccactctaccacagtcagtcgtgcctgcccaggaattcagtgatgcctttacatacccttggtaacaggcctgctgatctcagtctcagctatggacagtaaagtagccctgtgactccattccagtcttgctttgccacagtctgggcacagtccagcccatcctgggacctggtgaaagacataccatccattctcctaataagaggaccaccaatcttgaacccaaatgtggtcaccaaagctgtcctgtgacttggctctagccctgctctactgtggtctggaggcagtcctgtcttcccatggacctacctagtaaaccagcaggagctcaatctgggacccacagggagctataccagtccatgcccttggtaataggcctgatatctgaagacttgactgtagaactagaagtggccccatgacctggctccagtcctgttcaatcagggtatcagaggcagtccagttctcctgaggatccagcagaaactgcatcaccaacctatgccttgatagcggcctgccaatcagagattcagctgcagaccaggcagcagccatgtgatatggctccaggcccacttgactgtgatccagtcaagggatccagcaggaaaaggtttgtacctgctgaaaccaatctataaagacagaaagagattgggcatggtggctcacacctgtaatcccagcactttgggaggccaaggcgggcagaccacttgaggccaggagtttgagaccagcctggacaacacggtgaaactctgtctctacaaaaaatacaaaaaaattagccaggcgtggtggcacatgcctgtgatcccagctgcttgggaggctgaggcaggagaatcatttgaacctgggaggtggaggttacagtgagctgagatcacgccactgcactccagctgggtgacagagcaagactctgtctcaaaaaaaaaaaaaaaaaaaagaagaggtatttgcttcttcatagacattaatgaaagtctgtagatcatgaagaatcagcaaatatgacactaccaaaataaactcataaatctccagtaatcaaccccccaaaaatagagatctacaaattgcctgacaattcaaaataattaagatagctcagtgaaatttactagaatgtatatatcaactcaataatatcaagaaaatagtagatgaacaaagctaaaagttcaataaagatacagaaataataagaaccaaacagaaattctagaactgaagaatacaatgaataaaatgaaaatgcaagctgggtgccatggcggacgcctgtaatcccagcactttgggaggccgaggcaggcggatcacttgaggtcaagagttcaagaccagcctggccaacatgccaaaaccccatctgtattaaaaatacaaaaattagccaggcatggtggcatatgcctgtaatcctagctactagggaggctgaggcaggagaatcgcttgaaccgggaggtggaagttggagtgagccaagatggcaccactgcattcaagcctgggtgacacagactctgtctcaaaaatatataaaaataaataaatgaatgaaatgaaaatgcaatagagaatttcaattgcagacttgatcaaacagaagaaagaatctgtgaaattaaagacaggacatttgaaatatcccgtcagaagaccagaaagaaaaaaaagtttataagtaaaaacctttgggatttataggacaccaccatgaagtgggtcaaacatattatggacttcctagaagtaaaaaagatagaaaaggcctgaaagtatatttgaagacataatgggtaaaaactttccaaattcttagaggcaagtgggcttccagacacatgaagttcagaggccccaaaaaaggccagcccaaagaccataataccaagatgtattataattaaaatatcaaaagtcaaagacagagactttcaaaagcagcaagaagaaaggaattcatcacatacaaggaaacttcaataaggctatcagtggatttctcagcagaaaccttataagccaggagagaataggatgctatattcaatgtattggaagaaaaaaactgccaatcaggaagaccacaacttgtaaagctgtccttcagaaatgaaaaagagatgataaggtctttcccagactcccaccaaaaaaattctaagggagttcatcaccactgcacctgccttataaggcagtttttcaagttgaaataaaaggattctgattagcaacattaaaacattaagatattaagttcacaggtaggccgggcgcagtggctcacacctgtaatcccagcactttgggaggccaaggcgggtggatcacaaggtcagaagagggggatcatgctggctaacacggtgaaaccccgtctctactaaaaatacaaaaaattagccaggcgtggtggcgggtgcctgtagtcccagctactcgggaggccgaggcaggagaatgacttgaacccgggaggcagagcttgcagtgagccgagatcatggacactgccctccagcctgggcgacagagcgagactctgtctcaaaaaaaaaagttcacagggaaaggtaagtatatagtcacattcataacactgtaatattgcagtggtggtgtgtaaatcacttttcactgtagtataaaagttaaaatgtaaaagtattaggcggcccgggcgcggggcagctgctgcggggaggcggggaggcggggggcctggccggacacccctgcgccccctccccgcacccgggcggagggcggcctcttccccctccccctcccccaccacccccggcagccgcctcccccaggacgcaggaggcgggcggaggccgggtccgcgcagcgggcgacttgccgcatgggccgggtcgaggtgggggggcggtttcgggggctgggaagctggggtgccggggacaggagggtgggggagctggggaaaggagggctggggggccggggacaggagggccatgcaggcagtggcaagcgggcggcgagggctccgtggggcaggtggacggggatcagcgcctggggctgctccgttccccaggcgggtgtcgtggctctggcctccatgcaactccaggtctgcgcgccccgcgctgctggagccccagtcaaaagtctatttaaaaagcagagagaggatgcttccctctgagtggagcgatgaagacctgatccctgggccatttgggaacactagctgcctttcatcacagtcaacctggactcagagaatgtcaagagcttgttggttgggtcaagaatgaatctaggcatgacgtcatagtttatagtcatccttttaaacctgcaaagaagcatttgcaggtttaaagttatttcacgggtactgcttgccaatctttggaggatgtgaagcctgcagagaaataaagtgtcgcccctctgcgcgtcgctccccatctgctagaatgtttctcatgaatgctcctccagtggttgctctccagcccaaatgggaggcctctgtcccaccagggagctttaggttccccgggtgcttctcggaggctgacaagggcgtggagagcatgtcggtgagcacccgggtgcagatgctcatcagcacgctgcagagcgacagggctgctaggggcaccagcgatgagcgcactgcgcagagggggcagagggatgccacgacgccaggcctgctgccaagcccaccatgcacaaggagctgcctgcgttggctgcctgtggtcttgttgctgactttgaccccgtgggggaggaggaaactgcagactttggcccattggtgctagattcagacagtgacgattccgtggaccgggacattgaggaggccatccaggagtacctgaaggtaaagagtggagccgcacagcccggggccagcggggcccagccatgcacagccttccagggctgcaggcggaggcagtagatgtaagcgggaactggctcacagcagtgcccaactgccctgtgttccccaaaacttgtacctggctcaggtggtgtggccctggcagccaggtgggatccagcaaggaccagggctctgcctccccagtcagcatgagcagagcagactcctttgagcagagcatcagggcagaaatagaacagtttctgaatgagaaaagacagcatgagacccaaaaatgtgatgggtcagtggagaagaaaccagacacacatgaaaattcggcgaagtcactctcgaaatcccaccaagagccggctacaaaggtggtgcaccggcagggcctgatgggcgtccagaaggagttcgccttctgcagacctcccccggttagcaaagacaaacgtgcagcccagaagcctcaggtccaaggtcacgaccacgaccacgcaggagaaggagggcagcacaaagccagcaacccccaccgcccttcagaagcagtacagaataaaagtgggattaaaaggaacgccagcaccgcaaggaggggaaagcgagtcacgagcgccgtacaggcgcccgaggcgtccgactccagcagcgacgacggcattgaggaggccatccagctgtaccaggtgcagaaaacacacaaggaggccgacggggacccgccccagagggtccagctccaagaggaaagagcacctgcccctcccgcacacagcacaagcagcgccacaaaaagtgccttgccagagacccacaggaaaacacccagcaagaagaagccagtgcccaccaagaccacggaccctggtccaggggatctggacgctgaccattcccccaagatcccaaaggaaaccaaagctccacctccaacgagcccggcttccaggagcaagtttgtggaatggtcctcttgccaggcagacacctccgctgagctgatgtgtgtagaagcagtcctggacattttcaagacgatcctgccggccctatggagggcagcgatgggtccctgtccgcaagcccactcttctactcccccaacgtgccttcccgctctgatggtgacagtagctccgtggacagcgacgacagcattgagcaggaaatctggacgtttttggccctcaaggtgcagtctagaagtttgctggccagaggtgagagctgccctcaggctgcccagggcccactttcaccacctggcctcagcagccagaccggcagccccaaggcccctctctctaaaacactggacccactcctggctgcaaaaggaagcatagaggcggctgccaagtgaggccatccactcccaagaacatgcgggtggtggggaaagagggttggccaggatgccgaccgcagccaggggagagccgggcccggccatgaggggcgggacctttccatccagggcacagccagcgaggccccgggatgggagggcgccgctagggtgggacctttccatccagggcacagccagcgaggccccgggaggagagggcgccgctagggtgcccggtgacactcgcacgtcacagggccagggtaagacagacgaggcaaggcacctagacaagaagaagagctccgaagacaaaagcagttccctggacagtgacaaggacctggacacagccatcaaggacttgttaaggtccaagtgaaagctcaagaagaggtccagggagcccagggctgtgtgcaggaagaaggtcaggttcagcacctcccagacgcacttccaggagcagctgggcaggctcctgagagagtggaaaaacaggcacctgcaggtgctgaagagctgcctaagtccaagagagacagctgcgagggctccaggaagaaaccccccagtgtctttggcagcagggccgagaggacgaagccccggccttcctggtgaggagacccgcttctgcctccgcctccgaagagaatctattccccagagagtcccagggcccagctcccagccttggctccttgtctgacaacagcagttcagtggacagcgacgatagcatcgaactggagattaggaagtttttggtggaaaaggccaaggagtcggtgagcagttcagaagttcaggcagagggccccaccgctctcgggacagggggcccagccaggccagaggtaccttgcaggaaggagccggccccactgcctggcatgtgcacacggagccagagggccggggggtcccacatttggctaaagggcatcgaggcgcagggagcgcaggagcacagggcgcagcgtgcctgctcagccagggtgggaaggggctccccactgatccggcggaggggatcatgcgccacccaggaggaccagcggcagtgtctccgccaaggtctctcagtgagcaagagaaatgtttacgtttacaaagaccagagcccacgaggggctgagcctgctgccaaaagtgcttttggtcagcggcccagctgtgccacagcgggcaccgaggcaggaggagccagggggacctttcacgtggactgcaggaaccggagcttcctgacccccagcccgggagctgagagggatgctggagcccaggccaaccgcgccccgccctggagtgactttgcccaccacagtcagctgcccagcccatgggcactgcgctccaaaggtagagatgcggcgtggagggggcggcattgggagagagagacaaggggtccgagggccccacccggggcctgcccagcctgccccttgcgggcttctccccgctgctgtccacccagctcttccactttggaaagggtgtctcctgggggggcagggagaccggcctcttcagcccctacctggggctgcctctgcagggcctgtccttctcggccttcagggagtcccaggccaggcccagccctgtctttggaagcccacacttgctggcgaagaaggactgcggtcaccggccaagcaggaaggtacagacggggctgagtttgcacaacaggaagagctctggctcggaggaaaggattttagacctgaggtatccacgaagggtcaatcagtagagttgaccaggaccaggacaccttgggcagggacaccagtgatttcagcaacacctccgcagaggtgttgctgctgcagtggcggcagctcagtagtgaaggtataagacctcgagctgtgggttcgcgtcctgggttccatgcattcgtggaaagcggcatagccgacgtgtatctgtgcctgtgtgtgatggttctgtggttgcagggaggggaaacagtctgttatacatagtcttgtatatatgtataccaacacgaaacaatgcttttatttaacagatgtgtcctggtaaatatgatttttgtagattttgtacattatttaaagtgatgaaaaatgtttttggaaaatactgttggtcaattttgtagggtgttccttaactgcagttttctgtgttctgcatacaagtcttagattagaaaacatttggtttttatcatcacaaccaggtttacagggactctgatgttttttggttggttgctggtgagaatggccagcgctggctgcaggggtagccttaggaaggccgaggtgccctccccaggaatcgctcacatgccccaaagtgtccgtcaggaagttcctgggacagcactttttatacagaggacacccccccaccaccgcctggcttcatggtccttggaggccagagcacatctgaaaactacaggaatggaaaaccaaactccgcatgttctcactcataagtgggagttgaacaataagaacacttggacacagggcagggaatatcacacactgaggcctgttgggggatgggggcaaggggagagatagtattaggagaagtacctaatgtaaatgatgggttgatgggtgcagcaaaccaccatggcacatgtatacctaagtaataaacctgcactttctgcacggctaccccagaacttaaagtataattaaaaaaaaaaaaaaacagaaaaaataagtagagattaaaccagtaatgaaaaatctcccaacaaagaaaatcccaggaccaaatggttttactggtcaatttcaacaaacatttaaagaattaataacaatccttctcaaactcttccaaaaaaattgaagaaaagggaacacgttgaaactcattctaagaggccagcattatcctgatatcaatgccagataagaacactacaaaataagaaaactataggtcaatatccctggttaacatagatgcaaaaatcctcaatgaaatactagtaaaccaaattcaacagtgcattaaaagaattattcaccatgaatccagtctctaccaaaaatccaaaaaaaaaaaaaaaaaaaaattagctgagcatgctggcgggtgcctgtggtcccagctactagggaggctgaggcaggagaatggcgtgaacttgggaggcggagcttgtagtgagccgagatcgcgccactgcactcaggcctggatgacagagcgagactccatctcaaaaaaataaataaataataaataaataaaaaacaaaaaaagaattattcaccaggatcaagtgggatttatctctggcatgcaaggatgctttaacatacaagagtcactaaatgtgatacaccacatcaacacaataaacgataaaaatcctttatttttattattaaaaagcacttgataaaattcaacatcctttcatgattaaaaaaaacaacaaactgagcaaattaggtgcagaaggaatgtacctcaacataatgaagaccacatgtaacatactcaacagtgaaagactgaacgtttttcctcaaagatgaagaacaagacaagaattcctactctcaccatttctcctcaaaataggactggaagtcctagccagaacaattaagcaagtaaagaaataagaatggaagtaaaatggtctccatagatgacatatttttatgtatagaaaactgtaaagacttcactaaaagactgttagaagtaataaattcaataaagtagcaagatacagagtcaacatccaaaaatcagttgcatttctatgcatagatggactggagggcattatgttaagtaaaataagccagacacagaaagtgaaatattgtacaatctcacttatgtgtggaacctaaagacgtcaaactcagaagaagagaacagaatggtggttgctgggagctggggaagagaaggaaatgggaagttgatggttaaagtgtacaaatttcagttatgcaagataagtaagttctggagagctatacagcatagtacccacagaaaatgatactatattcttaaattgtttaattaaaaacttttattattattatttttttttagacagagtttcactcttgttgctcaggctggagtgcaatggtgctgtctcggctcactgcaacctccgcctcccaggttcaagagattctcccacctcagcctcccagtactttgctcagattataggtacccgccaccacgcccagctaatttttgtatttatagtagagatggggttttgccatcttagccaggctgctctccaactcctgatctcaggtgatctgcctgcctcagcctcccaaagtgctgggattacaggcgtgagccaccgcacctggccattaaaaacatttttttatacaataataataataaagaggcagaaggaaattttaaaaggtgatggatatgtttataggcttgatgataatggttttatggtgtaaatttatcaagatgtgtacgttaaatatgtacagtttttatgtaaatcattcctcaacaaaatggtttaaaaagtaataaagtaattactgataaggggggacttacttctggcattttgctatacattttctatatgccttacagcatttttgtccatttcctgcatgatctcatttgtatttagttgattttttgtagcgaagtgttttaattcccttctcatttacttttttatgttatataatgttttatttgtggttaccatagggattacacttaacattctaaagttatagcactctaacttgaattcataccagctatatttcaataatatgcaaaaactctcctcacagttttgccactcctctttcagttatcaatgtcacaaaattacatttttgtacattgtgtgtccataaacataaactaataattgtttttaatgcatttgtctattaaattatgtagaaagcaaaacatggagttttaaaccaaagttacgataatactagatttaatattttcccatatatttacttttactggcatctttatttcttcatatggctttgagttactatctagtgttctttcttttcaacctgcatgattctctttaagatttcttgcagggcaggtctaatggtagcaaacttctcaactttggtttatttggggatttcccaatttcttcctcacttttgaaggacagttttgctggatataggattcttggttgagaggtagtggttgtttttcttttagccctttacatatgtcatcccattgtcttctgttctccaaagtgtctgatgagaaatctacttataatcctattatatattcctagcatgtgactagttgcttctctcttggtgctttcaagaggccctactggctaattataatgtctcagtatgagtctttttttttttttcatcctacttggagtccattgagttttctggatatttattttcatgtctttcatcaaatttgggaagtgttcagcttttttttttcttttttgagacagagtctcgctctgttgcccaggctagagtacagtggtgtgatcttggctcactgcaacctctgcctcctggattcaagtgattcttctgcctcagcctcctgagtagctgggactacaggtacgtgccaccacgcccagctaatttttttttttttaaacggagtttcactcttgttgcccaggctggagggcaatggcacaatctcggctcactgcaacatctgcctcctgggttcaagcgattctcttgcctcatcctcccaagtagctgggattacaggcatgcaccaccacacctggctaattttgtgtttttagtagagacggggtttcaccatattggccaggctggtctcgaactcctaaccttgtgatccacccaccttggcctcccaaagtgctgggattacaggtgtgagtcaccgtgttcagcctcagccattatttcttcaaatgatctctctgcccctttccctctcttcttttgggacttccacaatgtctgcttgctattcaacaatcgtctttatttctgttcctctgacttgatcatttcaagtgtcccatcttcaaattcactgaatctttcttctgttgctcaaatctgcttttgaatccctctggtgaacttttatttcaatcactacacttttagttccagaatttatttattttttttctttttaggttttctatctctttattgatattcccattttgtttacacataattttactgactttctccacatcttccttcagttctttgaccatctttaagaaagttgttttaaagtatttgtgtagtaggttaccatctggtctttctctggaacagtttctgttgttgtttttcctttgaaataccatatgttcttgttttttgtatgccttgtgttttgtattgaaaactggacacttgaatataataatgcagtaactctggagatgagactctcctcttcctcagggtttgctgttttggggttttgttatgttttacattgttgtaggttgtctccatgctgaggatcaacctgagttgtaagcttgaggtcttctcaggtctgaagctgctcctttccctgggcacacactcctctctccaaggatgtgtggtaactttaatttcctctgtgtatgccattgcttttgagtgtcctagtctttaatgtttggctcccaaaaaaggaaaagagaacaatgaaggggaagggaaatggggttctggccttttctatctcctagaagttgcttcagtctggtaagggcttgcagcagtggagtggggagttgtgagcaataatggctgccggcctctgtgtttgcccttccataatcaaaagtagcaatcaacaaccagaacgcagatgctaacacttggaggacagagtgcttatcgcccatgattgttcccacaagcttggtacaagctgcttcaggaacacatgcaaagcttcttgccgtgaagctggggcatggggattgggtagccactgctgagctaagagctgaaattgaccaaaattaagtaaaaattatagtttaagccttcatttggaggttacaagcctcctttgatagagtctagagttccaaaatagttatatcaggcagattctgccagtgtgattattttctaggtggggagatgaattcccagtgcttcctactccactttcttcccagaaccctctcttgtaatagttttttacttaaaatctattttgtctatactttttttccatatatttactttttattgaatttgttaacgttacagagttcttgcactgccaaaccatgcctgagaattcaaacaaatggtacaatggacagcctcatccacccatcatacagtatattaaaacttgattcatctatattttgatattttcacaatcttttaaaaagttataataagagctggaatttaaatctgctgcaggtcttcagattttgagtacagtatgcctttacataacacctccacttactcatctctgttcattcttcagtaacataaaccccaacaacttgtacagccataacttgtacagccattcctgatctgttttggttactttttgcacggaatattctccattctctcatttttcaacccatttgtattggatttcaaatgagtctcttgtagacagcatatatagttgaatcccgtttttttaaatccaatcagccgatttatgtctttttattgggagtttaacctatgtacatttaatgaaattattgattaggaaggacttactaccaccattttggtcattgttttctgtatgtttagagcctttttgtccttctttcctcccttattgtcttcctttgtgttatagttgattttttgtagtgctatgctctgatttccttctcatttccttttgcatatattctgtaggtattttctttgtggttactatgggaattacatggaacatcttacagttatcttattattttaaacagataacttcaatcacatacaaaacctctactctttacatctttgccccactattaagttactgatgtcacaaattaaactttatatactttgtatccattaacatagatttataattattatgcttttgtcctttaaattccattaaagtattaaaaattgagttattagcaaaaattacaataatacaggttttaatctttatgtatttacctttatattttcatcaggctgagcaactgtctagtatcccttcatatcaacttgaaggactccctttattgtttcttttttttttttgagatgaagtctcgctccgttgcccagactggagtgcagtggtgtgatctcagctcactgcaacctctacctcccgggtacaagtgattctcctgcctcagcctcctgagtagctaggattacaggtgcgtgccaccacacccagctaatttttgtatttttattagagatggggtttcgccatgttggtcaagctggtcttgaacacctgacctcaggtgatccacctgcctcggctcccgaaagtgctgggattacagacgtgagccactgtgcccggcccctttattatttcttattggtcaggtctagtggtaataaactccttcagcttttatttatctgggaatgtcttaatttctccttcacttttgaaggacagttttgtcaaatatagtattctcagttggcaggctttactctttcagtactttcaatgtatcatcccaccaccttctggcctgcagggtttctgctgaaatatccactgataatcttctagaggctcccttgcacatgagaagtcacttttctcttgctgcttttaagattctctctatacttactaccactaaattctacacttaaaaatggtataatctgttatgtatattttgccacaataaaaacattggaaagaggtaccatagaagagtatattacatgcaccataggctggaaaacattttcagagattaggctattctcagtaactcacatatctagttctggtaaacactgattgatttaaacaaatatcaatgaacaaagtattacatgcaccgcgtgcagctaaacagtgtttcgctgacataacactagtacctagatctgataaactatctaaacaggcatcactgaaactatactacagaaaacacagaatgctaaccacagtatttccaagagtcaacgctacacctgggcaatcttgcacctatctctgttaaacacagggtttgaacttggaacaacaaagaatgtagtacctgcaccacacacttcttaaaacagggttttggccgggtgtggtggctcacgcctgtaattccagcactttgggaggctgaggcaggaggatcacctgaggtcaggagctcgagaccagcctggccaacatggtgaaaccccgtctctactaaaaatacaaaaattagctgggtgtggtggcagacgcccgtaatcccagctactcaggaggctgaggcaggagaatcgcttgaacctgggaggcagaggttgcagtgatccgagaccacaccattgcactccagcctgggttgcaagagcaaaactccatctcaaaataaataaataaataaataaacagggtttcatagggaaaacactatgctaagtcattcacaaacctatttctaataaacacagatagtgaacatgcattaaagaaggctatcttagatgagccacaccctgctaaacacatcgattctcaaagataatgcaaggctcattcactcatggtagacctaactgttaaacttaacatttaaatatgtatcacagaagatggtagtacctgaacctcatgcttctaaatggaatgcttcaccaaggtagcattattctcaatcactcatgcatctgcctcacttcagtacggagcaaatatgtatcagtgaacaatgtgccacgtgcgctatacacggccaaacacagtggctcatacagttaacacaaggtgtggtcaatcactgacagaatgggaatgaggaatgtgtcccactctctcagctgttgtattatatcatacaaggtgcagtgactaagttcattcatgaacccagctctcttaaacacagaaattaaacacatatatgggatacagcacacagtgtgatttgtgtctgcatctccctcgtgcatgttgtatatttcatataatgtaggtacaaaatgtaactttggtcttcacccgcatcagctatcatctatcacaggttacatagcgacataatacaactcagttctgcatccccctctgctatcatatggtatcatgtgtgacaatgtgacccgaggtgagtaatgactatcccctctcacctgctgtatggtgtcataagtgacatttgtgactcacatacactgtgaatcaggcctgcaacccttctgtcagttgttgcatgatactgtatgtgccatagtgacataatgcaactgaggtctgggctccttgatgtcatataatatcataagtgacatggtgtgaacaaggctgcctccccctcttgggttatcattggctatcatataggacatagtgatacaaagtgacaagtgtgtgtccccctcaagtgttatatatcacatgtgacatagagtaaggtgagcctgagtccttctcttggttgtcctagattattttattttatttttttgagatacagtctcactctgtccccaaggctggagtgcagtggtgcaatctcagctcactgcaacctctgcctcctgggttcaagcaattctcctgcctcaggtgcctgagcagtggggaccacaggcgtgcaccacctcacccagctaattttgtatttttagttacacagtaacaaatgtgactgaggtctacctgcgctctcagctgatgctggcacctttattgcctaggtgtttaatgcttctcaggtctgcatcctatctcccgtcacacactctcatatgctatgtaggatgaggacacagctgacacacttagtcactgcaccttgtatgatataatacaacagctgagagagtgggacacattcttcattcccattctgtcagtgtaacatagcatatagcagctgagaacggggtacatccctgactcacatgatgtcacaatgtcacatatgatatcataagtcatccagtgggctaggcacggtggctgacacctataatccccacactttgagcctgccaaagtgcctttttttgtgcctttcacataaagactatgacacagctaagctattcatgtactaataaatacctgccctgagctgtgtgaccacggacaccaccctataatgtggccagtgtgtaggaactctgcaggctcagatcattccagacatacatgcagatgttggaactcccttgcacagtgactcatgatcccaaggctgagtgctgagggcaggtcagtagttcagagcctcagcattggggccgtatgcttgggttcccatcttggctcccacactttgggagcccgaggtgggtagatcgcttgagctcaggcattcgagaccagcctgggcaacatggtgaaaccctgtttctactaaaaatacaaaaatttgccaggcgtggtggtgtgtgtctgcattcccagctactcaggaggctgaggtgggaggatggcttgagctgaggaagcagaggctgcagtgaactgccctgctgagagtggagctcctgctcagctcctaggaaggcaagagccagcaaggccactgcccaggcccccgagggttctagggggtcccatccctgggaaggtggaatctgggaggtgagggggacctaggaccccattgtgtgcacagcttgggctaaggcatgagataagaccagggtgacattacaggagtatccaagaactgacttcacctaacttctgcatttgacttcccatccccaatgtgggtagggccctgccctctggcgattggaaagaggcgcagggtgcaaagaagtcccctcctctgacctcctgcagggctccgtcttggcctggatccgcaggggggcctgggcaggagggaggctgtggtcttgggatggggtggcagttccaggcccacagcggggcaagagacatcctacaccttcctcccatccttgccccgaaagtcatgggcgctggggttcaaggtgccctcactatttgacctttcttgctggtggctttggtgtgtcattctggtccccagcctctgtttcctggactgtaagtggggataataataggtcacccctcccctgcaggattaacctcagcgattgttgctggcatcagtgcagccctgggaccagagcacacctgggtgagtttggagcgctcgcgctcttcctggtggccctgcctgggcactgacccctcccatcctctcctcaatagccacgcccctagcccagctagctaatgaataaatatgtagtagccaggccagcatcctggctccgcggtctagccactttctagtccttcctagctgcggctgccactgagccacgcacgcccctggcatcatgctcgccttgcggtgcagctggtgtggtgcagactctgagagtgagcaccaggactcttcccgtctggtctccaatctaccctcttgccatgctccaccaccccttaggtcttgccactgggagtggggagggactggggagagaaaatactggggtaggggtgacaggagagaaggttcttcactggcctcccctggcctaagcccctggcctacttcattcttggaccccagctgatgggatggggcttggagagggcccagatgactggcctctcagctcagcctcctgcccactgtctctataggtgcctggtgctacgactcccaggaccccaagtgtggtgaggacagagtgtcatgtgaggctgagtgagatcagtctgtgtcctgggaccaccagagcatgtgccagtggtgcaagagtggccaagagacagtctgcaccctgcactctgtggcctttgcaggtttctgtctgtagtcgtctgccccagtagactgactgggcatcaggtgcaagtgtgtgactgtccccctgtgtgtgagtctgggcctgctgtgatcgccggtcccgagtcagtcaaggctggtgtgcctgttactgtggccagcccaagtgtgtgcaggtgatagaggtcccagtgtgggtgtgcaactgtgtgccagagactcttttgccttcatctcaccatggggcagccaaccgggagactagatggataggccagatgcagggtacaagagaagggggatgctgtgacctgttcaggtgtgggggaagcagggagctgggtttcctgaggctgggctatcctctgggtgtatgggggccactctctgctgcacccccaggctgcctccctgaccccacccccaccccaaaggccccagtccttgttccagcagtccccacccactggaagaagctggcccctgcctgtgggggcccaggccagtccctcatcgacattgactttcacagggtccggcggaactctaccctagggcccttcatcttccgaggctatgactcagcacctccaggcccttggaccctggagaatgacagccacacaggtcagcaccctgtggtcaggacccctcctaggcaggagcaggagccccacacagggcatgagagctcctgagtgtacacagggaccaggaccccctacacacgggagctgagacaccctacagggccaaaaaccctccacaggggctagcttcacaggaaaggagcatcctcacacagcagtccagatgcgccctctgtgtaggtgccaggtcccaccctacaaatcacaaccagccatggcccctgaggaccaggagtcagggtctctggcagggccaggatccctgaccacacacagctgggctcagagccccaccccaggagggctgccctctgccttcttccatgccatgctgggtgtgtgggggagggtttcccctgcagtctgtggaactctgctctgctgaccagcaggagccatggacaccatgggttccattccatggaggcaatggggccccactggggagcagcctggcctgaggaagggcctctgctcgtaccctgtgccctaatggcacaaggtgggcaggtggtgaggtagagagggtgtcgtgtgcctcctccccttcattgctactctgaatggacactgatcctcagaaccacctggagatttgggaggctgggctgctgttgcctgtctaccgcgcactgcggctgcacatcagctgggggcggggggggcccgaggcgagcagactcggagcacagcctggacaggcagcgccaggctatggaggtagacttgggcacaaggtggggtggccggagtgctcccacggagatgagagagagcaaggtgggggcagctgggtatctcccacatctgtgcctacccccagatgcatgtggtccacagtaacacaaagtaccagagcatggaggaggcaccacgccacggtgatgggctcgagtgcaggccctgctgctggagttgctgctggcggtgaaggcagggctgtgattctatgtatgtttccaaaaaaggggttcatggggatcctggaagtggacaggctaggcctgtggagtccatggggggatctctagggtctataggatctgtaggaggatagggcggtgggaatgcctgaatcggcagggccagtggcggcgagaaccctccaccccatttcccagatgccagatgcctcctgccactgggaacctcctgcttagagtaccccagctgagttccctcttcagagactcccccactcagaaccccttgcacttggagcccctcccaggagcaggactgtagcaacaccaacttctgcgccatagtgtcgggcttgaggaaagtgcctgagccaggtgaggagccaccgggtcgttttccggctcaggggcggggggtttgctggggatggcaccagcagggcacggggaggctggttccaatccccctccctctgccgcccagggctctcagtgaatctgaggtccaccttcctgctggcgtcgatgcggcccaacacctcgagctactgtcgcttcgctgggtcactgaccccgcctgactgcgagcccacggtgctctggaccgtcttcgaggaccccatacccatccggtgggtgcaggtggagccaccgttccccctcgccccccacacccctccccgggccttgcctggctcctcccgcaggcgctgcccctctcccaccccgttttgatctctttgccctgcaccctcagatgaccctgttccacagcgtgccccaggctggaccctcccactttcaccccataccgctcacgggtaacttccgcccacagcagcctctttttttttttgagacggggtcttgctgtgtcgcccaggctggagtgcagtgttggaatctcagctcactgcaagctccgcctcccgggttcatgccattctcctgcctcagcctcctgagtagctgggactacaggcgcccgccatcacgcccggctaattttttgtatttttagtagaaacggggtttcaccgtgttagccaggatggtctcgatctcctgacctcgtgatccgcccgcctcggcctcccaaagtgctgggattacaggcgtgagccaccgcgcctggcccacagcagcctcttaaggggcacgcagtcttggcctcccccagagcctcggtccccgcagcagccccccgctcttcccccaccctagcaggtgtgcactgcgctctgatgcgcctggggctcagcttgtggttctgtcaaccgtgggcgaccctccatgtgaaataatgaaataatgcacagagtgaccttagcctaatgtggcctggagggggtgggtgcgtgacccggcgcggtcccccactgcaagaggggcatttcctgccctaatcccactgaggcctcagtgtgcctgtctgttccgtgggagccctctgagtgaccctctcctacctcagcagaacccgggcctctccaggttcctctcagagggagaagggcccccaccctcatcctatacattgtgtctgaatcccctggtcagatggaaggagaacatctagcagtcagaaattccaccattaggccaagattacattattttattttaaaactaagctgggtggccaacccagggacaccgtgctctgctaaatgatgactccagctacatttcccgaggccaagagatgagaagctgctggctccaggctccgctgcaggctgccctggctgagcgggtgctgggcaccgcggagggctgcctggtgctctgaagccatgccccagtgcctccctgggagttctgctgtggagtctgtgtggagggtgactctggagagatgtttgtgtcccggtggctgcctgtggtctggctaagtaaaggggtgagtattcttggtgtcactgtccaaagcaaagttgtgtccacgggacacagactaggtgaggctctgtgtccaggtgatgctgtccagtgagagggggttgcagtcagagtgaggctgaccggaggccgctgtccaattggtgccgtgtggaatgtgattacatactggttgacaccgtcctgagggccatcaccagctgcgtgtctcagccgccctgtgtccctgggttctgtgcccttgtgtgtggtttgacactattccagtgcgtggagaccctgcctcgtcactgagaccttgaaagaaaaagaacctgcagtcaccccaaggaagaggagtctcggctgttcccctggaggctgacccagccctggcccaaaggctgacccagacccaaggcccaaaggcccagctctaaggtccaaaggggctccaccctgttctctagccggactcagtctctcgcaaggaccccggctcccagccgcactccccagacgcacgtggcccaccctccgcccgtcccgcgcccaccccctccctccagtaccggagccctaactggcggcacccgggcacccttctgactcagagccacgctacacgagggggaccgatctgctcacttgccccgtcctgggggtaccagagtagccagcgcgacgccttccgcacctcgcctaggctgcccttgtgcggccgccctcagtccccgccaccttgcggggccccaggcggcactggcatcttcttgtggttcttcctgaccggggctcggtgcgctccgcattctgctgggccgtccggggcgtcgtctgcgggcctggaggcggcgaccagggcgctcacggtgccgagcgtccgcagcagggtcgggccgcggggcgtggcgcgggggacggcgcggggctcgcggcgggcaggcggggacggcggcggcggcggcagcagcgcgcgcagagcgtccagctccgctcgaagctccgcgcgcagcgcctcaatctcggcgcccagctcctcgcgcactgccgcgagtccctcctgcagccgccgctcgctgacctccaggacccccgccgggtaggtggccctgccgcggggctccccgcatactgagcacacggagccgcggctgtgcgcgccggtcctctcgcccgcgcccgccgccccggcccccgcacgctccaccagcttcagcagccgcggcacctcggaccgcgaagccgcttcggcccggagctggccgagcaggcgagccagccggcccggggctcgggcgtcttcctggcccggcccattggattgcggccccgggtcccgccggcggcccgtgacgcgccgcagcacctcgctggctctgtacgcactacgcgcctgggcccacgggcggccgggcgtcgccatccgccctgctgcctccaccgccgccagcgcccgggatggccgggagccccaggctgcagcctagccatcgctggggcccaggcgacgcaccgtggagggggcccgcgggacggctttgggaacgaccaaagccctgggggttccggcctggggcgcagggaaccctggcagggctgggtcccgggcagcccggttccccggggaccctgcgggaacaacgacgttgtgggcaggtcctcacaaagggcatggcccagtttctgggcataggtgacatggagcatcgccagccaaagaccaggcaccacccgctagacacgagtcaggaactgagctcacattttacactagaagctactgtctccatcatagtcaagggaaggccaggagtggtcatggaccccacagcccttttcaatggctcagggcgacgtccttccatgtagtccaggccattatctcctcaccctgtcccctagtccacacagctggaggaatccatccaggtggcatctccagccccaagctgctggtccttccatgcgagctcttcagggtctcccttactctccaaggtggcccgcctagggcctctggaaatccctggccatctcaagctgggttttttgttttgttttgtttttataaacaggatcttgctgtgttgcccaggctggagtgcagtggtgcaatcatagctcactgcagcctccatctcctgggctcaagcgatcctcccacctcagtctgctgagtagatgggactacaagcgtgcaccaccatgcccggctttttttatttttatttttatttattttattttatttatttattttttttgtagtgatagggtctcactgtgtttcccaggttggtcttgaactcctggcctcaagtgatcctcctgtcttggcctcccaaagtgctgggattacaggcatgagccaccatgtccaagcctgtctgtgtctttaacctcctctaatccaacagtcttcttcatccttctgggtctttgcacagttcctctccccccaacccctgccattttcctggtggctctcacttttcccacttagatagggaaatgttccatgaccaccccatcccacactggggacctcgagcccctcctccacagcacccttcacagttgtatttaaatgactctgttttccatccacccactgtggggtctctgagcccagggctgggtcatttctcctgggccgagtgtggcactaagcatgctgagtgctagcctgcacagaggccaggcccgggtgggccccaggacacagctgtcagtggctgtcttgccatggagtgagtggatgaatcagcagggctgggatcctctcccattttacagtaggaggctggggagaggagctggccagcccgtccacctctgcagcctggcatctgaggccctcatggcatccctgctggtctgccttcccctgcagcccttccaccctctgtggagccctcactactgcaccctactccttctcaccccagtgcctctgcataagcagtgctgcctgtggccgccacagggccctaggtatgggcagagtagtatcccccacacagcatgctgttctccctgtacccccaggggctagttagcactctgggtgccctggaccctggggcctccctcagcaaattgtggaggttggcctggcatgaatccaggcaggtctgggaagggacatggcaagacagcccctggaagctgtgtccccgggtccactggggtctggcccctgcagatcagtgcatgtgtgcatgtgttggggggggggattgaggggaccgctaatactgtcctcaagcagctgctgaggagaagactgggtccctctagtcatgttcatccactcaatcactccctgcagctcgtctctctggaaggtgcaggaggaggtgagaattgggcactctgtcaacccctcagactcccccattcctgctgagtcacccgtcctctgggacctccagcagctggctctgctgatccctagagcctcattagccattctctccctccccccagtcattaaaacactgccaacaagagcgccctgggttcttttccccagccctactggagacgggctgtgtgacccaggggctctgccctctctgagccaagtcttcacctgtgaaatgaagagatctctgaggtccccaggaggagtgacagggaggcctggatggtggagaaggtgtaggagagagtccagatttgcagaaagagctgttagttttgtgatctctgcctggaggtctatggacaggctggaagagaacctgagccattgcaatgagtccagattagggcttgttcctgcagaggctacagatgtgggggctggtacttatggcagagggtcccaaagtcatgggcatagagaagacaggttggcaggagcaagggcagaatgggagcggggtcctggggaccctgttgggccctgaagaggactgcagaggtgttggtgaggggtggacaggcaggtgtgtcagcacaaccctgagcccctgagctcaagtgcagggatggccgtgaagcaggtgatggggaccctggcttgagcttcatcggtagcggggctggggtggacaccggggactggcggagaggagatggggtgggggctggtcaaagcagtgtgtccctcagggagcgtggcagagcggggcgcgcacacaggtctgctctccagttcctccgggaagttcctcaaattcagccagctccagctgcccctggcacagaggagctgactgaggctccagtgcagggcctgctccttcccctcctgttcccctcagtgtgccctgggccgggggccaggcatggtgggggtggggaggctggctgtgcctgtgggaagccaccggctcccggggctgtccctgggcccaggctgtagctctgtgcatgcagacgtgcaggctgggtgggcaactggccaccttgcccgtcagtaatgcattcacagtggggggtcagaggaaaccccagggctcctctgcttagcttggccaggggtcccgatggggcagtctctccgtgtgacttaattgtcatcccttttgtgctctatggctattaaataaaacttggcagccaccttggctggaggttttatgtcccagagcccaagggcggttgggagccaggggagcgctcagacggcagggccaggcgagctctgtgtgtgggagggggtatgggggcctctgagagctgctgcagggacccggcagggcgggggtggaggcggagagtgtgactgtagcttcacagtcatcagagtggacgtggagatgcaggcagagtcctcgaagctggctcaggggtctgtgtggggagggggcacacccagcaggggcctgagggtaagcaagggaggcagcagggtcttggagctgcctcccaaaggtggtggggagccccaggaagagcaaggaacaggagcagccggcaggtgcggctgatccaccctgaggtcccggacacactggtggggacaggaaggctcatcttggagctgctcctggaggggccatgtgggtcacggcccctggccctctgctcagaccacagagcacaggacacttgtccagcctttgctgcgactgtgctgcttgctctgggagcagctgctgctgggcctttggaggaggaggaagggtggcctggctgggacccagcccctgtgcccagcctcttagaaggggaggtgatggtccttttaggccccaggagtgcaggctgcatagtggggcctctgtacacataagctggcaggtctggcttgggctttgctcaggacactgggtactgggttctgggttcagaggcctcatgaaaacacctagcctcagtttcctcatctgtcaggaccagcggctggctgggagggtgtgtgttagcatggcagcggccagcttagtctactctaggagaccttgcctccccgacccctgagctgacctcttctttgagagcttagagaggagaatgacttgttccaggtcttactgcagggtctggggcttcctgtggggactcaggtgcaccttgtccctgaatacccctgccttgcccactaggccctggaactgtgccccggcctcctgtggcactggctagccagatctctgggaaccgtcccagggcaggtggctctgcaggaggccaaatgattacccagcaatggccttgcctgatgtgggtaacgagctcattacctggtgatgaccttgtttgtctgctcctggcatcaacagcctcagctctccctgcaaggaatgtctagcctggggtgggtctgaccagtctgtgccacaggcaccagcatcccagtctgcactgcatggggtgtcgggcctgacagcatctacctatatgtgccctgagggcccagactcagcccccagtgggaagactccaggctcctgacggacccctcccagttgtacaacctgagcaggtaagccctgacccactctgggcctcactctcaccaagctggtgacaaagattctctgcttggtcaagctttatttaggctcctgagccttctcctaggcacatctgagcacttccttataaactctagttttagcaagaattctgcaaagtcagtttagcaagaagccccccgtccttgacatctgatcgggttccccctctgtcccccaggtgcggtctggccatcctggccggccttcagcaagaattctgttaggggagttaagccagaatccctggctgctgatgcttcctcttagtcactttccatgcgctgccccccaccctgctccttgactgtccgatcgcacttgcccatgctgtcttcgaggctgagcccagtctcttacccactgcagaatctcatcgccatggtcccttatgcctagtgacacggtcctggatagtcttccccctgctccttgacggtccgatcccacttgcccatgctgtcttcgaggctgagcccagtctcttacccactgcagaatctcatcgccgtggtcccttatgcctagtgacacggtcctggacagtcttccctacagcgctttggcaagtgtcatttttctttttttcttttcttttcttttttttttttttttctgagacggagtctcactctgtcaccaggctggaatgcagtggcgccatctcggctcactgcaacctccgactccctggttcaagcgattctcccgtctcagcctcccgagtagctgggattataggcacctaccaccatgcccagctagtgtcaattttcactgaattatttttttaacagtggggactaaagagggtccgcaagcagggctgctgctgggcaccatggagggccacctggcgggacatgccccaacctacaggggtccttgagggctccccttcccctgccagctgggctggggtctctgtgtcaggagtgtcctcaccaccacctggggatggacctccactgtcatcctagggaaggggccagggaggggagtctacatgctgagcgggcctgtccgaggcctctgctatcccaatgcagcccccagtatttagacctgcccccagtgacctgctccctcttgcccatcattccaggaacttcctgttccacgcctgcgcacatcctgtccctaggccggctccccctgctcagcctcaggacgcagccacccaccctcccaggagcgccttccctgcccctgtggcttcctgctggcactctctgcactgggttcttcctcctggtgtgtggggccctagtctctgtctcctgtcgggtttgacttctaccagagcagggacctccctgagtcctcatggcccagaaaagtgcccagcatgcagtaggcgcatcataaatacctgtctactatcatgtggtgaactgagtgaagacatctcattaaagatgacattaaagaatagggcatagggcttggcattcagtaggcacacagtacatgatggctttgttatttccagtctggggttgtgttcatgcctcagtttcccacctggcctgataggaggggctcagctgctgggctggctgtgtctctgtgccccttgcctggaaatgcctgacgaggggcagggtcctcatcccagccacatcccaggggttcccagccctctgaacttgaggagctgtgggaggcgaaggctgcagccaccctgtagcactgcaaacacaggctggggcgggaaggggggtacagagggtgtgcacaaggggcagggggagggagagggtgggcacaaggggcagggggcagggacatgtccccatgcccagctaatttttgtatttttagtagagacggagtttcaccatgttagccaggctggtcttgaactcctgacctcaagtgatccgcccacctaggcctcccaaagtgctgggattacaggcctgagccaccgtgcctgaccaaaaatgattaagtattttaaggcagccaccacagagcattaaacaagcccctagagctggccccgcccccgaaggctccaggcccatctgtcttggggatgcacaggttccagggacccaaacccacccttcacaactctcttcccctcccagcaccacaggggccctcctggcccctgggacctcccatggagcaggctctctgtccaggatggagatggggaccctcctcactgccctgtgcccctcatgggctggacacacccaccacccaagaagaaaggcctaaagggctgggcactgcccttttggaaccagaggcttggcggccccatatgggtctggctgaacccacctttggggggctgagatgagccagcctcagttactcagctgacggcagggcctgtggtatggagcttcccagactgcacacctagcccctaccggacttccatcgtctccagacacgcgcagcaagggttcccaggccagaaacaggaagcagcagctctccctcctccagttcctgggaactgtctcagacgaaccacccggagcctcacctacaggaggatggacacctgcacccagtgctgtagggagcaacctcagccctgggcctgggatgaatgccctcgccagcctggggccaggagacaggctctccgtggctcagcgcctgagcatccacttacaggacactcacctgcagaggtgccctgagcaccgttgtgggttaagggactttctcccctctggaaacagtcctgagaagctgaaggtcttgggggcctctcaccaaatgtctttgggaggtgggaagacatcaaatgcgggtgtggcttccctggaacagctctgtgtggggactcaggagccaagtcccccagcacatgcctctaacactttcagtaggggcccacctctctggagccatgggtggctgccaacaccctgtggttcccagcaggcaccacccaggcaagagagagaacaggctggggaacaatgggctggcctggccgcaagcgctggggcagatcacagaccagatggcctaagctcatgccctggggccagctctgactccctgcaagtgtggcaagggtcccttttggacaccttgagaagctgcagctgggagaggaccacccgcctgtctggacgtccagcccaggtggcagggcccaagtgaccagtcccaggccacagcccttaccacccgccctggctgcaggggctcccagaagccaccaagggcctggctcggccttgcctgtccgcatctgagcttcagtttcctcatctgctcaagaagggaggtgaacactgattaaattatgcaaactctgagcggcaggattaggtgtggctgggacagccaaggcttccctgggtggtggcatctctggagcccggggatgggacctgtctcccttccgggcccccagctgggcacgcacctgccccagtccctccctgcaactcttcctccatgccagtccctggaaatgtggccctgccgtgggtctcatggcccataggagatgctttgggcccagcacccacagcccctcgcagtgtgcacccccacttccctttccccactgctgggacacctgcttgaaatgtccctcctccccccagaaaggaggggagcagccctggccttctgccctgagggcggagctctctttggggtctcaattgcagcccctgggagagtgagaagggtcaagttcagaccctgcaccattccctaccaggcctcgaatgggactcttggcagctgtatcccccaccccagtccaggcaagcaaaaggggttcttctgcagtcttcagggcccccagaaggcgcactgttcacagacaccctggggagccaagagaggtcgagggctccagctaccgtggccctctgaggacccccgcctgtgggatagaggacttggtggctgaagggcagtcatgcccagggggcttctcctgaccctgcagggctgagcgggtgcagccttttgcctcttctcgctgcattctagcccatcagtcagggcaacagccagatggtctatgctaagattcatcccatccccacgggccctgtgactttctaccatatcaacgtggtggcctgtgcagttcccggccagcattttcctggggatgctgctgtctaatgggctgtgggagaaacagagacaggccctgcacatggggcagccagtccagcacccgccaggccaggccctcagcatcctctcctccagatgcccaagagagctgctccatgcgctgtggcgccctggacgggccatgttcctgccacccgacgtgctccggccttggtacctgctgcttggatttccaggacttctgcctggagatattgccctactcaggatccatgatgggcggcaaggactttgtggtgcggcacttcaagatgtccagccccacagacgccagtgtgatctgcaggttgggaggcccaggaggccgggcactggggccccacgcccccatccctgtgcatgctgagggctcagacccactggcaggctgaatggagcccctcagacccaggacaggcaggagggcacaggacagctggttggatgggttccccagggaggttgggggcccagactgtcgagatgctcagcctgcagtggcccagcacctcctaccaccaccaggcccacaggtttgcatgccacaggagagcatccagaccctcggccatgtggactcctccgggcaagtgcacttcgtgtcgcccctgctctatgagagcggccacgtccccttcaccatctcactggacgatggccactccttccctcgtgcgggcacttggctggctggtgagccctcctccctgcccacagcctgcccccacggggactttccccagcgctaatctatgcacaccgagacttggcccgtccgtgtcctgcctctctggctgaaccaatcccttgggaggcctgcccgcctgcgagagttccttcagctcctttccactccctggcatccagaccacggtcccagcccagagtgagtgggagctgcaggggtccctagagaggtgggccagtgcctatccactgagctccgccacaccagggcaggggagaagccaggtggaggctagaggcgtgggcagtggagggagggcaggcccctgcctctccggcctcagcgtccttttctgccatgagggccggagagaccatcacccagctgctgccatgcattggccctggaggctcccacagcccttgaagcctcagggcctcctccctgcttccctgggcccagccctcactcacccctcacctcccctgcccagtgcaccccaacaaagtgttgatgaaggagaagagtgagttgatgaacgagatgcattggcaatactacggcaccgccaacacctcaggcaacctcagcctgacctggcacgttgaggcgctgcccacacagacaccatcaagctgtggggctatgaggagacaggtgaggccagctgagggctagggtggcatccagagctttgggcccccagaggtgggagaaagggagtcccagctgtgtgggaggaggaggagagtttccaggtggggttgaggagggaagggaattccaggcggagattgaggattcggatggagggaagtgcaggccaggggggtcaggcaggtgggagggggcagctgcatggggcctgggtcccggggaggaggctcatgaggaacccctcacggctggcatggccctgggcccggcttccagcagggacagggatcctggagtgtggcaggaggtggtggtcacccaagccagggtccctgctagaacagcccctcctaaggggaccgcctggcagtccatccacacatgtgtcaggctgctctaggtatcaaggcctggggccaggcctcgaaggagccccagggctaaccaggccttctctccctcaggaatgccctactcacaggagtggactgcaaagtggtcgcacctgtaccccccagccacacacatccccaactccggctctttcaccttcacccaaaaacctgctcctcccagctaccagagatggtgagtgggtgcactttggatcatcaacaacaaaaattacgcagggcaggctggttacggtggctcacgcctgtaatcccagcactttgggaggccaaggcgggcggatcacgatgatgtcaggagatcaagaccatcctggccaatgtggtgaaacccagtctctactaaaaatacaaaaaattagccgggcgtggtggcgggagcctgtagtctcagctgctcaggaggctgaggcaggagaatggcgtgaacccaggaggcagaggttgcagtgagccaagatcgtgccaccgcactccagcctgggcgacagagcgagtttcaatctcaaaaaaatgataaagaaaaaaagaaagggcacatccactctatggagttctccctcaaatcctgtaaccctagtcttatcatgggcaagcatcagacaaacctaaattaggggacattcaacaaaataactgttcttcaaaagtgtcaaagtcacaaaagacattgacagactggggagtcaccacatattggaagggagtaggagacacagagattaaatgccacctggtgtcctgggttggatgctggaacagaagcggggcatgtgtgggagacctgggaaatccagacgaagtctgaagtttaggtaataggattatatcaatatctgactcagttttgacacatcagcctggttactgcagatgttaaaatccagggaagctaggtgaagggtatatgggagctctgtgctgtctttgccactctctgtaagtctaaaaccatttcaaaagaaaatgattgaaagttgctaggattctctctctgttgctgcaccttatccgtggaaacctcgtttcagggatgatgcagtgtgtgattgcagtcgcggacaaaatattcgatgccttcctgaacatgatggcggtccagaaaaacagatacacagggccaggcgcggtggctcacgcctgtaatcccagcaccttgggaggccgaggcaggtggatcgcgaggtcaggagatcaagaccacagggaaagcccatctctactaaaaatacaaaaaaaaaaaaggccaggcgtggtggctcacgcctgtaatcctagcactttgggaggccgaggcaggcagatcatgaggtcaggagatcgagaccatcctggctaacacggtgaaacctcgtctctactaaaaacacaaaaaattagctgggcgtggtggcgggtgcttgtggtcccagctactcgggaggctgaggcaggagaatggcgtgaacccgggaggcggagtttgcagtgagcggagattgtgccactgcactccagcctgggagacagagcgagactccttctcaaaaaaaaaaaaaataaaaaaagaaaaaattagccgggcgcagtggcgggcccctgtagtaccagctactcaggagactgaggcaggagaatggcgtgaacccgggaggtgtagcttgcagtgagccgagatcgcgccactgcattccagcctgggcgacagagcgagactccgtctcaaaaaaaaaaaaaaaaaaaaaaaatagaggtacacaggcaccacctgcccccaaggagctcacagcatcttgaagaggcaccaaggaaaacaccagacggtgttgagggtttgatgaggtgtgggggctcagaggaggggcctcgcagaagctgggggaggaaccagggatggaaggagttccccagtaggcaagaggacaaggaaaagaaagtgcctctgctggggcaggaaatgggcactggacacttatacccttcattggcaccatagagcagtgctaacatgttccatttgataggagagaaaactgtggccctgggagaagtggcccattactaggctaggagctgggtaccaggaattggacctcatctagagcatgcaggtgaggctttgcctcaacctcgctctgactacctgaagcctcatctcccacatccctcgcttcccacaatcagtgctgtgccacatcacaccccccactgtgcccaggctgttccctctgcctgtggtgcctttgccattccctcccactacactccccatgtccatcgtggcagggactcaatttatcatgctcccttaggtaagctgacaggaagatgcatgctggacccctttgatttttttttttttttttttttttgagatagggtctggctctgtcacccaggctggagtatagtggtgtgatcatggctcagtgcagcctcaacctcctgtactcaagttatcctcccacttcagactctcaagcagctagaactacaggtgcacacctccatgcctggctaatctttgggaaaaaaatttatagagacagtttgtctctatattacccaggctggtctgtaactcatggactcaagaaattctcccacctcagcctcccaaagtactgggattacaggtgttagccaccacacctagcctggacccttttgagtgcaaaggcagcacccagcatctctgtgactcccccaacagcccgctgggtcagaactgctatcaaccccatttacagaggaaaaaactgaggctcaagctgttcctcagcttctcagtcatctggctggtcagaggctcaagcccaagtctgttcttggactgtgagggccagaccaagtcctgagggggcttagataacctaaaggactccctctttctttcctttctccctcccaccttccttcctttctatcctccttcttctctcttttccttccttctcctttccaccttccttctactccattctctgtgcttagtgaatgaagaaattaacacattacttggcccttgtcctcccctgtctagattgcatgcttaacaaacatttgatgaaggactgtcctctgacctagagctatggccaaatgacagaacaaatggtcattgctactcgtgcctttgggaagtgggcaaagcctcaagtttcaggctgcagaggaaggagggtgattgaaatagatccagcccgggagcggtggctcatgcctgtaatctcagcactttgggaggctgaggtgggcagatcacctgaggtcaggagtttgagaccagcctggccaacgtggtgaaacctcgtctctgctaaaaatacaaaaactagccaggcgtggtggcatgcgcctgtaatcccagctacttgggaggctgaggcagaagaatcgcttgaatccaggagacagaagttacagtgagccaagattgcgccactgcactccagcctggatgatagaacgagactccatctcaaaaaaaaaaaaaatagatctaaagggaagagaaatggagatgctacaagacagaagatacgtctgtcctggcagcagtgtggagctgggaaacagagacgctgacagcagcaatggggatctcaggaagcagtgcctgcttgttcaaaggctcagggattacagtaacactcaggctgccagagccagagggcaagaccctgcaagcaccagttcagagcccagactcaggtcacacagacctgcccataagtccctgtgtgaccctggacagtttccttctctggagaggagagtgccaggctccctggctatggggaggattcagcgatgaggcttgtaaagtgcagatgggaaggggctgaccactcgctgcagaggcacatgagctagggagctgggccagggccaccagggcaggaagccagcccagtaggccagggggccccagccagagagctagaagctcgcaccatactgccctcctggcccaggaagatgtggaccagccaggcaggctgcagggcccaggaagagcagcacggtccctctccaggtatccagccccatccagtgctgggggatggaaggaactccactggaactcagcgggttagggtctggccaggtaaccctccctctctgagctccagtcctccctgcaccctcaaacgagggtcatgataggacgggaaaatatcagtgcaagaagggatgtgagtgccctgagggtggtgggcatgggtgagggctggtacagatagccagactgcaggaggctgggggtttgcagctccagttcccactgcctgaaatcgcctcccagctcctctggcagccctcactccctctccttcagctctcagctcttgtgtttcctccttgcctcatgcaggaagcctgctctgatgcggctcttctccccatgagcaccacattcctcacccagagcactcgcccaagcgccaatgttactacattccattgttgtttgtatttaacctttgcattctcccccaaactgagccctgaggaacccagtttgaaaaccattcatgtaatccatcactttcatttattgtttgtttgtttgtttgtttgtttattttgagacagagtcttgctctgtcacccaggctggagtgcagtggcacaacctcagctcactgtaacctccacttcctaggttaaagcaattctcctgcctcagcctcccgagtagctgggattacaggcaactgccaccacgcccggctaatttttgtgttttttagtagagatggggtttcaccatgttagccaggctggtctcaatctcctgatctcaagtgatccacccaccttggcctcccaaactgctgagattagaggcgtgggccaccatgtccagcttcacttttatttcataggtgagaaagctggaccgggagagggtaggagcttggtgagcccatgctgggacacctgcctcccagtctgcagctcattctcataggtcatggactgtcaattccctaaggacagcagccacatctggcctgtctgcctctgtcttcttcagtcctgtatttactgagcacctatcatgtgccaggcactgttctagacatggaggagacagcaaagaacagacagaaaacacatagaaacaaaaataaaaaatatgtggctgggtatggtggctcatgcctgtaatcccatccctctgggaggctgaggtgggaggatcactcgagattaagagtttgagaccagcccaggcaacatagggagaccctgtctctacaaaaaaaaaaaattaagtgttttttgtttgtttttttttttgagacagagtctcactttgtcgccaggctggagtgcagtggtgctatcttggctcactgcaagctctgcctcccgggttcacgccattctcctccctcagcctcccaagtagctgggactacaggcgcccgccaccacgcctggctattttttgtatttttagtagagacggggtttcaccgtgttagccaggatggtctcgatctcctgacctcgtgatccgcctgcctcggcctcccaaagtgctgggattacaggcgtgagccaccgcgcccggccaaaaattaagtttttaataaataaaaataaaggatatggaatgaaaagctgggggagctactgtagcaatgggggatgggaggcttaaaccctcctgcaggctctcaggatggagcccattcccctcctcaaggccaggcaggctctacaaagcttggggctttggtagccgaacagaaatggagccaggccatgccggcaggagaaggatgtgaaccaggttgcccaggaacccagactccatggcccaaaagtcatagactggggttgtagagagagggaaagtggaatacagagctggcgatgtggagccaactgagatgtaagggggacatatcgccttctctccgggtcagggaagtcattacgtactgggatggggtatgtgtgtgtcgtgtgtgtgtgagcacacaatgggcaagaggtcctctaacccaggggttctcaaacttgtttcaaggagcataatgctttattaaaccaaaacccttcttcgaatctgataagtgacacttaagagtagatctgccggccgggtgctgtggctcacacctgtaatcccagcactttggaaggccgaagagggtggatcacgaggtcaggagatcgagaccatcttggctggcatggtgaaaccccatctctactaaaaatacaaaaattagccgggctcggtggcgggcgcctgtagtcccagctactcgggaggctgaggcaggagaatggcataaacccgtgaggcggaggttgcagtgagccaagattgcaccactgcactccagcctgggtgacagagcgagactccgtctcaaaaaaaaaaagagtagatctgcccattgaagcaagtaggggcactgtctctccccatccgcttcctgcatacctcctcccaaaaggcctatggtatttctgttttatttatttttattattattattgtttttattttggggggttgggtttttgtttttttggttgtttgaaacagggtctggctctttcgtccaggtggaagtggagtggcacaatctcagtccactgtaacctctgcctcccaggctcaaggtatccttccatctcagcctcccaaatagctgggactacaggcgtgcaccaccatgccaggctaaattttgtaatttttttatagagatgcagccttgccgtgttgtctaggctggtcttgaactcctgagctcaagtgatctgcccgtctcagcctcccatagtggtgggattacaggcatgagccgtcacatctggcctgttgttaattttttttcttttttttttgactcagactctcactctgttgcccaggctggagtacaatggcgtgatctcagctcactgcaacctccacctcctgggttcaagcaattctcctgcctcggcctcccgagtagctgggattacaggcacttgccaccatgcccagctaatttttgtatttttagtagagacagggtttcaccatgttggccaggctggtcttgaactcctgatctcaagtgatccacccaccttggcctcctaaagtgctgggattacaggcatgagtcacggcgcccagcctacaaaaaaaaaaattttttttttttttgagatggagtcttgcactgtcacccaggctagagtgcaatggcatgatcttggctcactgcaacctctgcctcgcgggttcaagcgattctcctgcctcagcctcccgagaagctgagtctacaggcgcctgccaccacacccagctaattttttgtatttttagtagagatggggtttcactatattggtcaggctggtcttgaactgcccaaagtgctgggattacaggcgtgagccactgcgcccagccagcacaggagttttgacctgctccttttcgttttcctttttctttctttcttttttttttttttttgagatggaatctcactctatcgcccaggctggagtgcagtggtgcaatctcagcttgctgcaacctccacctcccagattcaagcaattctcctgcctcagcctgccgcgtagctgggattaggcgtgcatgcgccacaatgcctagctaatttttgcatttttagtagagacgggttttcaccatgttagccaggcgggtcccgaactcctgacctcaggtgacctgcccaccttggcctcccaaagtgctgggattacaggcatgagccaccgagcccggccaacctgctccttttctaacctgggccagttcacctctccttagacaagctggtggtttcctgctcccaggaagtcaccaatttatgccaaatttagtgcagacaccccatcagtatagtacattacaatccagaagtcctggatccaagcaagcctcctgcctcagcctcccaagtagctgggagtataggtgtgtgcccagcagttctatatttccaaggaaccctggagccctaaagaacccagtttgaaaccaccactttcaggctgggcatggtggctcatgcctgtaatcccagcactttgggaggctgaggcctgtggatcacttgaggtcaggagttcaagaccagcctggccaacatggcgaaacctcgtctctactaaaactatgaaaatcagctaggcatggtggcaggtgtttgtaatcccagctatttgagaggctgaggcaggagaatcacgtgaacccaggaggtgaagattgcagtgagccgagatcatgccactgcactccagcgtgggtgacagagtgagactccatctcaaagaaaaaaaaaagaaaccatctctttcatttaataggtgagaaagttgaacctggagaaggcagcagcatggtgagctcatgcagggactcctgcctccctgcaactcattctcatatgtcctgggcaccagtgatgtgctaagtcacatgcagggatgcaatagggacaagggaaaacatggcttctgctctccccaagatcagagttgatgggggtgacaggcaggtcactggacaatcactgcacaacatgatgagaacagggatggcagaaacccagccctggggaagcctggctttgctcatccactcaaccaacattcccgaatgcttttgacatactttggggcagctgctggatggtaactgtggggttcccagagacccatccaccccagtgtcctttttcttggtgacagcctactctctttttttaattttaattttaatttttatttttgagatggagtctcgctctgtcgcccaggctggagtgcagtggcgggatctcggcccactgcaagctccacctcctgagttcatgtcattctcctgcctcggcctcccaaataagtgagactacaggtgcccgccaccatgcctggctaatggctaattttttgtatttttagtagagacggggtttcaccatgttagccaggatggactctacctcctgacctcgtgatacgcctgccttggcctcccaaaatgctgggattacaggagtgagccaccgcaccaggctttttttttttttttttttttttttgagacagtcttgctctgttgcccaggctggagtgcagtggtgccatcacagctcattgcgactttgacctcaccttgcaggctcaagcaatcatttcatctcagctggaaatgcagactgggtctcgctcactctgttgcccaggctagtctcaaactcccgggcttaagtgaccctcccatctcagcctcctgggtagctggcactacaggcatgcaccagcacgcccagctaaaattttttttgtagagacagggtctctctatgatgctcaggcaggtcttgagttcctgggctcaagtgatcctcccaccctggtcacccaaagggctgggattacaggtctgtgccaccatgcccggcccagcctgccctcctgacctgacagttgaggccctactggagactgcagcagggcatccaggctgtgaaaccccacccaccagctctgcctcagttgcccatgtgccctggcaagccagtggctctcactgagcctcaggttctcttccgtaaaacaaggctgtgatgaagattctctcaagatagtcctccctgtggctaccatgtccaggagcccagcaccagttcaaggctaaggccatccctgcatctcacctccccttcctctcacatacacactacatctgcctcacctctcataaagaacatctgggctgggcacggtggctcacgcctgtaatcccaccattttgggaggccaaagtgggcggatcacaaggtcaggagatcgaaatcatcctggccaacatgatgaaaccctgtctctattaaaaatacaaaaattagctgggcgtggtggcgcatgcctgtaatcccagctactcaggaggctgaggcaggagaatcacttgaacgagggagtcggaggttgcagtgagccgaaatcgtgccactgcatgccagcctggtgacagagcaaaactctgtctcaaaaataaaataaaataaaataaaataaaataaaataaaataaagggccatgcgcggtggctcacgcctgtaatcccagcactttgtgaggccgaggcgggcagatcacagggtcaggagatcaagaccatcctggttaacatggtgaaaccccatctctactgaaaaatacaaaaaaaattagccaggcgtggtggcgggcacctgtagtcccagctacttgagaggctgaggcaggagaatggcgtgaactcaggaggcggagcttgcagtgagcagagattgcgccactgcattccagcctgggcgacagagcgagactccatctcaaaaaaaaaaaaaaaaaaaaagaacatctggagccataattcccgatgttcttgttacttgacactgcctaaaggcatgttctgtgggttccggggaaactgatttgaaaaacttgagtgttgtaaaggagggccataagctgagtgaacacagcagttgtgagaggtcccaggtgcttcctggggacagggagacacgacagaccaagaagcaaaggggcctctgatgtgacttcaatatcaaggtcttgtcgggcacagtggctcatgcctgtaatcgcagcactttaagaggccgaggcgggtggatcacttgaggtcagaagttcaagaccatcctggccaacatactgaaaccctgtctctactaaaaagtacaaaaaattagctgggcatggtggctcaagcctgtaatcccagctacttgggaggctgaggcaggagaatctcttgaacgtggaaggtagaggttgcaatgagccaagattgcgccactgcactccagcctggcgacagagtgaggccccatctcaaaaaacaaaatcaatgtctcaatgcagactgccaggtatcaggtgtccatccatgtctccaaaaagccacttggcaccaggagcagacaggaagggcaaagaggagccagactgaagcagggcttcttagctcccaagccacacaggtggccaccagtcagagaggcagtgtgtgtgtgtgtgtgtgtgtgtgtgtgtgtgtgtgtatttcttcagttcagtgtgtgtatgtatgtttcttctgcagctcagtgtatgtgtgtattccttcagctcagtatgtgtgtgtgtgtatgtttcttctgcagctgtgtgtgtgtgtgtgtgtgtgtttcttctgcagctcaggatgcctccaacatttctgctgaagcctcaccctcactcctggcccatcctgaggcctctacctaagatgccaatgagtagcccagacactggggctccagtgtttgtcaccaggtggtacctggatgtgggaggtagacaggccagatggccagtttgggcagtgcccccatgcctatctggccctgggtccctatgccaccttgctggggagggtcttttcgcttacacctcctctgagccgactctgcgcagtaacacaaatgtgtatcaggcacatcctttcctcaaaaggtggatgaccagttgggtgatcagggctgttagggggctgaagggtcctggggagtccaggtctagccaagttgaggcctatcctgctgcattttccagccacctgacccaaatacaccacctgaacccacgaccaggtatgcccacaccccatgggtggccttaacacacacaccctgcccctttctccaagtacaggagcagcagcccagacttccctcggggcaccgcggcctgcttgggactgcacagtgcctgggagggtgcctggggagggtcacaagggacttggtgctagtagcaggaaaagtgtagggaccggaaaagcccccgtgcatcctggaagggacatgggccagtttgagcaggggtgtgggagtccagccctggccttgccaggtggagaggcgcctgggccagacatccgcggcaggaggcgggggaacatgccaagaggcggaaggggcacgcggagacccccagggggcgccggaaggggcgcgccgggcggtcggcggcggccgttggcgagctgaggcctgccaggcgaagtctggagaccagccgggccgcggccgcaatggccaaggactcgcccagccccttgggcgcgtcgcccaagaagccgggctgctccagcccggcggcggcagtgctggagaaccagaggcgggagctggagaagctacgggcggagctggaggcggagcgggcaggctggcgggcggaacggcggcgcttcgctgcccgggagcgccagctgcgtgaggaggccgagcgggagcggcggcagctggctgaccgtctgcgctccaagtgggaggcacagcgcagccgggagttgcggcagctgcaagaggagatgcagcgggaacgcgaggccgagatccggcagctgctgcgctggaaggaggccgagcagcggcagctgcagcagctgctgcaccgggagcgcgatggcgtggtgcgccaagcccgggagctgcagcgccagctggccgaggagctggtgaaccgcggccactgtagccgcccgggggcgtccgaggtttccgcggcgcagtgccgctgtcgcctgcaggaagtgttggcgcagcttcgctggcagactgacggcgagcaggcggcgcgcatccgctatctgcaggcggcgctggaggtggagcgccagctcttcctcaagtacatcctggcgcacttccgcgggcacccggctttgtcgggatcaccggacccccaagctgtgcattccttggaagaaccgctgccccagacctccagcggctcttgccacgcccccaaacccgcctgccaactcggatctctagacagcctgagtgctgaagtcggtgtgcgctcccgctcgctaggcctggtgtcctctgcgtgctccagctccccagacggcctgctctccacgcacgccagctcccttgattgcttcgcacctgcgtgttcccgctcgcttgacagcacccggagcctccccaaggcctccaaatccgaggagcggccctcctcaccagacacctccacccctggctcccggaggctctcgccgccaccatcgccactcccgccgccaccaccaccgtcagcccacaggaaactcagcaacccgcggggaggagaaggctctgagagccagccctgcgaagtcctgactccctcacccccgggcctgggccaccacgagctgataaagctgaactggctgctggccaaggcgttgtgggtgctggcgcgccgctgttataccctgcaagaggagaacaagcagctgcggcgtgcaggctgcccctaccaggcagacgagaaggtgaagcggctcaaggtaaagcgcgcggagctgaccgggctcgcgcggcgcctagctgaccgcgcccgcgagctgcaggagaccaacctccgggccgtgagcgcgcctatacccggcgagagttgcgccggcctggagctgtgccaagtctttgcccgccagcgcgctcgggacctgtcggagcaggcgagcgcgccgctggccaaggacaagcagatcgaagagctgcggcaggagtgccacctcctgcaggcgcgtgtcgcctcgggtccctgcagcgacctgcatactggaaggggcggcccctgcacccagtggctcaacgtcagagacttagaccgcctgcagcgcgagtcccagcgggaagtgctgcgcctgcagaggcagttgatgcttcagcagggcaacggtggcgcttggcccgaggcgggcggccagagcgcaacctgcgaggaggtgcgacggcagatgctggcgctggagcgcgagctggaccagcggcggcgcgagtgccaggagctgggcacgcaggcggccccggcgcggcgacgtggcgaggaggccgagacacagctgcaggcggcgctgctcaaaaacgcctggctggcggaggagaatgggcggctgcaggccaagaccgactgggtgcggaaggtggaggctgagaatagcgaagtgcgcggccacctgggccgcgcgtgtcaagagcgcgatgcctccggcttgatcgccgaacagctgctgcagcaggcggcgcgcgggcaggacaggcagcagcagctgcaacgcgacccgcagaaggccctgtgtgacctccatccttcctggaaggagatacaggcgctccagtgtcggcctggtcaccctcctgaacagccctgggagaccagtcaaatgccggagtcccaagttaaaggtagcagaaggcccaagttccacgcacggcctgaagactacgcagtgtcacagcccaacagagacatacaggagaaaagggaagcctccctcgaggagagcccagttgcccttggggagtcagccagtgtcccccaagtttcagagacagtccctgccagccaacctctgtccaagaaaaccagctcccagtcaaactcctcctctgaggggtcgatgtgggccaccgtgccgtcctcccctactctggacagggacacagccagtgaggtggatgacctggagcctgacagcgtgtccctggccctggaaatggggggctcggcggctcctgctgcccccaagctcaagatcttcatggctcagtataactacaacccatttgaggggcccaatgatcaccctgagggtgagctgcccctcacagctggggactacatatatatcttcggggacatggatgaggatggcttctatgagggggagcttgacgatggccggcgggggctggtgccctccaacttcgtggagcagattccggacagctacatcccaggctgcctgcctgccaaatcccctgatcttggccccagtcaactcccagcggggcaggatgaagctctggaggaagacagcttattatctgggaaagcccagggaatggtggacagagggctgtgccagatggtcagggtgggctccaagacagaagtagcaacagagatcctggataccaagacggaagcctgccagctgggcttgctgcagagcatggggaagcagggcctctccagaccccttctggggaccaaaggggtgctccgtatggctcccatgcagctacacctgcagaatgtcacagccacatcagccaacatcacctgggtctacagcagccaccgccacccccatgtggtatatcttgatgaccgagagcatgccctgaccccagcgggcgtgagctgctacaccttccagggcctgtgccccggcacgcactaccgggtgcgggtggaggtgcggctgccatgggacttgctgcaggtgtattggggaactatgtcctccaccgtcaccttcgacacactcttggcaggacctccctacccaccgctggaggtgctggtggagcgccatgcctcgccaggtgtcctggtggtcagctggctccctgtgaccattgactcagctgggtcctccaatggagtccaggtcaccggttatgctgtgtatgcagatgggcttaaggtttgtgaggtcgccgatgccactgctgggagcaccgtattggaattctcccagctacaggtgcccctcacgtggcagaaggtctcagtgagaaccatgtcactctgtggtgagtccctggattcagtgcctgctcagatccccgaggacttcttcatgtgtcaccgatggccagagactccaccctttagctacacttgtggcgacccatccacctacagagtcaccttccccgtctgcccccagaagctgtcactggctcctccgagtgccaaggccagcccccacaaccctggaagctgcggggagccccaggccaagttcctagaagcattctttgaagaacccccaaggaggcaatccccagtgtccaacctgggctcagaaggagaatgtccgagttcaggggctggcagccaagcccaggagcttgcagaggcctgggagggctgtagaaaggacctgctctttcagaagagtccccagaaccacaggccaccttcagtcagtgaccagcctggggagaaggaaaattgctaccagcacatgggcaccagcaaaagccctgctccaggattcatccatctacgcaccgagtgtgggcccaggaaagaaccgtgtcaggaaaaggctgcccttgagagggtacttcggcaaaagcaagatgcccaagggttcacacctccccagctgggcgccagccaacagtatgcatctgacttccataacgttttgaaggaggagcaggaggcactgtgcttggatctgcggggcacagagaggcgagaggagaggagggagcctgagccccacagcaggcaaggacaagctctgggggtgaagagagggtgccagctccatgagcccagctcggcactgtgtccagctccatccgccaaagtcatcaagatgcccaggggtggcccccaacagctggggacgggggccaacactccagccagggtctttgtggccctctctgattacaaccccctggtgatgtctgccaacctcaaggctgcagaggaggagctggtcttccagaaaaggcagttgctaagagtgtggggctctcaggacacccatgatttctacctcagcgagtgcaacaggcaagtgggcaatatccccgggcgcctagtggctgagatggaggtggggacagagcagactgataggaggtggcgttctccggcccaagggcacctgccttctgtggcccacctcgaggactttcaggggctcaccatcccccagggttcctccctggtgctccaggggaactccaagagactcccactgtggactccaaagatcatgatagcagctctggactatgatcctggggatgggcaaatggggggccaggggaagggcaggctggcgctgagggcaggagacgtggtcatggtttacgggcccatggatgaccaaggattctattatggagagttgggcggccacaggggcctggttcctgcccacctgctggatcacatgtccctccatggacactgagcaagcatccttgcccaggtagtggcctctggctgctcacaccctgccagaggagaagcaagcgttcagaccctcacaccagcacccctcctcaccaccataagtagcatgtgctccaagtgccactgtgttaaactgatggtagtccttaagcgtcccctaggctctgaaagtagcaggacttaagcctgagttatttgcaaaagcaaacacaacaagccaacccctgagagtctgagaagccatttcaaagttgctgataactatggcaggtatacggagaagcgcctttttctgtggccaatgtgtgttttctctgggaggttaaggttatctgtccattgccttgtacgaaagtctcaagaaaagtctacatcttaaaaaagaaaaagcaatctgagtgttatttttgggatgtgagggtgatctggctgcgacatgtgtcaccccattgatcatcagggttgattcggctgatctggctgactaggcgggtatccccttcctccctcaccactccatgtgcgtccctccagaagctgtgtgctcaatggaagaggatgaccatccccgatagaggacgatcggtcttcagtcaagagtataagagtagctgcgctcccctgctagaacctccaaacgagctctcagaatgttatttttctgtcttatgtccaacccctcattaaaatgttcatagaaaaaacatattttagaagttgaagcacaaccaaggaaacatgagcctggctttcctccctctcacttctgcgcactgggtccgcaagggctacagaaatgttttcctggctgaggaagggagggtgcacccttctgctttttttttcctggctgcagtctattcccagaacacattccatcacatggttcccagaactcagattgtgcggtggccacgtcatcattggctggggctcacagtcacagcagcagaggcctccctaaacctccctctcctctagccccacccgctgtcccctgctcctcatgcccccatgctgtgtcccctggcctcacttccgttgccatgttttcataatcctctcaggctctgggcagcagcgctgcccacagtaggaccagatcatgtaaggaaaatactgcaggctcatcttggggctgcactggggacctgagaacaccttatcctactgtacgtgcggcacctcatctgacaccagcttctctgctttgcccaaggtccctaggccctgaatgcttactttttaaggtcagcctggctcaggatatgctagtttggctgcagagggtcctactaagagccaggactgaggagcaaggcccaaaaaactcctctgggccacatcttccccgagggcatccccgcagggaggccgtgtgctgctgagccctttgctaggagtgggtagtcagtgtctcccacatgacgatcttgcttcattcagatagctttcgtagctcactgcttttctgagtcacttcctgtgagggatcaccttgggatggcatttcttttccttttttttttttctttggagacagagtctcgcactgtcacccaggctggagtgcaatggcacaatctcggctcaccacaacctccgtctcccgggttcacacaattatcctgccttagcctcccgagtagctgggattacaggtgcacaccactacacctggctaattttttgtatttttagtagagacagtgtttcactatgttggccagactagtctcaaactcctgacctcgtgatccgcccgcctcagcctcccaaagtgctgggattacaggcgtgagccactgcgtccggccttcttttccgttttttttttttttttttttttgagatggagtcttgctctgttgcccaggctggagtgcagtggtgcaatctcagttcactgcaagctctgcctcccgggttcacgccattctcctgcctcagcctcctgagtagctgggactacaggcgcccgccaccacgcctggctaattttttgtatttttactagagacggggtttcactgtgttagctaggatggtctcaatctcctgacctcatgatccgcccacctcagcctcccaaagtgctgggattacaagcatgagccaccgcgcccggacctttcctttttttgagacagagtcttggtctgttgcccaggctggagggcagtggcacaatcacagctcactgtagtcttgagcttcagggctcaaatgattctctcacctcagcctcccaagtagctgggactacagatgtgcaccaccacacctggctaatttggtgtgtgtgtagaagcaggggtctcactgtgttgcccaggctggtctcaaactcctgggcccaagcaatctgcctgcctcaacctcccaaagtgctgggattacaggcctgagccaccacacctgatgcctggctaatttttaaattttttggtagagatggggtcccactatgttgcccaggctggtctggaactcctgcgctcaagtgattctcctgccttggcctcccgaagtgctgggattacaggcctgagccactgcacacagagggcatttctttatttgccccattttgcagaagagcttcctgaggctcagagaggcccctcatctaaggtcacatcatggctcaaagtcacctcctccatagactccccaggctgcccctctgggagggcgggaatgaggggtggtctttatccttctctccctctctttgatacccttttgtttccccacgtccaacaacactgtcagaggaaagacacttccagaatacccaggtaaaaaaaaaaaaagagacaataaggaaaggacactgccttctccggtgtcatcagaaatgattgaaagaggccgggcgcggtggctcacgcctgtaatcccagcactttgggaggccaaggtgggcagatcacgaggtcaggagatcgagaccatcctggctaacacggtgaaaccccatctctactaaaaatacaaaaaaattagctgggcgtggtggcgggcgcctgtagtcccagctactcgggaggctgaggcaggagaatggcatgaacccgggaggtggagcttgcagtgagccgagactgcaccactgcactccagcctgggtgacagagcgagactccgtctcaaaaaaaattaaaaaataaataaataaataggccgggtgccatggctcacacctgtaatcccagcactttgggaggctgaggcaggtggatcacaaggtcaggagttcaagaccagcctgaccaatacagtgaaacactgtctctactaaaaatacaaaaaaattagctggacgtggtgacatgcacctgtagccccagctacttgggaggctaagcagaagaatcacttgaacccgggaggcagaggttgcagtgagccaagatagcgccactgcaccccagcctgggcgacagagaaagactccatctaaaaaataaataaataaataaatcacattaaaaataaacttaattttttttaaaatttaagtttaaaaaagtaggccaggtgcggtggctcacgcctgtaatcccagaactttgggaggccgaggttggtggatcacgaggtcaggagttcaagaccagcctgaccaacatggtgaaaccccatccctactaaaaatacaaaaattagctgggtgtggtggtgggtgcctgtaatcccagctactcgggaggctgaaacagagaattgcttgaaccctggaggtggaggttgcagtgagccaagaatgcgccactgcactccaggctggtgacagagtgagactccgtctcaaaaaaaataaaaataaaaaatcactgggcatggtggcccgcgcctatagtcccagctactccggaggctgaggcaggagaaatgcttgaacccaggaggtggagcttgcagtgagccgagatcgtgccactgcactccagcctgggcgacagagcgagactccatctcaaaaaaagaaaaggaaggaaggaaggaaggaaggaaggaaggaaggaaggaaggaaggaaggaaggaaggaaggaaagaaggaaggaaggaagattaaatgtcaatggctcatacttgtaatctcagcactttgggaggcgaggcaagtggatcgcttgagcacaggaattcaagaccagcctgggcaacatgttgaaaccccgtatctactaaaaatacaaaaattggcctgatatggtggttcacacctatggtcccaactactcgagaaggtgaggtgggagaatcgcttgagcctgggaagcagtggtttcagtgagccaagattgagctactgcactccagcctgggtgacagagtgagaccctgtctcaaaagaaaaataaaataaaataaatgacaatgtaaaggcaaattttgtctataacaacatcataataggacattgaattattacagtgcagttgttataattaagtttacaatagaatattcatggctgaaacccagacaaactaaaatcaccaactgcttacaaaccaactgcttactagtgaaaacccaaataggtaaggcttttttttagcagtgagtctctgctcagtgaggacctgggcaccctcatttttttgagtcttggtatttctttccatctgaaaggatggagcggatgtgtggatccccaacgttttcagttcttccacctggtcctcattctgtcatggcgtgatcatggctcactgcagcctcaacctccagggctcaaaccatccttcccgctcagcctcctgagtatctggaggcatgcgccaccacacccagctaattaatgtgtgtgtgtgtgtgtgtgtgtgtgtgtgtgtgtgtgtagagatgaggaattctcgctatgttgcctagcttggctccaactcctggcctgaagccatcctcctgcctctgcctcccatggaatagttgattgttgttgttgttgttgttttgagatggagtctcactctgtcactcaggctgtggtgcagtggttcgatcttggctcactgcagcctcctgggttcaagcgattctcctgcctcagcctcctgagtagctgggcctgcaggtgcatgccaccatgcccagctaattttttttttctttttttttgagacagagtctcactctgtcacccaagctggagtacagtagtgtgatctcggctcattgcaacctccgcctcctggtgcaagtgattctcatgtctcagcctcccaagtagctgggattacaggcatgcaccaccatacccagctaattttttgtattttagaagagacggtgtttcgctatgttggccagactggtctcgaactcctgacctcagatgatctacccgccttgctccaaaactgctgggatttcaggtaggagccactgcacccggcctatggaatagttttcaatgccttgtctagctagggatcattgaacatgttgtatgcggggtagactgcagctgcaggatctgtaccagggtgttggtgaagacgcaatggggttgccccagcgtccttgagaaagactaccaccttgtggccgggcgcggtggctcatgcctgtaatcccagcactttgggaggctgaaacaggtggatcacgaggtcaggagttcgagaccagcctggccaagatggtaaaaccccgtctcttccaaaaatattttaaaaattatctgggtgtggtggctcgcgcctgtaatccaagctactcaggaggctgaggcagagaattgcttgaacccgggaggcagaggttgcaatgagtcgagatcatgccactgcactccagcctaggagacagagtgagactctgtctcagaaaaaaaaaaaaaagcaaaaacctaccaccttgcacttcgttcaacagagtgtccagttgctccacagagcctgcactccacagtctgccgccacccgtgccacactcacagcaaagcagagttcccactgctcagcccagggacctgctcaatcctgctcgctcactggagcccttgacggactgggacctcggctggcaggtctttggcttccttcccttagcataatgtccttgagcttcatccatgttgcagcatgtgtcagaatttccttcctttcatgaataattgtttaaggccagggtggtggcacaagcctgtagttccagcactttggaaggccaaggtggatggatcgcttgagccaaggagttggagaccagcatgggtaacatggcaaaacctcatctctattattattatttttatttttattttattttattttattattattttttgaggtggagtttcgctctgtcgcccaggctggagtgcaatggcacgatcttggctcactgcaagctccgcctaccgggttcacgccattgtcctgcctcagcctcccaagtagctgggactacaggcgcccaccagcacacccggctaattttttgtatttttagtagagacagggtttcaccatgttagccagtatggtctcgatctcctgaccttgtgatctgcccgcctcggcctcccaaagtgctgggattacaggtgtgagccaccgtgcccggcctattattattattttgagacagagtcttgctctgtcacccaggctggagtgcagtagtatcatcttggctcactgcaacctccgcctcccaggttcaagtgattctcctgcctcagcctcccaagtagccaggattattggccgcccgccacaatgcctggctactttttttgtatttttagtacagacagggtttcaccatgttggccaggatgctctctaactcctgaactcaggtgatctgcctgccttggcctcccaaagtgttgggattacaggcgtgagccactgcacctggccttcatctattttatttattttattttattttattttattttattttttttttattttattttattttattttattttattttattttattttatttattttattttattttttgagacagggtcttgctctgtctcccaggctggagtgcagtggcgctatcttggctcactgcagtctccgcctcccgggttcaagcgattctcttgcttcagcctctcgagtagctggaactagaggcatgcgtcaccatgcccagctcaggtttgtatttttagtagaggcagggtttcaccatgttgcccagactggtctcgaactcctcacctcaagtgatccacccaccttggcctcccaaagtgctgagattacaggtgtgagccaccacacccggcctcatctctattattttaaaaaacatattttttggccgggtgcagcggctcacacctatagttccagcactttgggaggccgaggcgggtggatcacaaggttaggagttccagaccagcttggccaatacggtgaaaccctgtctctactaaaaatacaaaaattagctgggcgtggtggcgcgtgcctgtagtcccagctacttgggaggctgaggcagaagaatcacttgaacccaggaggcggaggttgcagtgagctgacatcatgccactgcactccagcctgggcgacagagtgagactctgtctcaaaaaaaatcccatattttttaattgtttaaaattattattaatatttatttattttatttatttattttttttgatggagtctcgcactgtcacccgggctggagtgcaatggcgtaatctcggctcactgcaacctccgcctcatgggttcaagtgattctcctgcctcagcctcccaagtagctgggattacaggtgcccgccaccacgcctggctaatttttttctatttttagtagcgacgaggtctcactatgttggccaggctggtcttgaactcctgacatcatgatccgcccacctcggcctctcaaagtgctgggattacaggcatgagccactgcacctggcctattatttttttcttgtttttttatttccatatttttttttcttcttcttcttactttttaaaagttttatttatttatttatttattttttgagacagtttcactctgtcacccaggctggagtacagtggggtgatcttggctcactgcaacctccgcctcccaggttcaagccattctcctgcctcagcctctcgagtagctgggattacaggtgcccaccaccatgctcggctaattttttgtgtttttagtggagattgggtttcaccatgttggccaggctggtctcgaacttctgacctcaagtgatccaccccgcccccaccttggcctcccaaagtgctaggattacaggcgtgagccactgcacccggcctatttcttttttatttttatttttatttttatttttattttttggagatggagtttcactcttgttgcctgggctggagtgcaacggcacaatctcagcttactgcaacctcaccttgcgggttcaagcgattctcctgccttagcctcccgagtagctgggattacaggcacacaccaccgcgcccagctaattttgtatttttagcagacatggggtttctccatgttggccagactggtatcgaactcccgacctcaggtgatccgcccgccttggcctcccaaagtgctgggattataggcgtgagccatcgcgcctagccaattattattttttaagagactggggtctcactatatttaccaggatggtctcaaactcctggcctcaagagatccttccgcctcagcctcccaaagtgctgggattacaagcatgagccattacgccaggtctttatctaggtttttctattgtctgtatttcatcatccaaccatcccctaccagagtgtgcctggccaattttcttcccttcttccaccacacgtttctttttgtttgtttgtttgtttgagacagtgtctcactctgtcacccgggctggagtgcagtggcatgatcttggctcactgcaacctccacctcctaggttcaagcgattctcatgccttggcctccagagtagctgggattataggcatgtgccaccacacctggctaacttttgtattttcagtagagagggggtttccccatgctgtctgtgctggtttccaactcctggcttcaagtgattcgcctgcctcagtctcccaaagcgctgggattataggtgtgagccaccacacctggcctccttcctttttaaggctgaataatagtccattgtgtgtatgtaatgcattttgtttatccattcatctgtcaatggatactttggtcgtttctaccttttagctattgtgaataatactgctgctctcctttacactttttcaaagcactagatccctgatgagcccacagcctagaaatggagtctgagcacagcaagccacaagacagctgcttctgccgagaggacagcctgggaccttttgggtcaggggcaagagacttggaggttggcaggctgctctctgactgagaagtggggacaagtatggttcccacacactagggaagcaatgacagactagcaagagaatagaaactttaattcatgcactctcaggccaggcatggtggtgcagacctgtaatcccagcactttggaaggccaaagtgagccactgtgccctgttgtgttttgatttttgagacagaatctggctgtcacccaggctggaatgcagtagcacgatcatagcctcaacttcctgggctcaagtgatcctctcacctcagcctcctgagtaactgggactacaggtgcatgtcaccacacctagctaatttttcttttttttgaaacatagtcttgctctgtcacacaggctggagtgcagtagcacgatctaggctcactgcaacctctgtctcccaggctcaagcaattctcttgcttcagcctcccgagtagctgggattacaggcatgcgccaccacgcccagctaatttttgtatttttagtagagacgaggtttcaccatgttggccagggtggtctcaaactcctgacctcgggtaatctgcccactttggcctccctaagtgttaggattacaggcatgagccaccatgcctggcaatttttttgtacagatggaattttgccatgttgcccaagctggtctcaaattcctgggctcaagcaattcacctaccttggcctccctacaggcatgagccactgagcctagcctccagctaatttttacattttttgtaaagacagggtcttgctatgttgcccaggctgatctcaaacacctggcctcaagagatcctcctgcttggcctttcaaagcacttggattattggtgtgagccaccacttcccacctagcctgttccatcactttttacttaatttcacaactttccctgaccattgcctcaaatcagctttttttctgacagctgcgttgtagtctttgtcagagttatgaggggcacccccactcttcactccagcccccacctgttttattttcctccataaccctcatcaccccccagcatgttacctaggtttttatcttttttttttttttttttaattaagacaaggtctcggccaggctcagtggctcacgcctgtaatcctagcactttgggaagccgaggcgggtggatcacgaggtcagcagatcgagaccatcctggctaacacagtgaaaccccgtctctactaaaaatacaaaaaaattagccaggcgtggtagcgggcgcctgtagtcccagcactcaggaggctgaggggcgcctatagtcccagctactcgggaggctgaggcaggagaatagcatgaatccgggaggcggagcttgcagtgagccgatcgcgccactgcactccagcctggatgacacagtgagactccgtctcaaaaaaaaaaaaaaaaaaagacaaggtctcactctgtcacccaggctacagtatggagtacagtggcgcaaccacagctcactgctcactgcggccttgacttcctgggctgtcgatcctcccacctaaacctcccaagtagctgggactgtaggcatgagccaacatgcctggctaatttttgtattttccgtagagacagggtttcgttcaagccactgcacctgatcgtgtgttttgggcaactctgggagcagtggcacaggaaagaagaaagggactggggacaggtgccaacccatcagctggtgtggacctcctccccctgggagggttacaagtccagggaggaggacctcatgctgccgccagggggcagcctaggtgcacttaagggtcattctccaggggctgcacacctggcagagctgcctgggccacacctgcctgcccagtgtaagggggaataggaaatactgtatctttttgaccaagcaggcctggaatccacaccccacccgaccagccccattctctccctcccttctccccagagcaccctaggcagcccaccccccacataaccgagaggggctgtccttccaggggagcagggaccagtgtcaggcccggtcattctgacacccacccacagaaagatctccttcttcacccctctggcagccctgctcccctaaatcctcaacttcagaggccatgggcagttttaaagaagcataaggctggagaggcagggccacagagccactgggctccagaacccagtcactggatccaaatgccagcctgctcacagacagctgcaaggcctctctgagcctcatgttcccagactgtggcagaactggttttgttttgagcaggtcaggtgtgcagaacacttggcctggtgtcaggaccccgagaaagacccagacagctgatgagaaggggggcgtcatggcttgtgcctgcaatcccagctacggcggaggcagagaggggaggatcacttgcgaccaggagttcgagacaagcctaggcaacatggtgagactctgtctctacaaaaaaaatttaaaacaggccgggcgcggtggctcacgcctgtaatcccggcactttgggaggccgaggcgggtggatcaccaagtcaggagatggagaccatcctggccaacacggtgaaaccccgtctctactaaaaatacaaaaaattagcggggtgtggtggcacgcacctatactcccagctactcaggaggctgaggcaggagaattgcttgaacccgggaagcagaggttgcagtgagctgagatcgcaccactgcactccagcctgggcgacagagcgagactgtgtctcaaaaaaaaaaagaaaaaagaaaaaaaaagaaagctgatgagggcacaggtcgggggtgggggcaagggagcacagttctaagccccagcttggctccccgtgcagagccctgagaatctggagactttcagcagaagggaaggccgcacaggtctagcaagttggcaggctgctggggggtaggggtgggctgggaaggaggtggatgcctggctgtggcctgcaccaggccccttccctgactgactgcacgacctggaggcccaaaacctgtccagtccagacctgcccaggaggggaacgagcggggatgggcagcccagccggcccgaaggcagaggagcctaacgagtgggcgaaggggcggtgtccggagagttctggtgcaagggtcactaagcctgtccaggccccatccacccctgcccaggcgcctctggcccatctgccccctccacctctagctgacctgccccctctcgctcactgcggctatggattttgaaagcatgaggctaactgatcaatttcagagtcattgtaaaaaatctggagaagatttcacaagaacacgatatgaaagatacgactttttaaaagctcagagatatctctgcagcctattttaagctcattccaccttctggtcacaccctactctccctgtctcactactggggtggttgaatttggaggctgggtggggtgtgcaggaggtcaggtgttccatctgaggcggaacaagatgggccaactctagtcttgtgaaacaaagcacattgccaggtggagctggctccaggaacctaggcacagagggttccacacacggtggcattgctgacaccgcagccggccgcacaggtcctgccggcctccaggctcagccccacctgtccctgtcttcggtgctgggtggggtctataatgggttgttcccccaggctggaatgctctgtttggaagatctcctaaacatcccccgcccacagggcccatccaccctccccataaagccctagccctcactatctatatctgatatccacaggcttctgtgccgtctttttgccctttcacggggtccctagaagccccagtaaatcctcctgtcactgacggcctggctggttgtacctaccttggtggaactccaggacctgggcctcagtcttagggttgccacggtgcacagcctcttggtcagggtgctttgggtcgaaggtgccctcctgagggcaaagtaccttcctgcccggcctgagaatggagtgggggctgaatgtgaaccctggcccactcacttctcagttgagagacctcaggcagttcctttgttttttgactttcagcctcaatttcctcttccctaaaattggccttccagctgccctgtgcctacagccagctcactcccaggtatcctttgaaagcaccctccaccacctcttgcaggcagccttccccattctcccctcccttacaggatttagctacccctcccacgtgctcggacagcccttaggcataatcccaaaacgcacccaggaattactcattcatcctgctacctctcccttcagactgtcttactccaccctgcaccctgaatgcaggtacctggacctggcatggaccaggcaacgggatttgtggactaacccatttccaacttaggaaaggcaccaaccagctcgtgaatgagaagcactagactgaggctctcagcggccatacttcccctggaaaactgacctttcctgagctcacatattgctcagcacagcatacccagctagtttaattatttcccccttttacatagggaataactcagatttggagaggggtgtggtcatttagcaggttgggggcagagctgggggcccgaacccaggtgtgtccctttgaccaatgcccttatctataggattccttcccccaccctggggcagggcctgggtctagggaggaggccagagggagagataggaattcaaattggtggtgctggtggtgggggaaggcgaggccctgggagtggccagcactcagggcttgggcaacagggtgctctgcagagccactgggtggggggaacagcaggggcaggcacagacctgctgagtcagagacgccgcagggactccagggggaggtgtttggcagatggctgtgggctggggcccggcaaaagcaccacagggtggtgggtcaaggagtagaattgggtgctgaggccctagccaggaccaggggatgtaagaaggaggaggccttggagagggcagggggcaacgttttccagaaggagggagtggtcagtctccacaaggtcaggcgagataagcgctactgcacccagcctccctcatgactgtgaccagaggctgttgccccagctcaggggcttcctagcatcttggccatgagggatatgtgtagcccccgccccaccccccgccatctgaggccctgctgggccctggtgatggaggaaggctccccagagaaaagtaggaagatagagtttgcaaattccatgccattaggccttggtccactcccaccctctttttattattattattattattattattattattattttattatttgttttttttttttgagacggagtttcgctcttgttgcccaggctgcagtgcaatgatgtgatctcagctcactgcaacctctgcctcccaggttcgagagattctcccaggtcagcctcccaagcagctgggattacaggcgcctgccaccacgcccgactaatttttgtacttctgtagagacagagtttcaccatgttggccaggctggtctcgaactcctgacctcgagtgatctgcctgcctcggcctcctaaagtgctgggattacaggcgtgagccaccacgccaggccctctttttattttagacacagggtttcactctgttgcccaggttggagtacagtggtgctatcatagctcacttcagcctcaacctctccaggctcaagcaatcctcccacctcagcctcccaagtagctgggactacaggtgccaccaccacgcctggctaattttttaaaaagttttttgtagaaacaaggtcttgctatgttgcctaggctgttctggacctcctgactctgtctcccaaagtgttgggattacaggtgtgagttcattgcacacagcccatccctttcactacaggaggcaagccagagccccaaagaggttcttggtgcctcaagaaccctgttcctcagcccagattgaggaggggatgtgttttctccactcctgccccacctccaaactgctagagaggaacctcagcagggaaatgaagcattgcttcaccttgcctctacctctggccctggggtaccctctctgtccacttgacccccactcctccaaccactgaggctgtgctgaccttctgcctgctccatcctgtaactacctcacattcacacaacccaatgaagtagatatggctctgagttccatttcacaggtatgaaaactgaggtccatagaagtcagttctagggcgtctggcctagtggcacagccaggacttttttttttttttgagaccaagtctcgctctgtcaccacactggagtgtagtggcacgatctcagcgcactgcaacctctgcctcccgggttcaagtgattcttctgcctcagcctccggagtagctgggattacaggtacgcgccaccgtgcccgcctcggcctctgaaagtggtaggatcataggcgtgagccactgagttcggcattttttttttttttaatttttggacttttttttttggagactgagtctctgtcacccaggctggagtgcaatggtgcgatcttggctcaccgcaacctctgcctcccagtttcaagtgattctcttgcctcagcctcccgagtagctgggattacaggcatgtgccaccacgccaggctaattttgtatatatatgtatattttttttttagtagagatggggtttcaccatattggtcaggctggtctccaactcccgaactcaggtgatccgcccacctcggcctcctaaagtgctgggattacaggcgtgagccaccgcgcccggccggatttggttcctggttcgactatctccccatgggtttcaccgagaaacagccctgctggcccttgtctccacctatcacagaagaacaactgggtcccctcctttacccatcctggggccactgtatcctacacacagaccccagaagacagaccctgccagtctaatggtggagacaactctgagatcaaatggcacgtggcagattgatcaggagcaggagacccaggacctgggagagacagagcactgaattcacaaactaccccaagcagagggcaagcaaagctccctaagaaagtggagccaggccagacacggtggctcacgtctataaccccaacactttgggaggccgaggccggtggatcatgaggtcaagagttcaggaccggcctggccaagatggtgaaaccgtgtctctactgaaaatacaaaaattaggccgagcacggtggctcacgcctgtaatctcagcactttgggaggccgaggccagcggatcacgaggtcaggagattgagaccatcctggctgacacggtgaaaccccgtctctactaaaaatacaaaaaattagccgggcatggtggcggacacctgtagtcccagctactcgggaggctgaggcaggagaatggcgtgaacctgagaggtggagcttgcagtgagccgagattgcgccactgcactccagcctgggtgacagagcaagactccatctcaaaaaaaaaaaaaacacaaaaattagcttggcatggtggtaggtacctgtaatccagctactgaggaggttgaggcagagaatcacttgaacccaggaggcagaggttgcagtgagccgagatggcaccactgcactccagcctggtcgacagagcgagactctgtctcaaaaaaaaaaaaaaaatagctgggcatagtggtgcacacctgtagtcccagctgcttgggagactgaggcaggaggatcccttgagcccatgagtttgaggctgcagtgagttatgattacaccactgcactccagcctggatgacagagtgagaccctgtctctaagaaacagataaaaatacaaataaaaaagaaagagcatggccaggtgcggtggctcaagcctgtaatcccagcgctttgggaggccgaggctggtagatcacgaagtcaggagtttaagaccagtctggccaagatggtgaaaccctgtctctactaaaaacacaaaaatgagccgggtgtggtggtgggcgcctgtaatctcagctactcgggaggcttgaggcagagaattgcttgaacccaggaggccgaggttgcaatgagccaagattgcgccattgcactccagcctgggggcgacagagtgagaatctgtctcaacaaaaaagaaaaagaggccaggcgtggtggctcaagcctgtaatcccagcactttggaaggccgaggcaggcggatcacaaggtcaggagatcaagaccatcctggctaacagggtgaaaccccgtctctactaaaaatacaaaaaattagccaggcgtggtggcgggcgcctgtagtcccagctactcgggaggctgaggtgggagaatggcgtgaacccgggaggcggagctggcagtgagccgaaatcgcgccactgcactccagcctgggggacagagcgagactccaaaaaaaaagtggccgggcgcggtggctcactcctgtaatcccagcactttgggaggccaaggggagttgatccggaggtcaagagattgagaccatcctggccaaccaatatggtgaaaccccgtctctactaaaaatacacaaattagctgggcgtagtggtgcacacctgtagtcccagctactcaggaggctgagacaggagaattacttgaactcaggaggcggaggttgctgtgagccaagatggtgccactgcactccagcctgggtgacaaagcgagactctgtctcaaaaaaaaaaaaaaaacaaaacaaaagagcagccagagaaaaccacactaggagtgaccttagagcaggcactgaagaacagcaaggcatggcaggcagagggcatggcaagggcacggccccttccttggctcctcagaccagggaagtcagttcccctcttatgaccagacaaagcagcctgcacctttttgcccagccccagcacccttgtgagtattctgtcatcttctccttagtctgtgggcttctgaggccagggaacacatctgtgctgttcactagcccagtgcccacctcatcattgctgtcagcatctgttggttgaatgacagttccatgagtggcctcccttgggctcaaggtgcctggctctgctaggggtgaaggagtggtgacttgacagggaggtgtgtggtgaggagcggggcacccatcacaggcctggcctttgctatagggaataggcttgctggggatgcattcttcagatggtgttcctaagagggtgaactgagctcatgtcagtctgaggggctggagtctgaggttagctacggaccttgggcaggtgacttaacctctctaaccttggttttctactgggtcttgccctgtcatcatggctaggctgcagtgatgcaatctcagctcactgcagccttgacctcctgagctcaagctattctcccacctcaccctcctgagtagctgggacttcaagcactcaccaccatgggcctggcttttttcttttttgtatttgtagagacagggtttcgccatgttgcccaggctggtctgtaactccagggctcagctgacccacccacctcagccttccaaagtgctaggattacaggcatgagccaccacccctggcctcattcatttgactttcattttcgtttttattattatttgttttagactcagggtctcactcagtctcccaggcgggagtgcagtggtgtgaccttggcttactgcagcgtcaaattcctgggctcaaatgatcctcctgtcttagcttctgagtagctgggactataggtacatgccaccaagcccggctaattttttttttttttgaggccgcgtctggctgttgcccagctatagtacaatggcgcaagtatagctcactgcaacctcgaattcttgggctcaagcaatcctcccacctcagcctcccaagtagctagtactatagacgagtgccaccatgcccggctaattttaaaaattttttgtagagatgagatgtcactgttttgcccaggctggtatcaaactcctggactcaagcaatcctcccgccttggcttcccagagtgctgggattataggcgccagctaccatgagtggtctcatttgactttttttttttttttttttgagacagagtcttgctctgtagcccaggctggagtgcagttgcatgatctcacctcactgttacctctgtgtcccgggttcaagcaattctcctgcctcggcttcccaaatagctgggattacaggcgtgcattaccacacccagctatttttttttttttttttttttgtatttttagtggagacaggatttcatatgctggccaggctggtctcgaactcctgacctcaggtgatcctcctgcgtcagtctcccaaagtgctgggattacaggcgcgaaccactgtgcccgacttcatttgactttttttgttttttgagatggagtcttgctctgttgcccaggctggagtgcaatggcgcaatcttggctcactgcaacctctccctcccgggttcaagtgattctcctgcctcagcttcccgagtagctggaattacaggtgcctgccaccacgtctggctaatttttgtagttttagtagagatggggtttcaccatgctggccaggctggtctcgaactcccaacctcaggtgatctacccgccttggcctcctaaagtgctgggattacaggcgtgagccactgcacctggcccctcatttgacttttaattgagaacctactttgtgccatgtataagctggatacaagagtgaacaagaccaagccttcctgccctcatgccaactgctcagcagtatttcaggactgtatcagggtgattagcctgggatcacaggagacttcctacaagagatgatgtctgaactgagttgttcaccaggcacaggtgggagaagggagaaggctggcctggacaggaggagccctggtgtgaatgcccagagatggcaggagaaatcatggcgtatataaggtgtcttgagcttgggatatgggaaggtgagaagtgatattgtatgggacatacttttttttttttttttgagacggagtctcgctgtcacccaggctggagtgcagtggcacgatctcagctcactgcaggctccgcctcctggggttcacgccattctcctgcctcagcctcccgagtagctgggactacaggcgcccgccaccgcgcccggctaattttttgtatttttagtagagacggggtttcaccgtgttagccaggatggtcttgatctcctgacctcgtgatccgcccgcctcggcctcccaaagggctgggattacaggcgtgagccaccgcgcccggccgggacatacttatattaagcattattggttgtttatccgaaattcaaatttgggcatactgttaaatgctaaatctagctgtcatagtaagaagctgaaatttactgtttgggggtattttgtatatttgttttctttctgttttttattgaaaacagataatggtaaaataacagacccttcctacatgacacaacaatcatagtcactgtaccagggctcaccagagcctgagttccgtgctctgcctgctcaacctcctgtcattcaagcctcccaagggggtggtgccctgattcccaaatggatgaggaaagcagatcatagtggttagatcttggactagacacacagagaatccggagggagtgaggacacaaaatgaacccatttctggcgggtcttcccatccctgctaatctgtagtttttatatttccatattaccttccgcccagatctagctttactgggttgctgccagggagaacaaatttttgaaatctgctattttatttatattaattaattaattaattaattactttaagacgaggtctcgctctgttgtccagcctggggtgcagtggcatgatctcaactcactgcaacgtctgcctccctagttcaagtgattctcccacctcagactcccgagtagctgggattatccgtatgtgacaccatgcctggctaatattttagtagagacagggtttcttcatgatcaccaggctggtctcaaactcctggcctcaagtgatccacctgcctcggcctcccaaagtgctgggattagaggtgtgagccactgtgcccagcctaaaaatattttttaatagcaccacagtgtaggctgggtgcggtggctcacacctgtaatcccagcatttagggaggctgaggcgggtggatcacttgaggtcaggagttcaagaccagcctggccaacatggtgaaaccccgtctctacgaaaaatacaaaaattagccaggcatggtggcagatacctgtaatcccagctacttaggaggccgaggcaggagaattgcttgaacccgggaggtggaggttgcagtgagcaaagattgtgccattgcactctagcctgggtgacaggagcaagactccatctcaaaaaaaaaaaaaaaacaaaaaaaaaacaaagaaaaaagaaaacaaaaagcaccacactgtaaataaactgaacaaccatggttaacgaagtgtgaataaattacagaagctccatactctggaacatttgtcagctcttaaagaatgaattatgatccttttgtagttcataagcatgatgattatgtgttcacacacgttcccatgtaagatgtgccaccttcaaatattttttttttttttttttaagagggagtcttgctccgtcacccaggctggagtgcagtggcgcgatcttggctcactgcaagctccgcctcccgggttcatgccattctcctgcctcagcctcctgagtagctgggactacaggcacccgccaccacgcccggctaatttttttgtattttcagtagagatggggtttcgctgtgttagccaggatggtctcaatctcctgaactcgtgatccgcccgccttggcctcccaaagtgctgcgattacaggcgtgagccaccgcgcccggccgccaccttcaaatcttgttacgacataggcacattacccgtctgacatgaaaaaaaaaaaaaagaatgaattatggaaatgaactagaaaaatgtctatgatttcaaaatagtaggatcttttttgtaaggtgagtagatacatattgatgtcagagaagagagttaaactgttaatgttacttcagaaaggactgattagggtggaggaggagggagaatttaactttaaaaaattgctgggcatgggctgggcacggtggcccacgccggtaatcccagcactttgggaggccgaggtgggcagatcacgaggtcaatagatcgagacaaccctggcaacatggtgaaaccccatctctactaaaactacaaaaattagcttggtgtggcggtgctcacttgtaatcccagctacttgggaggccgaggcaggagaatcgcttgaacccgggagccggaggttgcaatgaacggagatcgcgcctctgcactccagcctgggtgacagcgcgagactccatctgcacaaaaaaaaaaaaaaaaaaattaccaggcatggtgtctcatgcttgtaatcccagcactttgggaggctgaggtgggagaattgcttgagtctgggagtttgagatcagcctgggaagcatagtgagaccctgtctctacagaaaataaaaaattagccgggtgtggtggtgcatgcctgtagtcccagctgggagaatcacttgagcctaggaagtggaggctgcagtgggccataatcacgccactgtgctccagcctgggcaacagagctagactctgtctcaaaaataaataataaaataaaaataaaatgtgcttcagcatctctagaattgttccgattagaaatgttactttcataaaataaaaataacacacacgctaaagtatacatgtgtagaaaaaaaattcccaacttccagagagaacctccgtaaatatttttgatttattttcttcagttgcttttccatatatcaatatttttgcatgcatttaaaaaatgcaattaaaaaaaaaatttttttttgaggcggaatctcgctctgtcgcccaggctggagtgcagtggcgtgatcttggctcactgcaagctccgcctcccaggttttcacgccattctcctgcctcagcctcctgagtagctgggactacaggcatctgccaccaggcccggctaatttttttgtacaaaaaatacaattttttttaagacagggtctagctctgttgaccaggctggagtgtgcagtggtgtgattttggttcactgaaacgtccacctcctgggttcaagtgatcctcctgcctcagtcccccgagtagctgggactacaggggtgtgccaccatgcctggctaatatttttgtgtgtatttttagtagagatggggtttcaccatgttggccaggctggtatcgaactcctgacctcaagtgatcctcctgcctcagtcttccaaagtgctgggattacaggcgtgagccactgcacctggcctcttctttttttttttttttttaattatttttggctgggcgcagtggctcacgcctgtaatcccagcactttgggaggccgacgcgggtagatcatgaggtcaagaggtccagaccagcctcttgtaaaaatacaaaaattagctgggtgtggtggtgggcgcctgtaatcccagctactcaggaggctgaggcagagaattgcttgaacctgggaggcagaggttgcagcaagctgagatgatgccactgcactccagcctggatgacagagtgagactctgtctcaaaaaataaataaataaataaataaaaattttattttttaattaaaaatttacttatttattattattattattattattattattattggagacggagtttcactcttgtcacccaggctggagtgcaatggcaggatctcagctcactgcaacctccgcctctggagctcaagcaattctcctgcctcagcctcccaagtagctgggattacaggcatacgtcaccatgcctggctaatcttgtatttttagtagagacggggttttaccatgttggccaggcaggtctcaaacttctgaccttgggtgatccacccgcctcggcctcccaaagtgctgggattacaggagtgagccaccgtgcccatcctattaatttaattaattaatttatttatttattttctgagaccgagtctcactctgtcgcccagactggagtgcagtggtgtgatctgggctcactgcaacctccgcctcctgagttcaagcgattctctgcctcagccccccgaatagctgggattacaggtgcccgtcaccatgcctggctaatttttgtatttttagtagagacggggtttcaccatcttggccaggctggtgttgaactcctcacctcgtgatccacctgcctgggcctcccaaagtgctgggattacaggcgtgagccaccgcgcctggcctatttatttttttaaaatggagtcccactctgtcgcccaggctggagtgcagcggcaccacctcggctcactgcaacctctgcctcccaggttcaagcaactctcgtgctgcgcctcagcctgctgagtggctgggactacaggcatgtgacaccatgcttggctaattttttttttgagacggagtttcacttttgttgcccaggctggagtgcaatggtgcgatctcagctcaccgcaatctccgcctcccgggttcaagcaagtctcctacctcagcctcccgagtagctgggattacaggcatgcgcaatcacgcccagctaacttttcgtatttttagtagggacggggtttcaccataatggtcaggctggtctcgaactcccgacctcaggtgatctgcccgcctcggcctcccaaagtgttgggattacaggcatgagccactactcctggcctaatctacattccattatgtggactatttaaccccattgtgagaaatttgtatatgcttttttctttttttttttttgatacggagtcttgctctgttgcccaggctggagtgcaatggcaggatctcagctcactgcaacctccgcctctggagttcaagcaattctcctgcctcagcctctcaagtagctgggattacaggcatacgccaccatgcccagctaattttgtattttcagtagagacggggttttaccatgttggccaggctggtctcaaactcctgacctcaggtgatcctcccgcctcagcctcccaaagtgctgggattacaggcgtgagccaccgcctgtatatgctttctttcactattatacatgacacttaaaaaatattatcatatattagttatcttttttgttgttttttgagaccgagtctccctctgttgcccaggctggagtgtcatggcatgatctcagctcactgcaacctcagcctcccagattcaagcaattctcctgtctcagcctcccgagtaattgggactacaggcatgcacctcgatatccggctaatttttgtatttttagtagagacggggtttcaccatgttggccagggtggtctcaaagtcctgacctcaggcgatctgccggccttggcctcccaaagtgttgggattacaggcatgagccagccacattagttttcaaatgcagatgaaacaagggaccgtggaatgcctgttgtctcaggtgtgctcctaggcatgggttccaaacttacaggtacaaacttacttatgggtagagagacagataataagtacgtggtctgcaaacgtggctaatttccccagaacagaatcctggaatactggtctgagagggtataattattttaaaatatttttggggccaggtgcgttggcttatgcctgtaatcccagcactttggaaggcaggaggatcacttgatcccaggagtttgaggctacactccagcctgggcaacagagtgagactccgagtctccaaaaaacaaaaaaagacaaaagaaccccaaaaaaacaacttttggctcataccgccaaactcatgtccaggaattttgaggtgatttatgtgcttccaaaagtatatgagagtgattacctatcagaccttgtgtttgaaggttatcacttgaaactgatttttaatttgtttaggagaaaacccagcttcttatagttttattttatttatttatttatttttttgagacggagtctcgctgtcgcccaggttggagtgcagtggcacgatctcggctcactgcaggctccgccccccggggttcacgccattctcctgcctcagcctcccgagtagctgggactacaagcgcccgccacctcgcctggctaattttttgtatttttagtacagacggggtgtcaccgtgttagccaggatggtctcgatctcctgacctcgtgatccgcccgccttggcctcccaaagtgctgggattacaggcgtgagccaccgcgcccggcctatagttttaatttatatgtcttgggttagtagaatggttgactttttttttcagtcgttccttcaaatagtgagtcctctgctaggctctatttgtggaatattcttgttcttcttcagggatgtttgatagctcttttttttccacagatgtttgatatttcctttttcatctattgtgttcttaccatttctaggatgtttctaggctttctattctatttcctgttctgtaccacactgaaatgcctgcggtagctttacaatttgttttgatatctgttagggcaagtctaccctcatgcctgcttttgttcccaaggggggaaaaccatagctgttttcggctatttatttttccaggtgaacttagaattttgtgaagtctaagaaatgttgttaggatgacattaaacctatacatccattaggaaagaaaggttgcatcatcagcttggcgaagggttattgaaactggtttttgatcttgactggagctggggcacaacttccctgtaaggcagacctgggctcctcttggacttgggcgacctcgatagtggtgtgttcctttgtttggtgttcaaagtagagagcggtccattaactagctccctagagaagcagtggcggctcaggccagcccagcccctgggaaggctatctgcatggcggccgggagcccgggtcctggtgggccggctcgggcaggcgcttgacccctggggcctgcgaggggctgcggccaccggaaggggctggctgagcgcagcgtgctgggtcctccgcgccctcggagcaggtagggttcgcgggggtgcgcccgcgggggcccgaggggcgctggggtcacgggaggggcgccccttctcttttgcacccaaccagcccgggcttccccaggagcccagacccccgagcttgcagtcactgctggctgcgcctttgagcctcgggcaaccgcagggagcgtcgagcaggggtcgcaaaggggtcggggagggggcgcgtaggccgatagaggtccctaattcggggctcctaggggtcagggtagggctaaaagggggtaagtccaccagagtttgagggggtgggcgtcagcctgtcggggggggccagggtccctgtcccgggggccggtatgcggtccgggtatttcaggggcgaggtcgcggtcctgccctggcgcttgaggtcggagtccggttagatgtccggggtctgggtccccggctcctcccgcgcacccctcccccacggcgccggaccccggcagcccgccccgcctagtgctgggaccgctgtccggcccggccccgcccccgcaggccccgcccctgttcacaggccacgcccccagctgccccctgtccccgccccgccgctcgcccattcagatgtgggtcaggggtgagcgggcggcgccgacgtcacaagcttccaagatggcgctgggcgggcggctgtgagcggcgctcggggcgcgctaggcggggagccgagccgggctggcggcaggcggacggggcgggcgcgtgcggcgcgagccgggcgctgaggacaagggccgctggtagggccggccggccggcgggcggagcgccgccgccgacgcacacgaggtgaggggcggccttgtggggcggggggcgcggggagcgggcgggggccggggccgcgggctgggcgcgtccccggggagaggggcgtggacgcgcgcgcgcccgggcgacgtgggactgcgcgcgtgggggacgcgctagcgtctggcgggcctgggctggggcgcacgcgggacccctggcaggcccgggctttgtgggccagatgcccggaggggcgcgggcggtggggcacccggggcacaaagcccaccgggccgcgccaggcccaggcggcgcgggtctgcggagcgggggtcggcgggcgagcgggcgccggctctttgtgccttttcattagcaatctaatccgaacagcgtcgggcgagctgcgctgcctgacaggcgggagggctcccattatgcaaacggccctgcgcccgcgttcgccccctcgctagaggattttgcgatttccaggactgcggtcctgcaccgtctgcggtctcctctcctcttgcctcctccccgcgggaagactggccacggcaggggcaggggcgggcctggaggggccgctcccagagggccgggctctgcggctggtgggctcgctgccctgcccccagacctctcctgtaggcagccgcttggcaggaagagagatgggcttgggggagggggtcggctttcagggggaagggaccggctggctgagggagggggctgaggggccccagcttgtcactctctgtttatcttccaagatggttcatattcacacaggcctgggtgtgtgcgtggttggggggggtgggggggaatgcctctccctggggggcagtgacttgctgagaggagggaatgaggccagataatgctcccaacggccccacccagaactgcctgggactgcctgtgtaagggagcccagtgctgagccggatgggttggagcggtgttaaagttatttatccatgtcttctcctgtcccccgcacccctagtcttttctagtaggagttgccaagcacatctggaaagctgtgttccccgaccccccactcccccaacagcaggaggggtgtaacccagggaagccacccctctgacatatgtgctggggggaggggcagagccttgcccctaggaatcctgtggcggtgggttgttgactgatgtgggattgctgtgtctcttgtgctgtcggagagctggcaggtagtggaggggccttgggagctcctaggctgaacttggggctgtcctccaaggatccaggatggagggatggagctgggtcactcaaacctaaggcctttctgggtctagcatttattgcttcctggcttctggcttggcttcttttcgtccattctcatctgccagtgtctggactccctgggccttcaggcaggcattttcaggagcacaggccatgtggttggtctggagccctgtgtcaaggagagtgtgcgtgcttggtggagcagggttgctggagtagtgtgaaaaaaagcagatgagctggcctctggagacaaagctgtgtggcaagactgctggtttagtgggctctgaacaccaagaacagggccgggagtctgatacttgggggctgaactgagtcctgtggcgcaggattgttgcctggaagtgaacgttccgtcttgtgccattgagactgtgaagatctctgggtcccacaggacgagcagtagacttggaaggctgggaagaggctccccagctgcctgccttgggaggtcagagctctcaggtgggtcggcaggccagtgtcgggctgggggagggaggttgtagtagagtgcctgtggcccagcttctctggtcagttggctctgagtgctgctgtgtgcccagcaacctctccctgcggtgtttttctgccagttgttggaacttgtagattagtcactgagtttttacgaccgattcctgaaaagaaaaatctccctctggttgctgcctctgtgtagaggaagaagcagcccgagggagtcaggcctttaattaaagcaaaaccgaaatgattgtcgaagttgctggaaggagaagagaaggcgcaggtggggcaggggtgatgagtcctgttgtgctgcatgatacctgctctggggacaggtaggcacgatcccatcctcgatccttggtcttggccagcagcccagccttctccacaagctgcagtcgcagattaatcctcacgtagtgttttctttccgtagatcagatttctcattttgttaataagcgcagcctcccatccacttgaagtcagctgttgtggacgaggagcaacagggttttgcattattgagctgatagcctgccgcctcccctcaagtccttattgtttgcggggtcagatctgaggggtggggaagtgccatttaatcagcagccagcccctggagaagagctggcggggcagttctggagagtgagagccgtgaggaaggaataaagttcagtttacccaggggacttgtggttccaaccttattgcttggtctgttggcctggagcagtcagccccaccccataccttgtcctgcccgctgcccccagtacctgatccctgggagagtggggcacttcttctgggctgctcttgctggcctgggaggcagctttcaccgcgggaagaaagaacacattgggttcctcccttcttgtctcctccgagcctggcctaggacggacccctgtggggcagtgagaggggaactggacttggtcggtcgcaaagtctgtagtgcattgctggctctgccatttactcccgtcatgaccttgagcagtgattgactctcctgccgggtttctacaatgggaacagaactggagtttacattcatgtatcgctgttttctggagctcagcctagggaaggcagacactcaacaaatgattataagatggggtgataagggctggcatctagcggagcgcagagggcatagcggtggcgtgggaggagccggccgtgggctggctgagaaccctggatgccatgtgggttggggttggcctggaggggaggggttttaaccaggaagtgactgctactgggttttaaaaggcagtggtagggtagagggtggcagtggagacagctggagagcactgaggacgcggacccacgggtactgtgtgagctgtgaagcccgcttgggagaccccactgccagccaggcatgtatgtggctctttttcaagctttttattcattccgccacattttctgagcgcaaagtcagtgcctggcccccttggtttagaccaagtcatgttggcccctgctttctggtgctcacagacttgcctgggcggggtgatagaggcgcttgcagttcagcacgcggcccgttctcctctggaggagggaaggagctgcttttggaagttaagtagcttgctgggggctggagggtaaatgcctttgactccaccgcctgtggaggcccatatagtgtggtgtctggagagatctgagatcgcactagggaggatggggctgaaagccccctccctaagagaggtcctggctcccatttaggggcttctgaaccagcccttccagtttgactctgcctggcaccgccagggttcgcttcctgctgggaggggccttgccctaagggttagggacctgggctgggggagggctctgaggaggggctgggccccgagggactgagggactgcaggcttgcttgccttgagcccagttttagctgggagtggcaaagcgagaaaagctggtggggatgggagctctgtgtgggcccccagtgagcttgataagggaggcgaggctgggagctggttccagcccgccaaagttcaggagggaagggccagactgcctgagaggggtgtggcgggactgagtggggagagggactccaagaaactgcttgggaccctcgggaaggtggccaggctttggggagcccctccttctaactattcaatttattttttatggtaatgttagtgggtggagagtgggagtgcagcctcggtgttagaacagggggacttgggggtccttctaatggtgagagggaacagggatgggtcagctaggtgcctcttacctagaggcaccggttttttgtgaggtgggcagcgcatcgtaggatcttaggtgcatgttttctgtttaagggtgatcacacatggggtgtggtgaggagggagtatgtggagtccccagccttcctgtggcagttcccagtgtgactaaaagaaggcagggattgggtttggttaggtgggtgcttccaggtgagagttggcctgctgtggaaatggaagagctcctggctctggcaggggtgtggctgctgtacagacttgtcccctgccgtcccgggctgttgccctgcggcttgggcttcggcttcattccaccgggtgggtgggttctctgacaagtgtgggaaggggccgctcccattaccacactgaggcctgagcccctttgagggggaggatctgttgcatggcctttgcaagccctcacccctgctgcgggtcgggcggtgaggccgcagcactcggaagacggtaaactgttggtgagctctcattcacaaagtaagtgagaagggagagtggggactgggacttcggtggcctgtccttgtgtggacacagtggggctcttctgggtgatgagtgcaggccgcacattcacccagcacacgttgcccatgctgcctggcagaggcctgcctgctggtgctctggttctcaccttgagctatacctgtctctggggtgggcccaaggcactagcttttcctgaagcttttgaagtgaacctgatgtgcagccaagtttgagaaccgctcttctagcaggtgatgcatctttgttgataatagaatccacaggcggagggatgagtagcccgcgcttttacctgcggttctcactaactgctttactccgagggcctggtggggtcagcggttacccagtgaatgagttggcagagtcagtcatgcctgttcctgggtagttactgggcacagagggtgaacagcaggaggaacctagcccatgtgcactgctggcttctcctgggaggtcctctggagagctgcctatagccctcagctgtaggcgggtcctactgaccccgtagcacgggcttttggagtctgcctggcctggtttcctggctgcattcttgggctctcgttggcctgtatgtagtctggcgggacctcacatagtgcagtttgggttgagcggaggtggccagtaatgggggcccctgggactcctgggacctctgtcttcttctccctggaagagaagagatttgtccctgaggttggtttcttgggctgtgttatctggacaaggtatatgaggccactaataggggcagagaaggacgagtgggaggggactgaagggggacgggagacagagagcttcaggtagggcctggctgggcctggccccctttgctggaacagaacaataggttgttctggggttttgtttgtatttgagggagagaggctataagacggctcctgccagctaggagcagcctatcatgtgaggggacgggtaggcccctgggtgtggttttggtcagcatcctgggtaggaaatcttgcctcttagaggtgggacagcaacctggccaggggcagtagaggagatgggaaaaggggctcagaaggaagggggtggtgcacatcttggtagctgggtccaggtggtcctgtcctgagtgagtgatctgggggtggattcctgccctaggtcttgcgccccttcaccccagccctgtccgggaccccatggcccttcccctttatggaagcagctgctattatagtttctgtctggcttgtaccagggtacttggcttagaagatgggaagaggatggtccccacggagttctgacagaaggctaggaaggtagtggtgaagagggtaagcactcatcctgggctcgttcctgggctcagcctggcagtgggcattctatgcccggttcagttgtcagaacacaccggtgtggtcctcatcatcttgtcagtcctcgttgtacaagtggctcagagaagttagagtcgtacatctaagaagtgagtggcgaagctccaggtgaagtgtgtgaaagcctcggacacatttgtgagtgaggactccttactctgcgcagtgcttgggctggagggcagctgaggtgttcattttgagtggggtagtgggttggctgctctggacaaagccagggaatctggctcccagagtgggaaggtggtcccctgcaggtcccccattcctccccaaggaccaggggccagagagcgttctctgggtcgtcctcatccttccagtcacacgcagctccttactgtctggtatgtgggaatcttctgccccacggcagcctgtgcctttgccgaacacctccaggagagccatgtgggggatggtctggacgttgcagggaccagagccgagctcttgagattctctgagtgtggacaaacgaggtgctcagacatggcccttggtggtgtggggacacaggcaggatagctcctctcggtgactcttggtagattgtcttctggtagatgggctgggggtgcgggttctggtgcttcaaggtggttgtcctctgactgtgaaccagagcccagggaccaggcgtcagccccgtgctggccgaagggagagggttgttgccaaagtcccacattccaggcatgtgttgatgctgataaggcagcctagggctggcctagccactttgggcaggaggggactttgacttcatgcccccagcaggcagcatgcacatcttgcttcctggtagcacccctcccccaccgaccccctctgcttccaggtgcagggcccccgccgggtcctggtcacacagcctgcagaggcagtgccgctttcagcagcgttgctggctcttagtagcaggcctctggaggcctattgatggattctgccagccccacctcttagagtattcgaggatgccattggaaatggcacttccttttatttgctgaaatttgttactcttaggtttggcagtgggctccttgtccaagagttcagcttttggggaagtgtagttttgtggaaagatgactcctgcttcctccgtgggccagtctcttaagctctccaggcctcattctccttgcctgtaaacgagttgttagaaatatttgaggcagtgcttgtcagctattctcaaagttgtttgcagaccctgagggtccccgatacctttttcagtatatttagaagttacaaggtcagatgcggtggcccacgcctgtaatcccagcactttaggaggccaaggcgggcggatcacctgaggttgggagttccagatcagcctggccaacatggtgaaaccccgcctctcctaaaaatacaaaaattagctgggtgtggtggcgcacgcctgtagtcccagctactcaggaggctgaggcaggagaatggcttgaacctgggaggcggaggttgcagtgagccaagattttgccactgcactccagcctgggtgacagagcgagactccatctaaaaaaaaaaaaaatcactggcctctgccctgggtggacacttgcactgccagagttgtgttccccactgttagccagcactgggggctgagacccaccagttctacacatgtccaggggaggcagtacagatgactgagtattaaatctagacctttaattacacatatttttacttttctgtgtgatgaaataggaaggatgcatgaggctttttttttttgagatggagtctcgctgttgcctaggctggagtgcagtggcgcaatctcagttcactgcaacctccacctcctgggttcaagtcattctcgtgcctcagcctcccgagtaactgggattacaggcacccgccaccacgcctggttaattttttctttttttttttttttttgagacggagtcttgccctgtcgcccaggctggagtgcagtggtgcgatctcgctgactgcaacctccgcctcctgggttcaagcgattctcctaccccagcctcccgagtagctgggattacaggcgcctgccaccacgcctggttaattttttcttttttttttttttttgagacggagtctttccctgtcgcccaggctggagtgcagtggtgggatctcgctcactgcaacctccgcctcctgggttcaagcgattctcctgcctcagcctcccgagtagctgggattacaggcatgcgcctccatgcccagctaatttttgcatttttagtagagatggggtttcaccatgttggtcaggctggtctcgaacttctgacctcgtgatccgcccgcctcagcctcccgaagtgctgggattacaggcattagccaccgcgcctggtgtaattttgtctagttttaataaagtctgggtttcgccatgttggccaggctggtcttgaactcctgacctcaggtgatccacccgccctggcctccggaagtgctgggattacaggtattagccaccatgcccggcatgaggctttacaattttttttttatttttaatttttttttggcgatgtggtctccctcagttgcctaggctggagtgcagtgatgatgtaatcacggctcagtgcagcctcaccttctgggctcaaatgatcctcctgcataagcctcccgagtagttaggaccacagtcatgcgccaccacagccagctatttttttttttttttttttccagagatgggatcttcctggtcttgaactcctaggctcaggcagtcctcctaccacgacctcctaaagtgttgggattacaggtgttgagccactgtgcccagcctacatagcaactttgtttttttttttttgagatggagtctctgttgcccaggctggagtacagtggcacgatcttgggtcactgcaacctctgcttcccgggttcaagcaattctattgcctcagcctcccaagtagctgagattataggcacgtgccaccacacccggctaatttttgtatttttagtagagactgggtatctccatgttggtcaggctggtctcaaactcctgaccttgtgatcgcccacctcagcctcccaaagtgctgggattacagatgtgagccaccgtacctggcctacatagcaacttttatttatgtttttccttgaagcggagtcttgctctgttgctagtctggagtgcagttgcgcaattctcctgcttcagcctcctgagtagctgggattacaggcgcttgccaccacacctggctaatttttgtatttttagtagagacgggatttcaccacgttagcgagactggtcttgaactcctgacctcaagtgatccacctgcctcagcctcccgaagtgctgggattgcaggcgtgagccaccgcgcctggcccatagcaacttttaagaaactcatttgtcgagctttagtgtaatatcaatgaagaatagacagttttctgaaaaagttattaaaatactccttccttctttctgtgtaaggccaaatttctttaaagactttaatcaaaaccgcatatcctaacagactgaatgcaggagatatgagaatccagcttcttctattaggctagacattaaagagatttataaaagtgtaaagcaatgctatccttctttttttcttttcttttcttttttttttttttgagacagtctcgctctgtcgccaggctagagtgcagtggcgcgatctctgctcactgcaacccccacctcccgggttcaagtgatttgcctgcctcggccttctagctagctgggactacaggtgcgcgccaccacacctagctaatttttgtatgtatatatatattttttagtagagatggggtttcacctgttggccaggatggtgtggatctcttgacctcgtgatccgcccgcctcggcctcccagagtgctgggattgcaagtgtgaactaccgtgcccagccctttttttgttttgtttttcggatagagtctcactcttatcacccaggctggagtgcagtggcacaatctctccttactgcaacctccgtctcctgggttcaagggattctgctgcctcagcctcctgagtagctgggattacaggcacctgtcaccacgcccagctaatttttgtatttttttaaatgttgttgttttttttttttgagagggagttttgctcttgtccaggctggagtgcaatggcgtgatcttggctcactgcaacctctgcttcccccaggttcaagtgattctcctgcctcagcctccccagtagctgggattacaggcatgcaccaacacatttggctaatttttgtatttcaccctgttgggcaggctggtctcaaactcctgacctcaggtgatccacccgcgtcggcctcccaaagtgctaggattacaggcatgagccactgcgtccagcctatttttttttttaagacagagtttcgctcttgttgcccaggctggaatgcaatggcacaatcttggctcactgcaacctccaccccacaccctcccctggggtaaagccattctcctgcttcagcctcccaagtagttgggattacaggcacctgccaccacgcttggctaattttttgtatttttagtagagatggggtttcaccatgttggccaggctggtctcgaactccagacctcaagtgatccacctacctcagcctcccaaagtgctgggactacaggcgtgagccactgtgctcagcctttaaaaaaaatttttttggccgggcacggtggctcacgcctgtaatctcagcactttgggaggctgaggcggcagatcacgaggtcaggagatcgagaccatcctggctaacacggtgaaaccccgtctctactaaaaatacaaaaagaaattagccaggcgcggtggcgggcgcttgtagtcccagatactcgggaggccgaggcaggagaatggcgtgaacccgggaggcggagcttgcagtgagccgagatcacgccactgcactccagcctgggccacagagcgagactccgtctcagaaaaaaaaaaaaaaaaactgaataagagggcactgttgtagtacatggtaacatcaaatacagcaacagcccagatgcagtggctcacacctgtaatcccagcactttgggaggctgaggctgcaggatggcttgaagccaggagttcgaggttgcagtgagctatgattgtaccaccgcacttcagcttgggtgacagagcaggaccctgtctcagaaaaaaccccacaaaacagtaatagagaagccacataagcagatgctcgttaggagccctgactatttaagaatgtaaacaacacaattttagaaccagtggcaaggagggtactggacatttccatcttccccacgtgcctccttatctttcacatgttgtttcactctgtctcttctcagcattgggtctgaccagcatttgctcacctaatgaatgtttatgagtgcctgctgcatgcctgctgctgtggctgcttgggacacagggtctaactttgggtactggtctatggggtggtgggggtaggcaggagggaagcagcttggcagctggtgctgacgttggaagcggggggacaacagaggcagttctggcttcacagaggagggagtcgtgagggggcaggctcctcccagagtagggcacggcctgcaggagctctcaggtgtgtctgtggaagggatgaggtgggcttgatgcccctgtgggaagtgctttgcatgccaggcctgagcatggactttatgctaggcatcaggaatttattgaaagctttatttatttttttaattttttttttttgtattttgagatagagtttcactcttgttgcccaggctggagtgcaatggcgcgatcttggctcactgcaacttcctcctcccgggttcaagtgattctcctgcctcagcctcctgagtagctgggattacaggcatgcgccaccatgcccagctaattttgtatttttaatagagatggggtttctccatgttggtcaggctggtctcaaactccagacatcagatgatctgcccgcctgggcctcccaaagtgctgggattaaaggtgtgagccaccatgcccggcccattgaaagctttaagcaggggagtggcttgatgagatgggtgttgagaaagataactcagggttattggactctgaattggagggtacagggactaggcgagggttggctggaggggttgcaggggggtgattgtgttctaaacgctgatattttcacttagagtggctctgattctgcccttctttctcctgtagaccttgggaggttgcctgggatttctccctcctggacaacttctgttgagtgaagcatacctgctaccccaggtgtggaggccccaggttcttttgctttgtatgattaggacagggtgatattttctgggttatctcttgtgggaactgagccctccaaagccctcatttgtgcattgttgtcatagctgcccaagtgtgtggccttgctgagtttgacggctgtggaccaggtgatctctcgggtggtgaaagggaggtgctctgtgagtgcacctcagctttagcctcttggcttctccctggattgggatttccagggaggtctctttcctctttcttttttctctttcttttctctctttctctctctctgtttttttgtttgtttgtttgtttgttttttaaatgagacagggtcttgccgtgttgcccaggctggtcttgaactcctgggctcaagcgatcctcctgcctcaatctcccaaagtgctcagattaaaggcatgaaccaccacacccgactttcctttcttttgagacttctgcacagagcaggctcagcttccttagtagacttagccattgaactctaagaagttatttacaaaggtgtaaataggccgggcatggtggctcacgcctgtaatcccagcactttgggaggccgaggcaggcggatcacttgaggtcaggagtttgagaccagcctggccaagatggtgaaaccctgtctctaccacaaaaattagctgggtgtggtgatgggtgcctgtaatccccagctactcgggaggctgaggcaggacagtcgcttgaacccgggcagcagaggtcgcagtgagccgagattgtgtcactgcactccagcctgggcgacagaggaagactcaaaaaaaaaaaaaaaaaaacaaaggtaaattacatgtatatatgtgtgtgcacaaatcttaaagaatagagagataagtagtggtaaacctactattggttgaatcgtgggtgtcccactaagcgtgacaccgttgttccctcatggccacataagaaatagcctcccaagttcctgggacacctcatgcacttctccctggcttattcccacttccctctagaagccaacagtcttctgaattgcgggtcagccattcgctggcttttgtcggtttcccacctttgtctggatcctgaaactgcgaatgattttggctcagttcgctgggagccgggtgtcctgcactcttgggacaccaggagcagcagttcctgtgttcccattctccatttcagtgtccaaggtggcgccatccacacataatcacctgtcctgctggcagtgagcatttgggtgggtttctgggttttgtttttgctgccttctaagtagctgacttttcacccccaagctatgcttcttgaggcagagaagtgccagtttattttgttttctgtctctaaatccagttccttaatgcaccactgagactcagtttagaagtacagtgaaactttgtgagcatttttctccctgagtttgaatggatccctctctcattctttgagttcttgggcacttgtctcttagacactttcaagttacctactggacaggagagacctcttctctataaagtatcacacttggaggcttttcaggcacaggaccatagattgtaatattttccatagcagttgcccaattttatctgtaaaaattgctttttaaggcctggcacagtggctcacacctgtaatcccaacattttggaaggctgaggcaggaggatcacttgagcccaggagtttgaggccagtctggaaaacatagtgagacctcatctctacaaaaaattttaaaaattggttgggcatcgtggcatgcacctttagttccagctactcaaaaggctgagacgggaggatcccttgagcccagaaattagagctatgatcgcgccactgcactccagcctgggccacagagcaagaccctgtctccaaacaatcacaaaacttccaatggatgccgaacgtataacttttttttttttttttctttcttggagtaaaataacttgatccttgatctttggctgtagctcctgagccatttgaggcactggggggtttgtgtgttgattacctatgaaggagcaagtgggctgtttccttctcccagcggcttcctttgaccccaaatccctgagagtctcgcccattttcttcttggcttcctccctttgatatgcccagccggctcctgccctacctggctgccaccaggacctgctggaggcggttgctgggaattatttggtgtcctgtttgaacctcgcttgccgtgctcccagatttcctgtttctcctgggcttgcctttcaggatttgcagaaccccttctcctttagaagtgtcaactggggctgggtgtggtggctcacgcctataatcccagcacttttgggaggccgaggcgggcggatcacctgaggtcgggagttccaggccagcctgaccaacatggagaaaccccgtctctactaaaaatacaaaattagccaggtatggtggtgcacacttggaatcccagctactcgggaggctgaggcaggacagtcgcttgaacccgggaggcggaggttgcggtgagccgagattgcaccatggcactctagcctgggcaacaagaggaaaactctgtctcaaaaaaaaaaaaaaaaaaaagtcaattggaccttaggacaacttaaaaacattatcaggtttttatcttttagatagcagagatgagtctgctcttaataaggatttacagtagtctctctgtttcctgtgggctcctggctggcttgtgtgagctccctcctctaggatgggcactccatcctggacattgccgcgttgccagctgtcctgccaatattttgcttcctgtgtttttgttattggttgggggtccaggagaggttgctgcctggactgagtctacttgctgatcaggatgaagttgatctctgcttcccttctgaaggtttctgtgcacgtattgaattcaaggacagcctacgtaagaagtgtgcacagctccaagagttcttcacaaatgattatgcccttgtaactagcatccagagtgcgaaacacaaccctggaagcccctcacgtatcctgaagcttgtagtcactctcaacccccacccataagattagtgctgcctgcttttgaatgtatgcaaatggaactgtaatagtctttttggctctggcatctttgctcaaaagtatatttgagagattcatctgcgttgtttgtaagtcaaaccatgtgaaattatcagcagccagctgtttttttacccctaaaaggtaaattcatacagttcaacctaaacgttctgtcctgttcactgctggctcatagtcttttatacctgcagctgtcccttctcagggtgggcatagttgttttccattgttgggccttcatgagtgtgcctgcctgtttggtgtgcattacgtgtgcattcttgttggcgtataccttgggtgagtttttgggcccacagctagctagctagcttgttggctttatttatttagagacgaagttggctcttgtcgcccaggctggagtgcagtggcgcagtctcagctcactgcaagctctgcctcctgggttcaagtgattctcctgcgtcagcctcccaaatagctgggattacaggagcctgccaccacgcccgactaatttttgtatttttagtagagacggggtttcaccatgtttgccaggctggtctcaaactcctgacctcaggcgatccacccaccttggcctcacaaagtgctgagatcacaggcgtgagccaccacccacggccttgggcccacagttttagattgtgccatccaagggttttctaaaccatgtgagttttctggccaggtgcggtggcttatgcctgtaatctcagtactttgggaggctgagatgggcagatcacttgaggccaggagttggagaccagcctggccaacatggtgaaaccccatctctacgaaaaatacaaaaattatctgcgggtggtggcgcactgcacttctgtaatcccagctactcgggaggctgaggcaggagaattgcttgaacctgggaggcgaaggttgcagtgagccatctcgccactgcactccagcttgggtgacagagcaagactctctctcaaaaaaataaaaaattataaagtatgtgagacttctggttgccttactgcctggccaacatttggtgttacctttttcctgatgggctttgacgttcttattgtttctggaacagtcctggtcttgtttaaaaacatccccattttcctttcatccctgggagatactcttttagtctttgtttggctagtcaaaatcccgtctttagtatctgttgttgaatttttgtgtttttgttttttctgattccctttcagcatgtcatctcagtcttgtcccagcccgggggtcagacggtgttgcgtacagacggtgcagtggctccttcatgctggttgcctcagagcctttgccaggcctggagaactgcataggtgcaggactgccagtagttcttcctgctctttgatcattgaaatgttttcttttgtgaagtaatgatggtagaagatgatagggtttctgtttgtttctaattctagtctttacttggcattaagaaattgttagctgctagggttgattttgaaattgtgaagttggagagtccctcctggagctgtgggttggatggctgcagctctgtgactcagctgtgctgggtgcctccctttggggctcagttacctccttttaaggtgtccctagggtgagagagatgatcacgatagtcccttccacctgggcggcccaggctttcctcgcccatttagtgcctttcatgtagaatttccacctgttgtctgctgtgctgccactgcttgtcctccctccctgccacacagagctgtgttctctgcctgccactcacgcctacttctctgatcagggtttgtggaaccctccagcgtggtcaccattctggtacctgtggtaacacgctcagccttggtgtggcacattctaggtctaccgtttgtattcaccagcctgtgagcttgtgtacatgggacatgtatcttcgttttgggggctttctccttccacttgatgcccatcccttgagcgtttactacttgtggagcgcttggctttcaggccgtagagagctttccaatcagtggtgtccaggtaaaaacaaaagaaggaaaaaaagcttctaacctagcccttctcagacttgactgtgtgtttgagcccccagggttctggtggttagggctggatggagtctgagcctctgcgtgtctaacaagatccctggtggtgctgctgctgtttcttgggtcatggccagtgagcaagaagagcagggaagtgggctggagaggactgcagaaaccagcacagggcctgttttgcctcctgacatgtgtggatgccagattcctgctttttcctcacctactaggaacagcggctgcacatcctctggtggtcttgcgtgggctcctgctctgtggctgtcagcgagccttttaccccatgctcaggcccctcttagggggcagggtagtgttgggatggagtttggaggtgagcacagcattcgtagtcactatcacaaccttaaattgttattctgcttcttttttttgagacagagtctcactctgtcacccaggctggagtgcagtggcgcgatctcggctcactgcaagctccgcctcccagggtcaagcaattctgcctcagcctccggagtagcggaactacaggcgcgtgccaccacacccagctaattttttgtatttttagtagagatggggtttcacagtgttagccaggatggtcttgatctcctgacctcatgatccacccatgtcagcctcccggagtgctgggattacagaccgcacctggccgttattctgcttcttaaagcaatgttcccctgcctgtctccaatatcctgtctcagaactgtcagccagactgtgccaggcctggggccctccttggtgccagcactagcaggggaaatcagctgcaggtctccaaggtcttcctggcctcattccttgctggctccaaacccggaagtgatgaggagagggaggggactgaggctgtaccttctgggggaagcacagtttggaggcactttcggtccagctctcctctcagcagcccattccagccttttccttgtgctggggtgttagcccgggcttcctcacctcagaagggacagtacccatgggcgggtggctcggaccatgcagggcttggccctgctgtgggcagtacgaggtcatcagtaggtcccatgggcatttcaggacgggcttgggaaagtcactgggctggggtggatgctacctccctcactttaggccacagggctggcctgaggagcagaggaggaggaggccagcctcaggtcccaatcgctgcatcaccaatgtgttgagtggaacccgagtgtttattttgtagaagctgcgttggagagagctgggctcctggcatttgtggagcctgttgctttccaggaggatggtctgggaggagagccaggagctgctggccggcatccaggtctgggctggattacatggctgggcttgcccagagcagtgagccccacccaccaccagcccattcctgaagggacagggaaggaggtcatggagggtgggggtgttcccagaggagcagcaagcacaacctgggcctccaaagcaggctgcatgggggctccaccttgtcacttctggtggaggagctgggcagaccccatgccctcacagtgagtttgggagaatacacccaggtggggccctgctgtggataggcaggtggtgctggggggtgggggagtgagggtggaggtgcagactggagtccctgctcctggcacaccagtgcatggagggcggtgcctcctctagctcccccaagcagcttggcagttggaagccatgtgtgagtggcatccctggccctgcctgcgttgggcgggggggtcatcagactacaactctggagtcaggctttaggtcctcactctgctacctacatgctcttgtgaccctgggcaagttgcttaacccccaagaacctttaatttcttatctgaaactgcagagataacgccccgctcactgggcctgtgggaagattgaggagatcagacctgcccacatgtaggctgccatctcatacagggctgtggcggtgggcgaggtgcagccttcgccccttggagctatctcttgtctaccaaggcttcctcagggaggactccaggccatggggataggatgaacaaagtcctgggcttgtgactgtgcagggctggttggtgtgtccaggggctgggccttggggcacttctggatactggctgcctcctgcctggctgccttgtgccttccaggcagtctctcccatggcttaggggctcctgggaagaggctgagctcacacagggccacccgttgcagctgcatctgtcccggccacacctgaagtatgaggtgactatagttgggggttggtctggaaccagggccgatgctgaccttagactgaagtttgggagcagtggcagcaagtctggggctctctctgaccctggtcagatgtacttagacctctgggttgtggaagttgcctggtggccctgccctgcctagcatggcttctcagcctggcatgcttgtccctcccacctgacagtggagctcgggcgggccgtgggcggccctgctcactctcagctgtcttggcgtcagctggagggttctcatttcactgttacttttgtttaggctgggaggtggttaaggtgctgctccttgggagtgggctggggggagcttctcctcagtcctccagcatagctccaggcctcctgcaggaagcccctttcttggtagtaaaggatagcttccagggaggaaggtggatgagaaggatcctaggagggctaggcgggatggcctgcttggggtggcgccctttcctggtcttcacccttctccccaggcctccctcctggctgggcgtgagccagaagtttcagtctgaaggcagggttatcatgtggctgagatgagtttgacccccgcctgtgggcctggacgtgggcgtgagatgtgttcctgtctcccagagtcatggcctccagaaggagccatgtggaggcccagcacctggagcagttctgaatgcctggcttcttggaggccaaggttctaggcaaggtgggtatccaggctgggttggggcagtgcctctcagaattggggctggagtttcctgctttctgcctcagcagggatcactttgatctgaaaacctcctctctcctggcctttgaaagatgctgactagagcacactctcctgccctttgctgggtgcttagaagaaaggccttgaggtaaccctgttccagcctccccacaggcccctgcagccacgtggactgaccagaggctccacacacgggcaggtgtggcctgacctcgctcgcgtaggatcatgggctagtgggtcccccaatggggggctgcttcgagtgtcaggaggcagcgaggggtgcacagtgccctggcctctgccatccccgttggttatttggctggtctgtgtttggtgagcgagtagagggatccagagtgcagggtggtcttggcctggggcttttgactgccctctggagatgcactgagggccacccagctggggagcagccgggagggataggaacctgttcccactgtggcatctttgcccttccaatctgcttcaccgtcgcccttgatctctgtgccagttggaaaattgaggcagaaccaatacccctgggtgatctggaaatcatcagtgggaagggttgcctttgcccaaggctaaagatgacatgtccctgcacactttcagccccaggttttcctaccttgtggggaggtgagaggtcagggtgagtgctgggtttgaggctcagctgtgctgtgtgaagattgagaggagcccacctgatcacatggacagaacgcacaggctcctgggtggccctgcggctccagtgacatagcacatggtcgggcatacaacagtgcccaggaaaggttagctggtggtgtttccagggtatcgtgctgagcttctgagatgagaatgtcctgtgaaagcctctgtctggaggtttcattggaagtaaagtttacatacaattaagggcctaaaattgtattttcatttaccttaacccagattcccagcaagctagagagctgccctcaccccaaagagttcctcatgccccgtcctggataggcctgtcagggccaggcagtgggcgcttgtccctcgccccatcctggacagtcctcacctgtcgctcacagcctgttctgctctggtttttaccctcagtccgttttgcctattctagaacttgatgtaaatggagtcatgcagtctgtactctcgcaaaagtcttcttccactcagtgccacgactgtgaggttcatccatgtctctgcatcatttctgccctttgtatttttagggttttaaaagtaatacttttggctgggcacggtggctcacacctgtaatcccagcactttgggaggctgaggcaggcggatcacaaggtcaggaggtcgagaccatcctggctaacacggtgaaaccccgtctctactaaaaatacaaaaaattagccgggcgtggtggcaggcggctgtagtcccagctactcgggagactgaggcaggagaatggcatgaacctgggaggcagagtttgcagtgagcccagatcgccatggcactccagcctgggggacagaatgagattccatcaaaaaaaaaaaaaaggtaatactttttaaaatgttgagtattacagaaatgaacataatatacagatactatggtttttctgtaatcccgctccccagagataatcttacttagcagttgggtatgtgtgtccccaaggtttttcttgccacagaatggacttgctgggccgggtaggctctgactgggccttgcagagcagctgccttactgtaagttctttgagggcgaacagagcgggggtggggctgctgtggctggcccagttctacagagcttgggcatgtgccaccagtggcttgagaggctggagtatctgagtgctgttccagcccgctagcacctgcctgggccctgggcctgccctcagtgtctggggacctggctttctggcttttttgtggcggggactgggaggggaaggaaaggagagcagttggcatgttggctgttccgtaaacagggccgtgtgtctgctctaacagatggcctgggaaggtaaccccgaggctttgtgttccttcctgcagaccttcaggattccgcagagagagctggccctccctccagctgctggggctcttgtccttcccagctggggccagtccacctacagggggaatcctggagctgagggatcctaacttgggagatagtttctgtgctacccttcttgcctctcccctggacccctgaaggctctgtcctagggaggggatgggtcacagccttaggcgaatgcccagctggccccgatagcccaggcctgctgccctactgcctcagatcctgggcgtcctgggagccagcgtttctggatgggcagtaggccagggctgggcgtgctagcctcggggctgataggcgtgctgcccgggcctgctgccaggggctgctgggtgctaggtggcattctcatcgcagcctgcagtcagctgcttccagggctgagcaccagcatccgggccagcacccagagccgtgtttctagttacctggcactccccaggcggagccctccaggataggcacttgctgtttcatgtccagcggtgagcgggtagggcagagctctgtggctgagaaggaaggagcagtgcttagtaggcgtttcgcagcaggatggcgtgtgccacccccctgccccgccatggggtgaggctgcattgctgctcgcagacacagtggcggcctagatgtggcccagacttggcccagctggtgtggatggcacgcatggtggcattgtgcttgctgtgaactttctgcaggtggctctgacaccccctaactcaagtggagggttcagggaggagccctgccctgttctacatcacagctgacccagcctggggccatccttccttggtggggagacctagtgctagccttgggcttgtaaagtgcccgtcagggccaggcagtgggcactgacggagggtgttcccacccccatggcactcaggtgccccccagtcctattctgccacccactccctgcgcggcatccagtagctggcctggcctctggcaaggtcaggtgacccctggctgcagagtttggcatgcgctctacccatggttgactgggtcctgaggggcagtggttggggagcagatgaagtggcacagggctggatggtggtatctgattgcctccagtgtgccaccgagaccctctacccagtttttcgactgctcccgccagtgtttcagtggcccctgccctactggcctcatcccagcattagcccactgggcccaacccttgctaactgtggacgcccttgggcttcctaccaacagagctggttctgctgccctctgggcctttggtggggtcctggaccagccatgcaccccctcccctcacaccccccacccagaggggagctgcactaggggctggagagacagctggccagctgcagcctaggcctcccagctctgggccggcaccccgggtctggtcacattcctgagggacctgctgagcctccctggccctgggggtggagtgggggaaggggaaacggggacgggccgctgcacgccccttccccgaccccggctctattccgtgggggcccaggctggcaggtgtggggtgcaaggacccaccacctcaggatcccccctcctgcaggacccagagctctgggggtgggagggaacccctcgtttcctggcggcagctgcccaaggctttggtgggccggtattgaaagcccaggcctgcagcttgggtgagcccttaggcagtgaaacctctggagagggaaggccatgtggtcaggccaggcgggctagggggctgggccctctgggcagggaggcggtgagagcagatcaggaagggaaggaacgggggagccaaaagcggttgagactggttcttataaatagcccttgcacaagtggctccaattttgaccttttgttatgtaaatgtggccagcttgggaagggccctgcccaggcctcctgctaccacacccgcaggccaagaattgtgtgtctgccaccagcgccccctggcctaggtggcccctgggtgtccttaatctcctgtgtgtgttagaggggcaggcattgcacccaccgaactccctagacctgttcgctggtccttactcttcctggctgtcagatccaactaccaggctctgtggccacagtctcctgctgggctgcccctggtgccccagccagagacccccaggtgcgtcccttcatcgcccttccctcccttcttcgctgatggctgtctgggtgactgtgttcgtcttctcttccccaggtgaccaggcattgatgcacccccaggaaggccacgcgctcaggagccccccccgccgctggctgctgctcacatggtgtctgggcccttggcactccggtgaggcgcaggggaggggggaccgccactggcccctttccccggagtttctgggtggcacacagccccacagctcggcctctatctgtctgacccgtggtcctttgtgtgcacacagcactgggcagtgtggagggagcctggaggccactgccctcttccagtccccttgccagtctcggggtaccaggtgtctgggtgctggcagagccggcactgatgttttctgggggctaggttactggggccaagtgtggaagccacaccttgggggctctttgtccctgcctggtgggttgaggcgggcagggagtggaggaggattggttcacgaagtctccagcccatgagcaccctcctgaactgctgtgggctgggctgctaggcagagagccgctggcgggtgcttgctgcctcttgctgttaggctctgagtgccagcggtgttccaggctgtgttgcacccttgcgtgttcacattgagctctggcaccttcaggggcctgtgaatgttagggtttttctttgtctttgcaaacaagggtaggcatgaggctggggagagtttctgtcatgagaaggttgggtagggtgggaccctttccaggcctctgctctgggaggcagggctggacactctgggaggggcagtagatcccagagggcggtgggctcagagtagttcagctgctgagagactggaccctgaactgcgaggctcagagctgcctgtgggccccgctgctcggttgtccgtcagccatgaggaaagttcatgttttcactggccccctgccctgtggaagcctgtgagcctatccggggcacaggtggccacctggacactggcatgccttccccagcaccctcctgctgagccattctctgagggactctggtaggggtgagaggatggagctgggagtactgcgttttgtactggggagttgggcttagggctgaggatggctttgagtcattcaaagccttccagagtcattctttataccgccggccacagtccttgcctccgcccttggagggacatttccctcctccccccggcgtctatctggtgcccactgtgcacccatttgccctgcccttgtactcccactgtggggtgcctggtccatggcagaggaggctgctcagtggggatgggaagcgtggcgaggagcacccgctcagaaccccatgtcttgctgctgcataagcaggaacacacctgggccgtcagagttcctgcagagaccagcggcgtcagtgtgcttcttgcttactgatctcagttagtgcctgtgccattctgtgtgatggaggccagctgtccacctttcctaggcccagatggtgctgcccttcctagagaggacggagggttcaggtggtgccaggtgcttggcctaagctacctttcctccttggcagctggaagcccaggctggggcagcacttggcgcccgcccagagtgcgaggcagcccagggccttggggagaggcagggctggctgcaggctgactgcagcatctgggaggcagcaacatgactgctggcagtttgatttgggccctgccgtatttcaaaaggaaccaccatttagttttgggggatttttgccagctttcaagacaagctcctctcacggagtcctctgcttcccgaagtttaaagccatctggtcatttttgggtccccttctggtccctgagggttgacttcatttagtgtagagacagtagcccgggctgtgaaaccaaatgcaaatcccagtttctctatttgtcccctcatcaccctccacctccattttctcattagtgcaaatggggcaggggcctctgtcccttctcagtttgagtcctcagtgaggtgacacgtgtactgcgcctgcatgtggtgggcattgtgggcttatgtgccgtgtactgtgccgcaggggctcctgccctatgtggggtcagttctgaggccctttgcctcgtcgagccccaccctgccccagagccctggtccgagtgtgccagtcatctgacgcatgcgtgcctgttcttgcccacaggtggtgcgcgtgggcagggcgcggggacatggggcccgacatggagctgcccagccactcgaagcagctcctgctgcagctgaaccagcagaggaccaagggcttcctgtgtgacgtcatcatcatggtggagaactccatcttccgggcccacaagaacgtcctagccgccagcagcatctatttcaagtccctggtcctgcacgacaacctcatcaacctggacacagacatggtcagctccacagtgttccagcagatcttggacttcatctacacaggcaagctgctgcccagcgaccagccagccgagcccaacttcagcaccctcctcactgccgccagctacctccagctgcccgagttggcagccctctgccgccgcaaactcaagcgagccggcaagccctttggctctgggagggcggggtccactggcatggggcggcccccccgcagccagcggctgtccacggcctctgtcatccaagctcggtatcaggggctcgtggatgggcgcaagggggcccacgccccccaggagctcccccaagccaaaggctcagacgatgaactctttcttggtggctctaaccaggatagcgtgcaaggtctgggccgggctgtctgcccagctggcggggaggcgggtctggggggctgcagcagcagcaccaacgggagcagcgggggctgcgagcaggagctgggcttggacctgtccaagaaaagcccacccttgccccctgccaccccaggtccccacctcactcccgatgacgcagcccagctgagcgacagccaacatggctcgccccctgcggcctctgctcctcccgttgccaacagtgcctcttattctgagctggggggcacccctgatgagcccatggatctggagggggccgaggacaaccacctgagcctgctggaggcgcctggtgggcagcctcggaagagcctccggcactccactcggaagaaggagtggggcaagaaggagcctgtggctggctccccctttgagcggagagaagcagggcccaagggtccctgcccgggagaggagggtgagggggtcggggacagggttcccaatggcatcctggctagtggggctggccctagcgggccctatggggagcccccctacccctgcaaggaggaggaggagaacggcaaggatgcaagtgaagacagtgcgcagagcgggagcgaggggggcagcggccatgccagcgcccactacatgtaccggcaggagggctacgagacggtgtcctacggggacaacttgtatgtgtgcattccctgcgccaagggcttccccagctctgagcagctcaatgcgcacgtggagactcacacggaggaagagctgttcatcaaggaagagggggcctacgagacaggcagtgggggtgccgaggaggaggccgaggacctgtcagcacccagtgcggcctacacggctgagccccggcccttcaagtgttcggtctgcgagaagacctacaaggacccagccacgctgcggcagcacgagaagacgcactggctgacacggcccttcccctgcaacatctgtggcaaaatgttcacgcagcgcggcaccatgacgcgtcacatgcggagccacctgggcctgaagcccttcgcctgcgatgagtgtggcatgcgcttcacccgtcagtaccgcctcacggagcacatgcgtgtgcactcgggcgagaaaccttacgagtgccagctgtgcgggggcaagttcacccagcagcgcaacctcatcagccacctgcgcatgcacacctccccctcctagaagccaaagacccgcgggcgccctctgccaccttgctccccgggaacccatggaaggagaagcgaggtgatgcagcagcaggggcaagaccctgggtccagtggaggctccgggtggcccctctggcccccactgcccacacccagagctttaatggacagtccgtaccaagcagagccgagaggagggaagccaggggtcccagcccgtctacctccccatcccacccaggcccccagctccccgcgggggccaccgcagggcctgtgggctgggtcacgtgggtctcgctgggacctggtccctttgttgcaggcggcttggagaaagggcagtgggacgctggccacggccagggtggtgtcgggagcaggcctcaccccgctggccgtgtctgtgtgtgtgcacgtgtgcttgtgtctgtgcgggcgcgtgcagccctggttctgcagggaacaggtgctgggggtgcagatccctccctccttgagccagggtggcactgttcactggcgctgggacagtcagggtgaccccaccgcctacctctctacatctaaagagccctctgggcctgtgttgctgttattcctactgatctgttcctctgtttttctttttgatttttgttttttaaaccaaaacagacaatagcttattttctttccgccccctccggggctgagcctgggtctgaagactgaatgtaacaggggccgctggcactcctgcgcgtcccccggctctggcgctgcaggggtgtcggcgcgccacctctccaggccccagaagcccttcttgcccaaaggcttccctggtccctgagccctgcctcggctgcctcaggggagagtgcttttcctgtagtttccaaggaatattctttgtttagaggtacttgttttttattaagagaaaaaccagtgtaacgtttatgtgactgtttgaactggaaggtctggggttccggggggtggggggaggctagactcaatgccggggccgtcggtactcttgttttcatttgtgtgtgcgtgcgtgtgtgtgtgtgtatgtgcgtatgtgtgtgtctatgtgtggtgtgtgccgtatgcatgggcagatgtttcgctttccctccttcctcgctgaacaaggtggagacttctgaccttttgctacctcttgaattcatgacaacgatatgttggtgactggcagtggaagcccttgacactcttgttttccttcgcttagcacctaggaagtcgtgtgcaggagccagcagggcgccaagtggcccagtgcctgcagctcacctgtgggttttccctttgagcctttggccacatccacctcgaggggaccctggcaccccgggcacacaaacctctgtggtataggtgaggggtgtgaggccccagcctggagccaggcactgggtgctgacaggggaaccatgaggagggtggcaggtctttgcagctcccggccagggtgaggcggaagtgagccctcatcctgccactcctatcctccattcctgcaagagttttaagcttgagagagctgaccacagggccccccggggaacagggatggcacttccctgagcagtcctggcccccggccactgtctcggggcccacctctcgcccctcatcttggtaattagccagcctcagatacttctgtgggccctgaagtgggctctcaaggtcagaccaaggttgctgatctcagtcccactgtcttcagccagctgaagctgtggggctgggctggcagcctttattgtcatcttgcttcaccatttttttttctctctcttttcattctattttaagtttagaccaaaaaaatacagagtcatcccctacccccacccctctagagaccctccagctaaaaacagagcctgagttcagggacccaagtggtgagcggcgtcttttgggggtgagggagcttgggtagatgaggctcctggctgagccctccctgtggtgatcccagcctaagatggcccctcttccctcctggtgggagacagaggactggaccctgggtctcaggttccagcaagtcaggctagggacctggggggaggagacccatggacttcacccatactcagtgagggggctcctgccgtcctgacgccaccccgccccatcagcacttaagccacatgacacaaagtctgtaccgcacgggaaatgttcacgcgcctggccgtgtgcatggcctcccgggctgtgggcagccgcatctgtgaggtgactcgtgaaagtaggtgattcctttgcagaacttcagggactgggagcagaggcccctcactcaacgacgtttgtgcgacatagtattgtatccaccttagtattgtatcgagccttttctgtgttttaatgagaaagcagaacactagtttcctatttaagactttaagggtttgtggggcggggcgggattaacacaacatttggctttgttttctttttcctttgatttccacatcaggtgtgtgcgagtgtgtgtgtgtggagatgttaagagcctcacaaggaaactgggttattggaggccaaggcggcttacagttctctgcgttcgtcacttaattcctgaatgtttcagagaaacaggaatcagaaaatagcagatatcatgtaggaaagagaggataaacaaagaaaaaagaaaaaaaaataagctcatacccaaattcacaaagcctattttttaaaccaaagcacattttgaatgagtatggaacctccatgggctcagaaaaaagatgctaatatatttatctcattgtttacataagcttttacagtttcagacctcagcagctgtaaggccagtccagggaaccctcccctgctgctggaaacccttctgagttggccctggagtggctcacgggcagagaagggtagccctggggctgggggagggattggaagcctccctggagtcacctgagccctcgtccccattcccagggcccctccaagcccagctggcaccaaagagcttgggcccgtgctgaccagcccccaaggccctctggccggaccatgctggtcctgaccagctagcctacgcggggatggccgtcagttctggccacaggacccgagtctgggcttgggtccccctgctgctctgcccgtgacccttggggatgggttgatgcgagggtcccactcaagccaaaaagccgggacctttgcgcagctctgtcgactctggtgggtccccactcctggggccccctaaccccaccccaggcagcggaaggggctgactgggtctggtccttaccaacatagacggtgcaaacactcttaacagtgttgtttttgtatcaatatgtttgtgcagtgatgaatgtatttatttctcagacttggggcgagtgagcgggtggcaggccgggctccgccactgcatgctcccgccggaccgagccccagcaagggctcctccaggattgcaaaaaaaaaaggaagagaaaagatgaacctttaagcaaataagaatctcagagactcgcagcatagccatacacctcagcctgtgaaatgaacgatccggaccctcaccaactttccccacctcaggcagccctgtgtgtttaccgttcatcaccactcgggggcaccgggccgcccacccactcccaaaatccgtcagtattcactggacctcaggccctgtgcaggagtgcgatccgggctgggccgctgggcaggctgaccccctgccctcctgcggccatcctgagttggggtgaggcctgggcagccggagggcagggctcagggagcaggaggctgcatccgtccacccccaggcgtgggggacaaaagccaaaggtgccaggccttagagcagacaagggctctcagccctggcatgccccctaaagggaccaaggtcctcctatttcccagaaccccgttggggcagatgttactgaacctgtgaatcagacgccaggagtgagggctggggagggacctaactggagcctcagtctgacattccacgccggggtgggggtgggcatgagcggtgggaactgaggctgcccaggacccccttcctaggatgccccggcttcagtcaccccactttaactttctaccaggaccccctccccctacctcaccttgctatttattgctgtaatttattgacctcaaaaatgctgcataacagacctcactggggcagggaggatccccagggctcccaccctccacttggcgggccccgtggggccaggtgctgaggggagcctctctaccccacccatcactagcttccctctgccctctcccaccccgggggggacccaggttgggcactggctcatttctcgcaaatacctcgaaggggaggggggagggatggggttatagctgttttgtttaattggaactggaagagggatcatgttttgttttatgcccttcccagaaggggggagggacaccgggatcgcactcctgtactggccaccgccgctgtcacttgtcacattgagttcatgtcccttgagagtttgtataaattcaggtcagagctgcagctacacagctgcccagtgtcatagaaaagcaattcaccaacgactgatctctccattcagaagtgtgcagtcttaaatgtacagcgataagaaactgttattttatgatcttttcattaaaagcttgattgaaaactctggtgtgggacctccatattctgctttggctgttctctctagcaaagtgacacggcttctaagtcttagaagggtggggtctgggatgggcatctgcctgccactgttcagtggtgcttggtgggtcctgggggtgtgcaccgtgccagggaactagcactttggggtcagcatcctcttgggcagtgttggcctgagttagctgaggctgtctgggaagcagcgatgtgtgtgcagttacagcagcatggacctggtgactggggagaggaggatggctgcccagtgcctgggacccctcattggagtggctcagttgggactgaggaagggctggggcaaggcgagggctgctcccttctgcccactgctgcttcctggtgcttggcctgaggggaggggagggaggaaggaaaaggggtaatgttaatccccagggaccacccggaatggggatcctcgtgtgaagacctaggaggaggagcaggggtggagggtgattgccactttagacctctggcatggactgcagacatctggtggctcctggcagccggagatgaacccagtgaccccagactccagaagaacttgagcgcagctactctaagtcttggtgagttctgttcagttgctttaaaatgattttttggctttatcaaagtaattcctgaatagaatttaagtaattaaatggttctcaaaaaggcttaaaacaaaaatagtttatctccccaactccatcccatactatacagccaatcactttgaattattttagcactttcttctgcatttatctctatgtgtctaagtagtattcttacactgctgtcttattccattttggagtctggacttattatcaataaggattttagttcatttatactctcttctccctaatttatatccaccaaatacttgtaaaatgtgtagtttgatctagaggttggcaaactttctattaagtagattgtaaaaatatatatatttatattagatatataaaatctatatttacatatagatttacatatatatatatttactccagcttttgtctaggctggagtgcagtggatcatagcttactgtaacctcaaactcctaggctcaactgatcctcctactgccgcctcccatgtagctgggactgcaggtgtgagccaccacatccagctaatttttttttgtttttgtagagacggtcttgccatcttgtcaggctagtgttgaacttctggctttaagtgagcctcttggcctcccagcatgctgggattacaggtgtgagccactgcctctggctgccagatagtaaatatttcaggctctacaggtaacaccatctctgttgtgactactcagccttctgtcatagtgcaaaagtagccatcagtggggccaggcgcaatggctcacgcctataatcccagcactttgggaggccaaggtgggtggatcaccagaggtcaggagttccagaccagcctggccaacatggtgaaaccccttttctactaaaaatacaaacaacaacaacaacaaaaaactagccaggtgtggtggtgggtgcctgtaatcccagctactcgggaggctgagacaggggaatctcttaaatccaggaggcagagattgcagtgacctgagattgtgccattacactgtagcctggatgacaagagtgaaactctgtctcaaaaacaagacaaaaattagctgggcatggttgtgggtgcctgaattccatctaggcaggagaattgcttgaacccaggaggcggaggttgcagtgagccgagatcacgccattgcattccagcctgggcgaccagcaaaactcttaaaaaaaaaaaaaagtagccaccaatgatatgtaagcagatgagcatggatatattccagtaaaacttcatttatggccaggcacggtggctcatgtctacaatcccagcactttgggaggctgaggcgggtggatcaccagaggtcaggagttcgagaccagcctggcaagatggtgaaaccccgtctttacaaaaaaaatacaaaaaattagctgggctgccgggtgcgttggctcacacctgtaatcccagcactttgggaggcttaggcggctggatcacgaggtcaggagatcgaggccatcctggctaacatggtgaaaccccgtctctactaaaatacaaaaaattagctgggggtggtggcacgcctctgtagtcccagctccttaggaggctgaggcaggggaatcgcttgaacccgggaggcagaggttgcagtgggccgagattgtgccactgcactccagcctgggcgacggagcgagcctccgtctcaaaaaaaaaaccttgcttctttgccaagcgtgatggctcacacctgtaatcacagcactatgggaggcccgaggtgggctgatcacctgaggtcaggagttcaagactagcctggtcaacgtggcgaaaccctatctctattaaaaatacagaaagcagccagacattgtggtgggcacctgtaatcccagctactcgggaggctgaggcaggagaattacttgaacccgggaggcagaggttgcagtgagccaagatcgtgccactgcactccagcctgggcaacagagtgagacacctgtctcaaaacaaaaacaaaaaccagcttttcagccaggtgaggtgaatgcatctatagtcccagctactcaggaggcagaggcagaaagctcccttgagccccaggagtttgaggctgcagtgagccatgactgcattactgcactccagcccgggcaacagagtgagactctctttttttttttttttttttttttgagacagaatctcgctctgtcacccaggctggagtgcagtggcacgatctcagctcactgcaagctctgccccccaggttcatgccattcttctgcctcagcctcccaagtagctgggactacaggcgcctgccaccacgcccggctaatttttttgtatttttagtagagacggagtttcaccgtgtttgccagcatggtctcgatctcctgacctcgtgatccacccacctcggcctcccgaagtgctgggataacaggcatgagccactgctcccagccaagactctatctttaaaagaaaaaaaaataagtcgttttccaaaagccatttgaggtggattgcagtaaaagtcttctatggagtggagaatgtttgacacagtaaaagaacaggaataggagaaagctgccatgctttccagggggctaaaatgtgtggctgagcatcctatttggctctgcgtgcccaaggtgtccctctgccctgctcccaaaaagaggagggatgtgaaaaagcaaaggtcgggaagtgggaattggaggtggttttcatcttagtacaaaaggaagtgtccccatgctaaatattccaagaaatgtttcccacaggacttacttttttttctttttttccgagactgactatcactctgttgcccaggctggagtgcagtggcgcaatcttggctcactgcaacctccgcctcccaggttcaagcaattctcctgcctcagcctcccgactacctgggactacaggtgcgtgccaccatgcccagctaatttttgtatttttagtggagacggggtttcaccacattggccaggctggtctcgaactcctgacttcaggatttgccgacctcagcttctgaaagtgctgagattacaggcgtgagccaccgtgcccagcctccaataggactttgtaaaggacattcactaagttgcacagcaaatgtagaaggaagcttgtgaaaggctttttctcgaaatgacctgggtaaaatcagactgtgtcattaaaggtccctggtgttgtgctgtaaaatgttacttttgccagtggcaggatgctgcccctgcctccaccgtgctgtaaggtagtgtgcagcatccatactgatcacctttccacaatcgcgtaagagtgtgtggacacgtgtaagccctaggcttgggtggctgggacttggtcttgcagccccctggcctgggccgcattcatctgtccacccacgcggcacaggccggacttaccctttccactgctccaggctggggcggaaagagccaacggggaggtggcaggaagccccccacagagcaggaagctgcacagaccccatgctgaaggaagaagtcatcaaggggccacatggggaccagggttgggaaaggcaggcagggctgcaggctccctaggaggccagaactggccaggggtgcagcagccgaggcctctccctgcagtgccaggctgcgtcctttcccacgcaaaggctagcctctgtgctgtggagaccagacgggaggctggagggccttggtggcagtgtaagaggctgggccaccagcagggcccaggtgtctttctcagtgcgcctggtgctaccaagaaccgtgccctgggcagatggctgaggagcgctcacctgtccctgtgcccagacactttctgagccaggtggcctcccctaatgccgctgaccagtggatttaagaaaatgtcggcccccatggccaggtgcagtggctcatatctgtaatcccagcactttgggaggccgagttgggcagatcacttgaggtcaggagttcaagaccagcctggccaacatggcgaaaccccatctctacttaaaatacaaaaaattagccaggcatggtgtcaggcacctgtaatcccagctacttgggaggctgaggcaggagaattgcttgaacccaggtggcagaagttgcagtgagctgagattgcgccactgcactccgccctgggcgacatggcaagactccatgtcaaaaaaaaaaacaaaaaaacaaaaaaactcagtccccagcgattttgggatttggaatttttgcctattcatgttcagctcctctttctggccaaggtaacaatgagttgcctcctgcagggtccctgctgtgaaatcaggccatcccgtgcttctcgatcagcaggccgcacctccaggtcagctgaaaggagcccagagcatttgaatcccagccccaactggcagcggcctttgccttggacagatgccatgtctctgaggtgcagacgggctggctctccattcaggtgtcagagcatttgagtgtgtgtggttttccaagccctgggtttgtcaatggagggaaaggtgcacaagatgtggtccgtgagctcttggatcctagaatgcttggggaagacaggccagcctcggaggctcagcctgtggtcccagctacctggggaggctgaagtgggaggattgcttgagcctgggaggtggaggctgcagtaagctaggattatgctactgcactccaacctggatgacagagtgagaccctatctcaaaaaaataaataaataaaggaaagcatccttggtagtgctgagtgctgtggggacactgttgcaattggggatgagtggcctgggaaggcttcccaagaaatggcattagggtgaggccataggaagtgagggaggggctaggcagaggaatgagcaggcacagaggcctgtagcagcagactgcacagcggcaggagcggtcctggcggcgccgggcctaggagccatgttggggtttggacttgtgctctctgaaggtctgagaggccctactggctgctggaggaagacaaggtgggggcagccaggctccttaggagctctcggaatggtgcagtccagagccatagtgttgaaggtggtaagcaggggtcagaacttggaggttcacattttatttaaagctgtttagtgagcacttgtgagtcactgacactttgtaaacatcagctcgtttactctgtgtggcaatcaggctgaggtggacagcatctcctgaggaagtaaggtgcagatgggccagcagtttgcaatggaagagctcgagggcttggggacaggctggaggaagggtgtgaggcggaggggaggtaaggagagcatcagggtttctacgcctacacggaagagtgggagaagagcaggactcacccagggagccgtgggggtgccgcgttgaagaggaatggctgcgaggccagaggggacagtgtccaggagcgcaagggtcacttggctgagtgtggcaagtgggcaagtcagggacagctgacccccaataatgctaaaacaaaa

SEQ ID NO: 259 - DNA, 8103 bp, Homo sapiens
ctgtcgtgggaagcggagtctttaaatagcctcttgctttccactaaaaatagtgaagctctgctgccgtggaggtggttgccggggcggcggggctggctcttggccaggcgggcgtgggtgcagcagcgtggccacgtgcgctggagtggtaggcagcgcgtgggccccatccactgctagtggccatagaggtcagggctgctgtgggggatccccactagccccccgactatgcagagggcctgggtgcagggagggacgcaaacccctgtgttcctgtccctgctgcttgtcacagcagctgtctcagggtgcgcaggggagagacaaggagcctgaggccagaggggcttcttggaagctgagtgggtggatttaggaacccgctgcaggccgtgtggcccgaggaccggcaagtctcttcagaggggactcgggccaggcccgttaagggctgaggaaggcgcctttcaggaaggtgtgtgagggcacaccttatagggaagctgcagagggcagcctggagtcctggaaagcttcccggaagagggggtggccttggagccaagtgctgatggctgggaagatgggaagtggtggggggtgttgtgcattctagagtccctaagtgttctactttgtcatctggggagggaggtgacaaactaaaaagaaggggctgtctggatggggatgtgcctgactgggaagagtaggggagacatgccccatgcacttactgaccaaggactggggctccccacaccccagaatctgcctggtgagaggccccactgggccagggacaggcctggatgaggcatcgtggcgcattttccatctggggctcccacctccagcctgtgtaccgcccccgccccctaccccgccccagtcatggagcctaggtcgctggaatggggtgaccttaggtctgtgggcctctctgagacggctgccctgagaggttgccgggtcagggcacgggtagcccacatgctgtactgatacgcacagcctctggccgttactcgaaggagcgatgtggctgaggtttcttggcagggctgtggcagcctccccactgcctctgagctctgagggtgaccttgcaggcccagcctgccgcaccacatagctctgcgcctgcatccgctctgcacccccagactccactctctgcccccactgtctactgcaggtgcccgtggttgacacgagctgtgtccccagctgttcccgtctacaatggcatcatcttcctctttgtcctggccaacttcagcatggccactttcatggaccctggtgttttcccccgaggtagggccctgtgctgcggcagctcctctcactttcactagagtgtgagtggctaacttgagacagccttagggattcctggtgggtgggctggacttgggggagggattcacctgccaggaaagtcaacttcctgctcactgcctggctcctggtctgtagcggatgaggatgaggacaaggaggacgacttccgggctccgctgtacaagaacgtggatgtgcgaggtatccaggtccgcatgaagtggtgtgccacgtgccacttctaccgcccgccgcgctgctcccactgcagcgtctgtgacaactgtgtagaggtgaccgccctgctgccccgcgctcccccagccctgtgccacatccctgcctgccatgtgccctgatgcactgctcccgcccaggactttgaccaccactgcccctgggtcaacaactgcatcgggcgtcgaaactatcgctacttcttcctgttcctgctgtcactcagtgcacacatggtgggcgtcgtggccttcggcctggtctacgtgctgaaccacgctgaggggctgggagccgcgcacaccaccatcacgtatccttggttcctgtgggcctcattgcagaggcgatgtggaccggggacacgttcaccagggagattgagcctcagaaggcttggttcctgcccagggatccccagtgggcaggtggccgtccctaggttgggaggaggtttgtccacaggcacctgctctgtgctgctgcgatggggtctgcggtgtcctggcctgcaccgttggccttaacgggctagcatggctgtcatgtgtgtggccggcctcttcttcatccctgtcattggcctcactggcttccatgtggtgctggtcactcgggggcgcaccaccaacgagcaggtgcagaccccatgggggatgggtggccccaaagggccgagagagttggggctgcatggggacagggtgggggctggggcacccttgcctgaggtagcttgtgcagctgtgttgagacgaggctccaactctgagacccccacgtggggctacgcctgccccgtcccctgcgcacatcctgcctgtggacactgtggccaccagtgacccagaaatcccacagctccctgcaagttcaggctgggtaacctatgtgaggggcagccctgggctgatcccacctaagccacttcccgcaagtatcagcttctaaggaaccccagctcccttgcccagccccctgcccaccctggcctggaccttgggaggccaggctggctgagggtcctgcatccacaggtgactgggaagttccgcgggggtgtgaaccctttcacccgaggctgctgtgggaatgtggagcacgtgctgtgtagccccctggcgccccggtgaggcccggcctgggcagggtggaggggggcctctgctgggtgtggggcgggcagccttagaccctcttggtccgtttggctcttgccaggtatggccagccctgcccttgtgtgtttgtggcaggtgggctggctactgacccctgtgccctggtgcaggtacgtggtggagccaccccggctgccgctcgcggtgagtttgaagccgcctttccttaggcctgaactcctggaccgagctgcaccgctcaaggtcaagcttagtgacaacgggctgaaggctggcctgggccgtagcaaggtgggcgcctgggcttagggatgggctggcagtcaggcccttggatggggaaacaggcaggttggtgggggcctagaagaggtggatggggcagacagagccgtagacagattcttgggagggggctaggtcccaggctgaatccctagtgaagccctgcccctcatccaagccccacacaccactgaccccgctccctcccagtccaagggcagcctggaccggctggatgagaagccactggacttggggccaccactgccccccaagatagaggctggcacgttcagcagtgacctgcagaccccgcgcccaggcagtgctggtgaggttggggcagccacgactagggagggatatgggttgaccctcctctgacctcagtctgacagtggtctgcatccccagagagtgccctgtcggtgcagaggaccagccccccgacacctgccatgtacaagtttaggccggctttccccacgggtcccaaggtgcccttctgtggaccaggcgagcaggtaaggaggcctagcctgccccctggcaggcctcgtcccccaggcccgcctctaggagctcgccccacagccttcaccccgtgaaggccccacctccagagccccatctctccagcagaggccacatcccctgaggccatgcccctcagggctctgcctgggtcaccaagggccttgtgtgactggtaggaccctgtctgtgtgcacccagagctgggacccacagaggggagcagggtgtcctgggaggggctggcgtgggccatccaggcttggcgtctgtcccttggccagcattgccctaggccaggtgggcggctgcccccaggagcactgtgtaccaggatgcctggaattccaccattagtcactctgtaaggcccacgggaagactttggaagaatttgagacgtgcttgagaaagcacatttctcttccctgagttgcatgagtgctctgtggtcactggaatggtgggcagtgcggggcggtctgtgcagtgatcaggaacaccaaacagtcccagggtgccatccttccttctgggccaccccgagaggcaggcctgtgactgggccctgtgcacctagaccagccccatccccagggacctctcccctcaggactgatgtctttcctggagagagtcactgggtgaagcagtgagtctgagcctccttggccaagggtctgagtctgcaggcatgtaggggccgtgcctcgcaggaggaggcatccctgtttggagatgagggctctgggtatgtcatcttcctgggactcctgggtccagtgggggattgggtctggttggccaagtgcattgagcccacatttgccctgatccacttctggctttgtggttcctgaggctcttgtcccaagcccaagcccaagcccatgcctatgtgcccgtcacaggggctagacgaggctcctcctccctctggctgccctgagtggtgggcccctggggctgcatggctccaagggcagaaccccaggtgtctgcagtagccagctgtggcctccctcctgttgcagagcccctgcccctcagccgtggatgctcagggacagggccatgggtcactatgtggctcttatggctccttgaggcccagttcctgaggccacggtgccatgtgtggcccccgtgggtgctgactggcggctgcaggcggggtggcaggtgggcagtggtgagaatgccttctccctacaggttccaggccctgattccctgaccctgggggacgacagcatccgtagcctggactttgtgtccgagccgagcctggacctccctgactatgggccagggggcctgcatgcagcctacccgccatccccaccgctcagcgcctctgatgccttctcgggcgctttgcgctccctgagcctcaaggcctcgagccggcggggcggggatcatgtggccctgcagcccctgcgctctgagggggggccccccacgccccaccgtagcatttttgccccccatgcactgcccaaccgcaacggcagcctgtcctatgacagcctgctcaatcctggctcgcctggtggccacgcctgccctgcccacccagcagttggcgtggccggataccactcaccctacctgcatcctggggcaacgggcgacccgccacggcccctaccccgcagcttcagccccgtgctgggcccccgcccccgggagccctcgcctgtgcgctacgacaacctgtccaggaccatcatggcatccatccaggagcgcaaggacagggaggagcgtgagcgcctgctgcgctcccaggccgactcactcttcggcgactcaggcgtctatgacgctcccagctcctacagcctgcagcaggccagtgtgctgtccgagggcccccgaggtcccgcgctgcgctatggctccagagacgaccttgtggctgggcccggcttcggtggcgcccgcaaccctgccctgcagacgtcactgtcctcgctgtccagctccgtgagccgtgcaccgcggacgtcgtcctcctccctgcaggctgatcaggccagcagcaacgccccggggccccggcccagcagtggctcacacaggtcacctgcacgccagggcctgccctccccgcccggcactccccactcaccatcctacgcgggccccaaagctgtcgccttcatccacacggacctcccagagccaccgccctcgctgaccgtgcagaggtgggtgccgggaggtgcgggtgggcttcctggcacagggcagctgtccagccgtctccagggcccctcttggctgggcactcataggtcatcccaggggcctgagtttttctctggggacgggacagggaggatgcgcctcaccctgccttgaaggccttggctagcccgtgtggcccagctctgaggatgtcctgggcacgctctggggacagggtatgagaatttgtgtcctgagcccgacgactcgttcttctagagctggcacagacccagcatgtgggaggccatggggctttctctttggggccagtatcatgtggcagcctgggcctcctttaggctgtggctctggcttcctgggtcacagtggccctgtccacccagggctctccctgggcctgcttggctgcatctctaggaggctggggctgaggatattacctagcagcagaatgtgccaccctgagtggccgggccctggccctccctgtaggacatagttctaggaagcaggggcttccctgctcgtaggtggggaagctgaggactggagaaagcaggctggctccaggcacccggcaggttggtgactgagaaggcggggtcagctggctcacaggcccaggtccaggtaggagagctgcacacctgctggggccaggacccacgccacagacgcatggtgtcctcacggcatctgtcgccctgtccgggcctggaaacctcaagcacaggcgcagttgtttcccgtcggcagatgcagccccagagggagagcccagcccagcccagcccaggccacttggccacaaaggggctgagggcacagcagtccagccctgagcgggtctcctctaccccacagggtgggacctgttcagcttttgtggagttggggaggaggctgccactgggagtgatgagtggggagcccgagacctagaagtgggcagcattgcagccaggcagggatcgcagcccggggacaaagggctctcgcctcaagaaggtttaagtagcaaagatacagctgctgttggtcagcgctggtgggcaggagggcagcccctcgttttcctgagagagagcaggaatgaggccaggcagagtggctgggctcccagtgcagggcacggcaggggctccattcagtgcccacctggctgccccatgctctctgtggccagtgctggctaggagggacccagggactcgggagggtggtggcagttctgacaacatctgtctgtcctgtgacagcacagctgctccccaggcaggctctgcatccctcacctgctttccaggtgaaccctccaagcccagagggcagggactgcacggggccccacaactcggctgcactagtccacgtccgcgtcgtctctgtcttgctgcctcctccgtcctctgtccccgtgttcgtgtgttcaccgtgtgcatgtgtgtatgtgcttgttttgatgcagggaccaccctcagctgaagactcccccaagtaagcttaatgggcagtccccgggcctggcccggctgggacctgccaccggccccccagggccctctgccagccctacacggcacacgctggttaagaaggtgtccggcgtgggtgggaccacctacgagatctcggtgtgaggactgactgccacacatccgccatggtgccacggggaccaggaccccacagcgcaccccccctccccaccaacttctctgccccagggacccgaggccaccccagcctggtgtggacccatcggcgggagagagtgccacgcctccacagcttgccccaagcgctctgcctgcccgtccactcatctgcccatggggaagtcggctcactgggacaagggccactgggctggtctgtgtctgggcctgtcccatggctggggcagtgagggggcccagtcagcctctttggggcaccctctctcagccaggcttggcccactgccatcacccagcaccccagatcaccgccaggccagcccccaatggtccccttacggacaggtcccagagatggacagaggcacccagggcccccaccgtccttctgacacagcctgtgggctcccggaccgagtgtcccccgccaggctactcctaactaacgcgttgcctttcacggaccccgctggaagcttgtagcttggcaaggctgatgcttctgccctggcctgctctgggtggtggtggataggtggacagacggccagccagccagctgtggccgggggcccggctccatgtgtcccgtgtctgtgtgctgtgctgccgcgccgtgtctgatgtgtcagtgctccggccgccgctgtccc
